United States Patent 10,766,935 (PLANT TRAITS CONFERRED BY ISOLATED POLYNUCLEOTIDES AND POLYPEPTIDES) - sequence listing, part 9

SEQ ID NO: 15598 - DNA, 815 bp, Arnica chamissonis
ttctcagggttcttatcggagaagtgaagtttacgagaggagaagtttccgaaaatgagcaagcttcaaagtgaagcccttagagaggcaattactcagattactactgatgccaaagaaaagaagcgtaatttcactgaaactattgagcttcaaattggtttgaagaattacgatccacaaaaggacaaacgtttcagtggcacggtgaaattgcctcacattcctcgccccaaattgaaagtttgcatgcttggagatgcccaacatgttgaagaggctcaaaaaataggccttgaatatatggacgttgagagcctgaagaaacttaacaagaacaagaagttggtgaagaaacttgactaaaaaacaccaagctttcttggcttctgagtccgtcatcaagcagattcctcgtttgttgggccctggtctaaacaaagctggtaagttccctactcttgttagccaccaggaatcccttgaggcgaaggtgaatgagaccaaagcaacagtgaagttccaactaaagaaggtgctctgcatgggagttgctgttggaaactgcagcatggaggaaaagcaaatttttcaaaacgttcaaatgagtgtcaatttccttgtttctttgctcaagaaaaattggcaaaacgtgcggtgcttatacttgaagacaacaatggggaagcccgttcgcatcttttaaggaggttcatatgtttgttatgttttcatcaacatcggaataggtttttttggcttgtcacatgtttgtttttgcaaaacactaaatccatataacttatgagatttat

SEQ ID NO: 15599 - DNA, 1107 bp, Brassica rapa
gatcagatctttgagacaagctcaaaatgaggtacctgactacatctatacattcacagttgtttgaatttaactctccttcttcctttaggctattttgggtgaccaattagataaaatacgtttgattaaggtttatattagcctgctaatggctttggtatatttagataagttgagacactggttacagtttggtttgttccaactatacttgtgtcactgttgtctgtttgattaatggttctgtccttgatggattacagtaagcttcagagtgaggccgtgaaagaagccataactgtaatcagaggcaaatccgaagataagaaacgcaacttcgttgagactctcgagctccagattggtctcaagaactatgaccctcaaaaggacaagcgtttcagcggctccgtcaaactacctcacattccacgtcccaagatgaaaatctgcatgctcggagacgctcagcacgtcgaggaggctgagaaaatggggctagactatatggacgtggagtctctcaaaaagctcaacaagaacaagaagctagtcaaaaagcttgccaagaagtaccacgccttcttggcctcggagtctgtcattaagcagattcctcgtcttcttggtcctggtctcaacaaggcaggcaagttcccgacgctcgtgagtcaccaggaatcgctggaggggaaagtgaatgaaaccaaagctactgtaaagtttcagctgaagaaggttctgtgcatgggtgttgctgttggtaacctctccatggaggagaagcagatttttcagaatgttcagatgagtgttaacttccttgtctcttttcttgaagaagaactggcaaaatgtgaggtgtttgtacctcaagagcacaatgggaccacctcaaagaatcttctgagctcttgcagctccgtcaatggtggctagatacacctgcactcttgtttttaaattgcagacatatagttaagaaatgtgttggagtgactttgtttgatggattttgtagcttatatattatcttgaattacttgttcatgaatattcaacaaacaaagaattttctaaactaaaaaaattatatgccaaagc

SEQ ID NO: 15600 - DNA, 796 bp, Picea glauca
cggtttggagaagagcagcagtaggacgacgaagaagaggcagaggcagaggcagaggaagcaaggcgccccctcctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaagcgtttcagtgggtccggtaaaattgccccacattccccgccccaagatgaaggtctgcatgctcggagatgcccaacacattgaagaggctgagaagatcagtcttgactacatgggtgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttctcaccaagagtccctggaggggaaagttaatgaaaccaaagcaactgtcaaattccaattaaaaaaggtactatgtatgggggttgctgtgggaaactgtggaatggaagaaaagcaaatttttcagaatgtgcaattgagtgttaacttccttgtatcactactgaagaagaactggcagaatgtaaggtgcttatatttgaagactaccatgggaaagcctaaccgcatttctgagttttgcaatattggtgtcagcctgtgttggctgcatatggagaggatttttccttggttt

SEQ ID NO: 15601 - DNA, 998 bp, Brassica rapa
cccccattctcttgcctgccgtccttacagcatctgaggaagttacccaaaatgagtaagctccagagtgaagccgtgagagaggcgatatcctccatgatcactcactgcaaggagacaaagccacgcaagttcactgagaccatcgaactccagattggtctcaagaactacgaccctcaaaaggacaagcggttcagcggttccgtcaagttgcctcacattccaaggcctaagatgaagatctgcatgctcggtgatgcccagcacgttgaagaggctgagaagattgggttggagtctatggatgtggaagcgcttaagaagctgaacaagaacaagaagcttgtgaagaagctagcaaagaagtttcacgctttccttgcttctgaatctgttattaaacagattcctcgtcttcttggtcctggtctcaacaaggcaggaaagttccctactcttgtgagccaccaagagtctttggaagccaaagtgaatgagactaaggcaacagtgaagttccagctcaagaaggttctttgcatgggagttgctgttgggaaccttgacatggaagagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcgaagtttcgcttaagatatcatctttaaggctgagagagatttgattttcatttctgttgtgagccttctacttcttggattaatttcagaatcctttttttggtaggttcaagattttctttataaagacaattttatttctattttgctattatgattagtgttttttgccttaagtttttcaagatttgcgatttcgttatcattatcgttatatagtgcagtacgtcaaatgatcttatatcacaacaaaaataatgtataatttgatttttctgtc

SEQ ID NO: 15602 - DNA, 906 bp, Brassica napus
agcatctgaggaagtttgccaaaatgagtaagctccagagtgaagccgtgagagaggcgatatcctccatgatcactcactgcaaggagacaaagccacgcaagttcaccgagaccatcgaactccagattggtctcaagaactacgaccctcaaaaggacaagcggttcagcggttccgtcaagttgcctcacatcccaaggcctaagatgaagatctgcatgctcggtgatgcccagcacgttgaagaggctgagaagattgggttggagtctatggatgtggaagcgcttaagaagctgaacaagaacaagaagcttgtgaagaagctagcaaagaagttccatgctttccttgcttctgaatctgttattaaacagattcctcgtcttcttggtcctggtctcaacaaggcaggaaagttcccaactcttgtgagccaccaagagtctttggaagccaaagtgaatgagactaaggcaacagtgaagttccagctcaagaaggttctttgcatgggagttgctgttggtaaccttgacatggaggagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcgaagtttcgcttaagatatcatctttaaggctgagagagatttgattttcatttctgttgtgagccttctacttcttggattaatttcagaatccttttttggtaggttcaagattttctttataaagacaattttatttctattttgctattatgattagtgttttttgccttaagtttttcaagatttgcgatttcgttatcattatcgttatat

SEQ ID NO: 15603 - DNA, 922 bp, Raphanus sativus
ggaagttactcaaacccttctcatgccgtcctcttagcatctcaggaagtaagccaaaatgagtaagctccagagtgaagccgtgagagaggcgatatccgccatgatcactcactgcaaggagacgaagcctcgcaagttcaccgagaccatcgaactccagattggtcttaagaactacgaccctcaaaaggacaagcgtttcagcggttccgtcaagttgcctcacatcccaaggcctaagatgaagatttgcatgctcggtgatgcccagcacgttgaagaggctgagaagattggattagagtctatggatgtggaagcacttaagaagctgaacaagaacaagaagcttgttaagaagctagcaaagaagttccatgctttccttgcttctgaatccgttatcaaacagattcctcgtcttcttggtcctggtctcaacaaggcaggaaagttcccgactcttgttagccaccaagagtctttggaagccaaagtgaacgagacaaaggcaacagtgaagttccagctcaagaaggttctttgcatgggtgtcgccgttgggaaccttgacatggaggagaagcagatctttcagaatgttcagatgagcgtcaacttcctcgtctcactattgaagaagaactggcaaaacgtgaggtgtttgtacttgaagagcacaatgggtccacctaaccgtgtgttctaagattattattatctcaaagtttctcttaatgtatcatcaaaggctgagattagatttgattttcacttctgtcgtgagctttcttcttcttggattacttccagaatccttacttttgtaggatcaagattttcttaaaagacagttttgtttctattattgctatttttgttagtgtttttttttcatttaagttttcaaaatttaata

SEQ ID NO: 15604 - DNA, 1090 bp, Brassica rapa
gctcatataaagttacacaaacacttctctggccgttcttttctctgtctcctatctatcgcaaggtatactttcttcttcttcacttggtcacggctactcttcatcgtctctaaacgttccttgataaaaccttgttttgcaggagagactagtagctgaggaagtgccaaaatgagtaagctccagagtgaagccgtgaaggaggcgatatcaaccatcatcacccactgcaaggagacaaagcctcgcaagttcaccgagactatcgagctccagattggtctcaagaactatgaccctcaaaaggacaagaggtttagcggttccgttaagttgcctcacattccaaggcccaagatgaagatttgcatgctcggtgacgcccagcacgttgaagaggctgagaagattgggttagagtctatggatgtggaagctcttaagaagctgaacaagaacaagaagcttgttaagaagctagccaagaagttccatgctttccttgcttctgaatccgtcatcaagcagattccccgtcttcttggtcctggtctcaacaaggcaggaaagttcccaactcttgttagtcaccaagagtctttggaggccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgtgaggtgcttgtacttgaagagcactatgagtccacctacccgtgttttctaagattattttatctctaaagtttctctcaaggtatcatcagggctgagaggagatttcgttttcatttctttcatgattaagattttgtttaaagacagttttatttatattattcctattactcttggtgaattttctctatttatgttagattaacccaatcttattacaaaataacggaataaaatcacaagaaaccaataaacagtgttttattatcataaatataaacaaaacattagatttcacaaagcgaaacaaa

SEQ ID NO: 15605 - DNA, 915 bp, Brassica napus
gtcacggctactcttcatcggctctaaacgttcgttgataaaaccttgttttgcaggagagactagtagctgaggaagtgccaaaatgagtaagctccagagtgaagccgtgaaggaggcgatatcaaccatcatcactcactgcaaggagacaaagcctcgcaagttcaccgagactatcgagctccagattggtctcaagaactatgaccctcaaaaggacaagaggtttagcggttccgttaagttgcctcacattccaaggcccaagatgaagatttgcatgctcggtgacgcccagcacgttgaagaggctgagaagattgggttagagtctatggatgtggaagctcttaagaagctgaacaagaacaagaagcttgttaagaagctagccaagaagttccatgctttccttgcttctgaatccgtcatcaagcagattccacgtcttcttggtcctggtctcaacaaggcaggaaagttcccaactcttgttagccaccaagagtctttggaggccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgtgaggtgcttgtacttgaagagcactatgagtccacctacccgtgttttctaatattattttatctctaaagtttctctcaaggtatcatcagggctgagaggagatttcattttcatttctgtcatgattaagattttgtttaaagacagttttatttatattattcctattactcttggtgaaaaaaaaaaaactaaacagatctcacgagacacacggaggagtgc

SEQ ID NO: 15606 - DNA, 904 bp, Artemisia annua
acggggattgatagcggcactttgaaaccctaatagcagggttcttaccacagaagtgaagtttaacgaaaggaaaagtcagcaaacatgagtaagctatcaagtgatgctcttagggaggcaattactcagatcaccaccgatgccaaggagaagaaggtccgtaactttgttgagactattgagcttcagattggtttgaagaattacgatccacaaaaggacaagcgtttcagtggtaccgtcagattgccccacattcctcgtcctaagttgaaggtttgcatgcttggagatgctcagcatgttgaagaggcccagaagattggtcttgagtatatggatgttgagagcttgaagaagctgaacaagaataagaagttggtgaagaagcttgctaagaaacaccaagcttttttggcttctgagtctgtcatcaagcagattccccgtttgttgggtcctggtcttaacaaggctggtaagttccctacccttgtttcccaccaggaatctcttgaggcaaaggttaacgagaccaaagccactgtgaagtttcaactgagaaggttctttgcatgggtgtcgctgttggaaactgcagcatggaggagaaacagatcttccaaaatgtgcaaatgagtgtcaacttcttggtttctttgttgaagaagaactggcaaaacgtgcgatgcctatacttgaagacaaccatgggaaagccagttcgcatcttttaagaagtttatgggttgctatgttttcattttggttaatgttgaggatggtactggaaagttttccaatgaacaggaaatagtcctttttggcttgttacatgtttgtttggtactatatttttggacaccttactttagatgttatattatcgaagttacttctg

SEQ ID NO: 15607 - DNA, 838 bp, Fraxinus spp
gagatattgaacaatgagtaagcttcagagcgaggccctgagagaagcaatttctgtaattgttaccgattctaaggagaaaaacgtaatttcacggagacgattgagcttcaaattgggctgaaaaattatgatccccagaaggataagcgattcagtggctcggtgaagttgcctcacattcctcgccccaaaaatgaagatttgcatgcttggtgatgctcagcatgttgaggaggcagaaaaaataggattggagtccatggatgtggaggctctcaagaagttgaaacaaaaaacaagaagttggttaaagaaacttgacaaaagaaatatcaatgctttcttagcctcagaagctgttatcaagcagattccgcgtctattaggacctggtcttaacaaggcaggaaagttccccaccttgtgtcacaccaggaatctcttgaatccaaggtcaatgagacgaaggccacagtgaaatttcaattgaagaaggttctttgcatgggagttgctgttggaaatttgggtatggaggagaagcagatctttcaaaacgtgcaaatgagtgtcaactttctagtttcactgctgaagaagaattggcagaatgtcagatgcttgtacttgaagagtacaatggggaagcctcagcgcatcttttaagatgtatgtttcttcacagctagttcgggaagtatttacgagcttaaacaattaaatgtatttatcatgaacattttttcctcactctcgtctgttcgaagcttgctgctattaatcaactgtttctgttggaaacaatctttttctctgaaatacatgcttagaaatc

SEQ ID NO: 15608 - DNA, 779 bp, Ipomoea nil
ggcttcgtatacctcaggacttgacttcaggtatttacaagggacagcaaagtcgtccgccatgagtaaattgcaaagtgatgccgtgagggaagcaatcacccagataatgggggattccaaggagaagaatagaaaattcacagagactattgagctgcaaattgggttgaagaattatgatccccagaaggataagcgtttcagtggctctgttaaactaccccacattccccgccctaagatgaagatatgcatgcttggtgatgctcagcatgttgaagaggcagaaaagattggaatggagtatatggatgtggagtttaaagaaactcaacaagaacaagaaacttgtaaagaagctggctaagaagtaccatgccttcttggcatctgaagctgttattaaacagattccaaggcttttgggccctggtcttaacaaggcaggtaagtttccaacattggtgacacatcaagagtccttggagaacaagtccaatgaaacgaaagctatggtgaaatttcagcttaagaaggtcctctgtatgggtgttgcagttggaaatgtggcaatggaggagaagcaggtgtttcagaatgttcagatgagtgtcaacttccttgtctcgctgttgaagaaaaactggcaaaatgtcaggtgcttgtatctcaaaacaaccatgggaaggacagtccggatcttttgagttggtgcttttgtttttctagagttctgtagggagagctgagaattggatttgtcatcttcttctagt

SEQ ID NO: 15609 - DNA, 733 bp, Lotus japonicus
ggcttcccagctccagccgccaaatctcattagggtttcgccactgctgtgagctcttcttccaatgattcggaacgatgagtaagcttcagaatgatgctgtcagagaagctatctccggaatcatgactgattccaaggagaagaatcgcaaatttgtggagaccattgaactccagattggtctcaagaactatgatcgccagaaagacaagcgtttcagtggctctgtcaagttgccccatatccctcgacccaagatgaagatttgcatgcttggtgatgctcaacacgtcgaagaggcggaaaaattggattgaactggatggacgtcgaagcattgaagaagctgaacaaaaataagaagttggtgaagaagctagctaagaaataccatgcatttttagcttctgaggctgtcattaagcagattcctcgtcttttgggtcctggtctcaacaaggaaggcaagttccctacacttgtcactcaccaagaatcccttgaagcaaaggttaatgagactaaggctatggtcaaatttcagctcaaaaaggtgctctgcatgggagtcgccgtgggtaatgttagcatggaagaaaaacagatctttcaaaacgtgcaactgagtgttaacttccttgtctctttgttgaaaagaactggcaaaatgttagtgcttgtatctgaagagtaccatggggaaatcgtaccgcgtctttaaggatttatt

SEQ ID NO: 15610 - DNA, 868 bp, Guizotia abyssinica
atcggcaggcagtttgaaaccctactctcagggttcttaccggagaagttaaatttaggagaggagaagcttcagaaaatgagcaagcttcaaagtgacgccctacgagaggcaattactcagattactactgatgccaaagaaaagaagcgtaatttcactgaaaccattgagctccaaattggtttgaagaattatgatccacaaaaagacaaacgtttcagtggtacagtgaaattgccccacattcctcgtcccaagttgaaagtttgcatgcttggagatgcccagcatgttgaagaggcccaaaaaataggccttgagtatatggatgttgagagtctgaagaagctgaacaagaacaagaaattggtgaagaaacttgcaaaaaaacaccaagctttcttggcttctgaatctgttatcaagcagattcctcgtttgttgggccctggtttgaacaaagctggtaagttccctactcttgtttcccaccaggaatcccttgaggcgaaggtcaatgagaccaaagcaacagtcaagtttcaactgaagaaggttctgtgcatgggagttgctgttggaaactgcagcatggaggaaaagcagatttttcaaacgttcaaatgagtgtcaatttccttgtttctttgctgaagaagaactggcaaaatgtgcggtgcttatacttgaagacaaaaatggggagccggttcgcatcttctaaggagtttatttgttctgatgttttcattttgggttattgttgaggttggtatgttcctcattaaaaccggaatagttttcttcgcttgtcacatttctgtttttgtaacacctcaaaatctattttacttggagatttatt

SEQ ID NO: 15611 - DNA, 717 bp, Ambrosia trifida
taccctggtgttaggaagagctaattaaaaatgagtaaacttcagagcgaagccctcagggaagccattactcagatcaccaccgatgctaaagaaagaaacgtaacttcaccgagaccattgagcttcagatcgggctcaagaactacgacccacaaaaggacaaacgttttagcggtactgttaagttgcctcacattcctcgtcctaaattgaaggtttgcatgcttggagatgcccaacatgtggaagaggctcaaaagattggtcttgaatatatggatgttgaaggactcaagaaacttaacaagaacaagaagctagtgaagaagctagccaagaaacaccaggcgtttttggcttccgaatctgttatcaagcaaattcctcgtttgttgggccctggtctaaacaaggcaggaaagttcccaacgcttgttagtcaccaggaatctctcgaggctaaggtgaatgaaaccaaagcaacggttaagtttcaactgaaaaaggtgctgtgcatgggagttgctgttggtaactgcagcatggaggagaaacagattttccaaaacgtgcagatgagcgttaatttcctcgtttcattgttgaagaagaactggcaaaatgtgagatgtttgtacttgaagacaacgatgggaaagccggttcgcatcttttagatattgtgtttgttttgttttcaaacttgttgtgagg

SEQ ID NO: 15612 - DNA, 915 bp, Flaveria ramosissima
cgacgagagtacgatggggagtacggcggtgtctgttacgggttcgtaccgaagaagagtaggtttaaggaaaggaaaactaaacgaaaatagagtaagcttcagagtgatgcccttagggaagctattacccaaattactaccgatgctaaagaaaagaaacgtaatttcactgagaccattgagcttcagattggccttaagaactacgacccacaaaaggacaaacgtttcagtggaactgtgaagttgcctcatattcctcgacccaaattgaaagtttgcatgcttggagatgcccagcatgtagaagaggctcaaaagattggtcttgaatatatggatgttgaaggactcaagaagctcaacaagaacaagaagctggtgaagaagcttgctaagaaacaccaggcttttttggcttctgaatccgttatcaagcaaattcctcgtttgttgggccctggtcttaacaaggcaggaaagttcccgacacttgttactcaccaggaatccctcgaggctaaggtgaatgaaactaaggcgacagtcaagtttcaactgaaaaaggtgttgtgcatgggagttgctgttggtaactgcagcatggaggaaaaacagatcttccaaaatgtgcagatgagcgttaatttcctcgtttcattgctgaagaaaaactggcagaatgtgagatgtttgtacttgaagacaacaatgggaaagccagttcgcatcttttaggtattcagtctgtttttctcttacaaatttgttgtgaggtggtgtcggttttgacttatcgggtctctgttatgtgttatcttctcgttttagatgataccatgaacgttatgtttactggttactggttattttaacaatttttttgtcatcttaaggagagtatttgtttcg

SEQ ID NO: 15613 - DNA, 978 bp, Malus domestica
gagtcgctacttctcctttcaccctcactcagtagcggcagcccgaaaatcctgttctttcgtcttccttcttcaggaagttttttcgcagcgaggacaaagatctaaccaaccatgagtaagctgtcaagcgatgggctgagggaagccatttctcagattaagacgaactctgagacaaagaagaggaagttcactgagacagtggagcttcagattggtctgaagaactatgacccccaaaaggacaagcgtttcagtggttctgtcaggcttccacacattcctcgccctaagatgagggtttgcatgcttggagacgcccagcatgttgaagaggcagagaagatgggtttggattatatggacgtggaaagcttgaaaaagctgaacaagaacaagaaacttgtgaagaagcttgccaagaaataccatgcctttttagcttctgaagctgtcattaagcagattcctcgtcttcttggccctggtcttaacaaggcaggtaagtttccaaccttggtgagtcaccaggaatctctggaggcaaaacttaacgagaccaaagctatggtgaagttccaacttaagaaggttctttgcatgggtgttgctgtcggaaatctcgctatggaggagaagcagattttccagaatgtacaactcagtgtcaatttcttggtttcattgttgaagaagaactggcaaaatgtgaggtccttgaacttgaagagtacgatggggaaagctatccgtatctactaagttaatctttatcgaaaactttccaagtgaaggaagcatcagcgtaacttttttgaaagacatttatacctttcggtgttctattttgtttttgatgactttgatttcgttgttaaaccataatttagtactcgatgttgctctggatgaatgcttttggaaaattttgaaggaaagccttttctttctctccggtgtttggtggatggtgat

SEQ ID NO: 15614 - DNA, 1010 bp, Leymus cinereus x Leymus triticoides
ggtttctagagacgagagccactcctcctcgcgccgcccctccactcctccccaaaccctagtagaccaggtgaatcggcgacaggtgaatcgatcgatcttcgcggccagccatgagtaagctgcagaccgaggccctcaaggaggccatcacccaggtggtggcggaggccaaggagaagaacaggaagttcactgagaccgtcgagctccagatcggcctcaagaactatgatccgcaaaaggacaagcgtttcagcggctccgtcaagctgccccacgtccctcgccccaagatgagggtctgcatgctcggtgacgcccagcatgtgggagaggctgacaagattggtcttgattccatggatgttgaagctcttaagaagatgaacaagaacaagaagcttgtcaagaggcttgccaagaagtaccatgctttcttggcctcggaggctgtcatcaagcagattccacgtctccttggtcctggtctcaacaaggcaggcaagttcccgactctggtttctcaccaggagtctctggaagccaaggtgaacgagacgaaagccacaatcaagttccagctcaagaaggtgctgtgcatgggcgtcgcggtgggcaacctgtcgatggaggagaagcagatccagcagaacatccagatgagcgtcaacttcctggtttccctgctcaagaagaactggcagaacgtgaggtgtctgtacatcaagagcaccatggggaagccggtccgggtgttctaagcctgtgcccatgccgtccgtctatatcaatgctacctacaatactggacttccttactatgttcatctttaagtatgtcggtgtcgtgtcgtagtttttattgaattttgcgagtgtcctggtgaatgaagatgaaggaagagtactactgtttctcctgagttgtgattctgatggaacaatagctcatcaagatcatgccagaatctgttatataatatgttgtggatgcatgttgtgtgcca

SEQ ID NO: 15615 - DNA, 1061 bp, Aristolochia fimbriata
agtggtaacaacgcatccgacgcgggggggtttttgttcgtgtaactcccctgcttcctatctccaaaaccctgtgagagtttacacttcgaagactctccaccgcaggaaggagactcctcgcgtgcatattttggttttccgtctgcgaagatgagtaagcttcagagtgatgttctgagagaagctattggccaggttatggctgatgccaaagagagaaaacgtaacttcactgaaactattgaacttcaaattgggcttaaaaactatgaccctcagaaggacaagcgtttcagtgggtcagtcaaacttcctcatatcccaaggcccaaaatgaaagtgtgcatgctgggggatgcacagcatgtcgaagaggcagaaaagataggaatggactacatggatgtggaaggcctgaagaaacttaacaaaaacaagaaactagtcaagaaattggccaagaaatatcatgctttccttgcttcagaggcaatcatcaagcaaattcctaggcttctgggtcccggtctgaacaaagccggtaaatttcccaccctggttacccaccaggagtcgctggaatcaaaggtgaatgaaacaaaggcaatggtcaagttccagcttaagaaggttctgtgtatgggagtggctgtagggaactgcggaatggaagagaagcaagttttccagaatatccagctcagtgtgaatttcctggtttctctcttgaagaagaattggcaaaatgttcgatgcttgtatatcaagcgtacaatggggaaaccgtaccgggtgttctaaaagctgtgtcatttgctgaacgagaatttggagctgcttacacacttgtctttgctagaacttatattgagcagtttttggtttaggagtgagtttagtatttcttatgagtttctgtgtaaactttgaaagttctgctaccttttattttgacgtgaaagtttttgatacatttttcaagtgtagtatggcaaagatgaatctgctatataatttcgtttcaaactccaaggttggcttacggtttatcgaaaagt

SEQ ID NO: 15616 - DNA, 984 bp, Brassica rapa
agccgccttttagagaaggttagagcttcctctgcttcacctttcaagctcagagattcgtcaattgagagcaactcaagatgagtaagcttcaaagcgaggttcttagagaagggatcacagctgttaagggcaaagccgatgagaaaaaacgcaactttgtcgaaacggttgagcttcagattggtctcaagaactacgacccacaaaaggacaaacgtttcagtggttctgtcaagctccctcacattcctcgccctaaaatgaagatctgtatgcttggagatgctcagcatgttgaggaggctgagaagattggactagactatatggacgttgaggctttgaaaaagctcaacaagaacaagaagcttgttaagaagcttgccaagaagtaccatgctttccttgcttctgaatcggtcattaagcagatccctcgtcttcttggtcctggtcttaacaaggcaggaaagttcccgacgctagtgagtcaccaagagtcgttggaagggaaggtgaatgagacaaaagcgacagtgaagttccagttgaagaaggttttgtgtatgggtgttgctgttggtaacctttccatggaagagaagcagctctttcagaatgttcagatgagtgttaacttccttgtctcgctgttgaagaagaattggcaaaacgtaaggtgtttgtacttgaagagcaccatgggaccaccacaaaggatcttttgagctctctgcttttttaatctttggaaatttgctttgcgttttttgtttcaaatatctagtgcttcttgagatatatggttcggattgattataacggaactcaggtgctagtttgcttttcgttaaaagacaaatataatatatgcaatgtttgcgtttaaagcttcaatcacgtctcgtttctggttttcccattacccttttattgactggttacagtagaaacggttcacaacttaagcgcaacgatgag

SEQ ID NO: 15617 - DNA, 850 bp, Brassica napus
ttcacctttcaggctcagagattcgtcaattgagagcaactcaagatgagtaagcttcaaagcgaggttcttagagaagggatcacagctgttaagggcaaagccgatgagaaaaaacgcaactttgtcgaaacggttgagcttcagattggtctcaagaactacgacccacaaaaggacaagcgtttcagtggttctgtcaagctccctcacattcctcgccctaaaatgaagatctgtatgctcggagatgctcagcatgttgaggaggctgagaagattggactagactatatggacgttgaggctttgaaaaagcttaacaagaacaagaagcttgttaagaagcttgccaagaagtaccatgcgttcctggcttctgaatcggtcattaagcagatccctcgtcttcttggtcctggtcttaacaaggcaggaaagttcccgacgctagtgagtcaccaagagtcgttggaagggaaggtgaatgagacaaaagcgacagtgaagttccagttgaagaaggttttgtgtatgggtgttgctgttggtaacctttccatggaagagaagcagctctttcagaatgttcagatgagtgttaacttccttgtctcgctgttgaagaagaattggcaaaacgtaaggtgtttgtacttgaagagcaccatgggaccaccacaaaggatcttttgagctctctgcttttttaatctttggaaatttgctttgcgttttttgtttcaaatatctagtgcttcttgagatatatggttcggattgattataacggaactcaggtgctagtttgcttttcgttaaaagacaaatataatatatgcaatgtttg

SEQ ID NO: 15618 - DNA, 915 bp, Brassica napus
cgagcatgagtcgatgccagcggcaccggccctgaattcacgggtcgacccacgcgtccggcttcctctgcttcacctttcaggctcagagattcgtcaattgagagcaactcaggatgagtaagcttcaaagtgaggttcttagagaagggatcacagctgtgaagggcaaagccgatgagaaaaagcgcaactttgtggagacagttgagcttcagattggtctcaagaactacgacccacaaaaggacaagcgtttcagtggatcagtcaagctccctcacattcctcgccctaaaatgaagatctgtatgctcggagatgctcagcatgttgaggaggctgagaagattggactagactatatggatgttgaggctttgaaaaagctcaacaagaacaagaagcttgtcaagaagcttgccaagaagtaccatgctttccttgcttctgaatccgtcattaagcagattcctcgtcttcttggtcctggtcttaacaaggcaggaaagttcccgactctagtgagtcaccaagagtcgttggaaggaaaggtgaatgagaccaaagcgacagtgaagttccagttgaagaaggttctgtgtatgggtgttgccgttggtaacctttccatggaagagaagcagctctttcagaatgttcagatgagcgttaacttccttgtctcgctcttgaagaagaattggcaaaacgtgaggtgtttgtacttgaagagcaccatgggaccacctcaaaggatcttttgagctctctgcttttatcatctttggaaatttcgctttgctttttttgtttcaaatatctagtgcttcttgagatatatggttcggattgataatagcggaactcgggtgctaggttgcttttcgttaaaagacaaatataatatatgca

SEQ ID NO: 15619 - DNA, 847 bp, Salvia sclarea
ctcacaacccctgctctagggtttttcttcagtgattcgggaagctaattgatcgtgaacgatgagtaagcttcagagtgaggcgctgagggaagccatcactgtgattgttgcagaggctaatgagaagaagcgcaacttcactcagactgttgagctccagattggactcaagaactacgacccccaaaaggacaagcgtttcagtggctctgtgaggttgccccatatcccgagacccaaaatgaaactctgcatgcttggagacgcccagcatgttgaggaggcggagaagatcggcctcgagtccatggatgtggaagcactgaagaagttgaacaagaacaagaaactggtgaagaagctagcaaagaggtaccatgctttcttggcctcagaagcagttattaagcagattccacgtctcttgggacctggtcttaacaaggcaggtaagttccctactcttgtgacacaccaggagtcgcttgaagccaaggtgaacgagacaaaggccactgttaagttccagttgaagaaggtgctttgcatgggtgtagctgttggaaacctcgacatggaggagaagcagatcttccaaaatgtgcaaatgagtgtcaacttcctcgtttcccttttgaaaaagaattggcaaaatgtgaggtgcttgtacttgaagagtacaatgggaagagtgcagcgtattttctgataagtttataaacttttgttattgaattctcagagggagcagaaaatattctaaattctaaactttccagaaatgggaacgttttggttttctctttttgtgttgttgaactctttttagctgttgcggatactc

SEQ ID NO: 15620 - DNA, 1094 bp, Fragaria vesca
gcagcccaaactagacacagctttgattaggttttagcagtcatcacctctcaatctccagctccttatataaacttgcttggccgccagaaccctaacggcgcctcctgcttctcttctctacggtgagaaatcgctggtggaggatcggacacgtcttaagtttcgatcatgagtaagcttcagagtgatactctcagggaggctatctctgtcatcatggctgcttccaaggagaagaatcggaagttcacagaaactattgagcttcagatcgggttgaagaattatgatccccaaaaggacaagcgtttcagtggttctgttaagctgccacacattcctcgtccaaagatgaaggtctgcatgcttggagatgctcagcatgttgaagaggctcagaagatcggtttggagtacatggatgtagaagcactgaagaagttaaacaaaaacaagaaattggttaagaaactggctaagaagtaccatgcttttttagcatcagaagctgttatcaagcagattccccgtcttttgggtcctggtctcaacaaggcaggaaagttcccaacccttgtttctcaccaagaatccctggagtctaaaatttctgagacaaaagcgacaattaagttccagttgaagaaggttctctgtatgggagttgctgtagggaatgtctcaatggaggagaagcaaattttccaaaatgtgcaactgagtgtgaacttccttgtttcactattgaaaaagaattggcaaaacgtaaagtgcttgaacctcaagaccacaatggggaagccatatcgtgtttattagagtcttcacttagttttggagatttgtagctacagtttgtaagaagcctgctccttatagggactgctccttgtaggaagcgtgtttattttgatggtccagtttcttatatgcctgttttactttttgctcaatgcttgtcaacattgttatgttagactttctattattattattgtgggagggtaaactgattttcaattttgtgtcgcatattatgttgaccaatgatatttctatgcacctgcatgttttgaaagatttaaccattc

SEQ ID NO: 15621 - DNA, 869 bp, Tragopogon dubius
cggggggtttttcctctcgaacttcatcggcagtgctgctagggttctcaccaaagacgtgaagtttcaggaacggaaacttaacagccatgagtaagcttcagagtgaagctcttcgtgaagccattactcagatcacaaccgatgctaaggaaaagaagagaaacttcaccgagaccattgaactccagattggtctcaagaactacgacccccaaaaggacaagcgtttcagtggtacagtgaagttgcctcacattcctcgccccaagttgaaagtttgcatgcttggagatgcccaacatgttgaagaggctcaaaagataggccttgaatacatggatgttgaaggactcaagaagctaaacaagaacaagaagctagtgaagaagcttgccaagaaacatcaagctttcttggcttctgaatctgtcatcaagcagattcctcgtttgttaggccctggtctaaacaaagcaggaaaattcccaacacttgttacccaccaggaatccctagaaggtaaagtgaatgagaccaaggcaactgtgaagtttcagttgaagaaggttttgtgtatgggagttgctgttggaaactgcagcatggaggagaagcagattttccaaaatgttcaaatgagtgttaacttcttggtttcattgctcaagaagaactggcagaatgtgaggtgtctttacttgaagacaacaatggggaagcctgtgcgaatcttttaggtgtttgttttttgaaaattgggtgttgatcgtttttggtttgatgaatgtttaattttaaattgtattgctataaacattatgtttactggtagctttaaaccctttttaatcttttatctatttggg

SEQ ID NO: 15622 - DNA, 941 bp, Lotus japonicus
atttttgcctccggtatctcctcttcctctatccgattctctcaccttttcttctgctgctgcgctaagatctaacaccccattttcgttttctccttctttctcttcacaggtgtaagatccaattcgaaaaaccccaattctcaaaatatgagcaagctgcagaatgatgctgttagggaagctatctctggaatcatgactgattccaaggagaagaaccggaaatttgtggagaccattgagctccaaattgggttgaagaactacgacccacagaaggacaaacgtttcagtggctctgtcaagttgcctcacattcctaggcccaagatgaaaatctgcatgcttggagatgcccagcatgtggaggaggctgagaagataggtcttgagtccatggatgttgaagctttgaagaagctcaacaagaataagaagctggtgaagaagctggctaagaagtaccatgcctttttggcttctgaagctgtgatcaagcagatccctcgtcttctgggtcctgggaagttccctacacttgttactcaccaggaatctctagagtcaaaggtcaatgagaccaaggctatggtgaagttccagctgaagaaggtgctctgcatgggtgtagctgttggcaacgttagtatggaggaaaagcaaatcttccaaaacgtacaattgagtgtcaacttcctcgtctccctcttgaagaaaaactggcaaaatgttaggtgcttgtacctgaagagcactatggggaaatcataccgtgtcttctaaggagctgttgtaattgcagtgaatttccgatctcatttgtttcctcttattacttggataggagtttcaatctctctacagttttgttggatgttttttttaacaaaagaatttcatattcctgcttgttttgtttaagtgctttgcaacaattg

SEQ ID NO: 15623 - DNA, 912 bp, Fragaria vesca
gcctttcactcagagccgtctcctccatccctctcattccttcatccctgttccgatttcgtcatgagtaagcttcaaagtgaggcattgagggaggccatctcccagatcaagactaatgcggagaccaagaagaggaagttcactgagactgtggagttgcagattggtctgaagaactatgacccacaaaaggacaagcgtttcagcggttccgtcaggcttccccacattcctcgccccaagatgagggtttgtatgcttggagatgcccagcatgtcgaagaggctgagaagatgggattggcctacatggatgtggaatccctgaagaagcttaacaagaacaagaagcttgtcaagaagcttgcaaagaagtatcatgcttttttggcttctgaggctgtcatcaagcaaattcctcgtcttttgggccctggactcaacaaggcaggtaagttcccaactcttgtgagtcaccaggaatctctggaggcaaagcttaatgaaaccaaggccatggtgaagttccaactcaagaaggttctttgtatgggtgttgctgtcgggaatcttgccatggaggagaagcagatattccagaatgtgcaactcagtgtcaatttcttggtttctctattgaagaagaattggcagaatgtgaggtcgttgaacctgaagagcaccatgggcaaagcaattcgaatctactaagttcttacgtttcagcaggagctattatgtggacgaagagcagtagcaaaactatcatccttttgtttactttagtttaaattcatagcctaaactacaaggtgtactgtgatttttgttcaattgaatgcttaattttgaagggattctgtttgttcttcaatatctgcttgtcatggtttttagtttgttgtgtac

SEQ ID NO: 15624 - DNA, 868 bp, Pisum sativum
cgctttttgttgtgagatctgtagctgattacccactgtattctgttatcaaaatgagtaagcttcaaagtgaggctgtgagagaagccatctcaggaatcatgggtgattccaaggacaagcaaaggaagtttgtggaaactattgagcttcaaattgggctcaagaactacgatccacaaaaggacaaacgtttcagtggatccgtcaagttgccccatatccctcgccccaagatgaagatttgtatgcttggagatgcccaacacgtcgaagaggcagagaaaataggtttggagtcgatggatgttgaagctttgaagaagctcaacaagaataagaagttggtgaagaaactagccaagaggtaccatgccttcttagcttctgaggcagtcattaagcagattccccgtctcttgggtcctggtctcaataaagcagggaagtttccaacacttgtgtcccaccaagaatctcttgaggcaaaggtaaatgagaccaaagctatggtcaaatttcagcttaagaaggtgctctgcatgggagtagccgtgggcaatgttagcatggacgagaagcaaatctttcaaaatgttcaactcagtgttaacttcctagtctctttgttgaaaaagaactggcagaatgtccgttgcttgtatctgaagagttcaatggggaagtcttaccgtgtcttttaggaagtttattttcttaacattgttccgatattcagcggcgcgcaatctctctctttagttatcctaatagttggatagaatatttcatcttctcacaattttgctggttttttaatgttaatttttgtctttatgttaaaatacttgatgattttacgattgct

SEQ ID NO: 15625 - DNA, 1021 bp, Prunus persica
gcgctgaacatgctctaacaaaacgtagcagctagggtttttataaagcgccaaagttcccttccgccttttgcctcactcagcagcagcagccctgcaaatcctgttctagggtttcgctctctttcttgaggaagtatttgcacaggaattgcagcgaggaaaaggctgtaaccatgagtaagctctcaagtgacgggctgagagaggccatcgctcagattaagacaaactcagaaacgaaaaagagaaatttcaccgagacagttgaacttcaaattgggttgaagaactatgacccacaaaaggataagcgtttcagtggctctgtcaggcttccacatattcctcgtcctaagatgagggtttgcatgcttggggatgctcagcatgttgaagaggcagagaagatgggtttggactacatggatgtggaaagcttgaaaaagcttaacaaaaacaagaaactggtcaagaagcttgccaagaaataccatgcctttttagcttctgaagctgtcattaagcaaattcctcgtcttctaggccctggtcttaataaggcaggtaagtttccaacattggtgagtcaccaggaatctttggaggcaaaagtgaatgaaaccaaagcaatggtgaagttccaacttaagaaggttctttgcatgggtgttgctgtggggaatttggctatggaggagaagcagatttttcagaatgtacaactcagtgtcaatttcttagtttcactattgaagaagaattggcagaatgtgaggtccttgaacctgaaaagtaccatggggaaagcaatccgtatctactaagttcttaagctctatcagagacttttgtagcggaggaagcattagcagaactttaattaagacatttcttgcaaatgattttatgttcccttttgtttttgttgactttgatttctttgtttaaattataatgagtactgtatttttggtttgaacgaatgttggaagattttgaaagaaattttcttcacccc

SEQ ID NO: 15626 - DNA, 950 bp, Papaver somniferum
ttctaccaggaaaataaccatgagtaagcttcagagtgaagtgttgagggaagcaatctcccagatcaataccgaagctaccgctaagaagcgaaagttcaccgagacagtggaacttcaaattggtcttaagaactatgaccctcaaaaggacaagcgtttcagtggttcagtgaagttgccacatataccccgccctaagatgaaagtctgcatgcttggagatgctcagcatgttgaggaggctcagaagatcggtcttgagtacatggatgttgaaggtcttaagaagcttaacaagaacaagaagttggtcaagaagcttgcaaagaagttccatgcttttctagcctcagaagctgttatcaagcaaattccccgtcttcttggacctggtcttaacaaggcaggtaagttcccaactcttgtgactcatcaagagtcattggaggccaaggtgaatgaaaccaaggctatggttaagtttcaattgaagaaagtgctctgtatgggtgttgctgttggtaaccttggcatggaggagaagcagatcttccagaacgttcagcttagtgtcaactttctagtatcattgttgaagaagaattggcaaaatgtgaggtgcttgtacttgaagagtaccatgggaaagccagtccgcatcttctaagcattacatttctataattgtaagggcaattcctacacgctcttcatgttttgtgagatccctggatgtagggaatgccccaagtcccgagactctgtaatcagatataggtagtttgcatgagtagcagactttttctgaaaatgctcagtaatctttttgtttaattcctgaattcgttttttctgtttttacttggtagttcagggatacttaaatcttgaaagataatgatttggcttttctttatgacttgttaaatagatggttggctttacca

SEQ ID NO: 15627 - DNA, 853 bp, Brassica napus
agagcttcctctgcttcacctttcaggctcagagattcgtcaattgagagaaactcaagatgagtaagcttcaaagcgaggttcttagagaagggatcacagctgttaagggcaaagccgatgagaaaaaacgcaactttgtcgagacagttgagcttcagattggtctcaagaactacgacccacaaaaggacaagcgtttcagtggttctgtcaagctccctcacattcctcgccctaaaatgaagatctgtatgctcggagatgctcagcatgttgaggaggctgagaagattggactagactatatggacgttgaggctttgaaaaagcttaacaagaacaagaagcttgttaagaagcttgccaagaagtaccatgctttccttgcttctgaatccgtcattaagcagatccctcgtcttcttggtcctggtcttaacaaggcaggaaagttcccgacgctagtgagtcaccaagagtcgttggaagggaaggtgaatgagacaaaagcgacagtgaagttccagttgaagaaggttctgtgtatgggtgttgctgttggtaacctttccatggaagagaagcagctctttcagaatgttcagatgagtgttaacttccttgtctctctgttgaagaagaattggcaaaacgtgaggtgtttgtacttgaagagcaccatgggaccacctcaaaggatcttttgagctctctggtttctgaatctataaatttttgctttgcgtttttgtttcaaatgtctagtgcttcttgagatatggttcggattgatattagtggaacgaaggtgctagtttgcttttcgttaaaagacaaatataatatatgc

SEQ ID NO: 15628 - DNA, 901 bp, Arnica chamissonis
gtcttaccagaggatcatttgatttatacttatgtttttgtagtacttgattattagcagaattgaagttaacgagaggaaaacttgccgaaaatgagcaagcttcaaagtgaagcccttagagaggcaattactcagatcactactgatgccaaggaaaagaaacgcaactttactgaaaccgttgagctccaaattggtttgaagaactacgacccacaaaaagacaagcgtttcagtggtaccgtcaaattgcctcacattcctcgtcccaagcttaaagtgtgcatgcttggagatgctcaacatgttgaagaggctcaaaaaattggtctcgagtatatggatgttgagggtctgaagaagctgaacaagaacaagaagttggtgaaaaaacttgctaagaaacatcaagctttcttggcttctgagtcagtcatcaagcagatcccgcgtttattgggccctggtctaaacaaagctggtaagttccccactcttgttagccaccaggaatctcttgaggccaaagttaacgagacaaaagcaacagtcaaattccaactgaagaaggtcctctgcatgggagttgctgttggtaactgcagcatggaagaaaagcaaatttttcagaatgttcaaatgagtgtcaattttttggtttctttgcttaagaagaattggcaaaacgtgcggtgcttgtacttgaagacaacaatgggaaagccagttcgcatcttttaaaaagttcatttgttatgttgtttaatgccgaggtcagtactggaaaacatattcccataatcctttttggctttttacatgcttgtttggttctctgctttagacattacatatttgttttggttttgttaacctctttggtagaaaagtttgaaaa

SEQ ID NO: 15629 - DNA, 870 bp, Cirsium arvense
aaggaaggaaaaatctatcaatcatgagtaagcttcagagtgaagccctccgtgaagccattacccagattactaccgatgctaaggaaaagaagaggaattttaccgagaccattgagctccagattggtctcaagaactacgacccacaaaaggataagcgtttcagtggtaccgtgaagttgcctcacatccctcgtcccaaattgaaagtttgcatgcttggagatgcccagcatgtggaagaggctcaaaagatcggccttgagtatatggatgttgaaggtctcaaaaagctcaacaagaacaaaaagctggtgaagaagcttgctaagaagcaccaggcttttttggcttctgaatctgtcatcaagcagatccctcgtttgttgggccctggtctaaacaaggctggaaaatttcctacccttgttacccaccaggaatcccttgaggctaaggtgaatgagacaaaggcaaccgttaagtttcagctgaaaaaggttctctgcatgggagttgctgtcggaaactgcagcatggaggagaagcagatcttccaaaacgtgcaaatgagcgtcaattttctcgtttcgttactgaagaagaattggcaaaatgtgaggtgtctgtacttgaagacaacaatgggaaagccggttcgcatcttttaaccggttcgcatcttttaggagttatcgttgtttctcagatttgttctgtttgaggtctagtacttggaagcatatgcctatatcggggtgcttatcgtttttgacttgttggatgttgggtttttatttttgttttagatactgctgttgccttgaacgattaaaaaaaaagaaaaaagaaaagtaaccgactgcg

SEQ ID NO: 15630 - DNA, 833 bp, Ambrosia trifida
tgccctggtgttaggaagaagagctaactgaaaatgagtaaacttcagagcgaagcccttagggaagccattactcagatcaccaccaatgctacagaaaagaaacgtaacttcaccgagaccattgagcttcagatcgggctcaagaactacgacccacaaaaggacaagcgttttagcggtactgttaagttgcctcacattcctcgtcccaagttgaaggtttgcatgcttggagatgcccagcatgtggaagaggctcaaaagattggtcttgaatacatggatgttgaaggacttaagaaacttaacaagaacaagaagctggtgaagaagctagccaagaaacaccaggcttttttggcttccgaatccgttatcaagcaaattcctcgtttgttgggccctggtctaaacaaggcaggaaagttcccaacactcgttagtcaccaggaatctctcgaggctaaggtgaatgaaaccaaagcaacggttaagtttcaactgaaaaaggtgctgtgcatgggagttgctgttggcaactgcagcatggaggagaaacagattttccaaaacgtgcagatgagcgttaatttcctcgtttcattgttgaagaagaactggcaaaatgttagatgtttgtacttgaagacaacgatgggaaagccgattcgcatcttttagatattttgtttgtttttttgttttcgaacttgtgaggtcagttcttggaagcatttccttttaataggcggtgttggttttgtctcttattcgtgtcttagttgatacgataaacgttatgtttaatggttaccgcgattttatctgtg

SEQ ID NO: 15631 - DNA, 959 bp, Ambrosia trifida
ggggtacacaatagaacttgagtactggatcaagaccaagacccaggcccaattagggtttcacctcacttattattattgagtcctataacacggccgctgttttcctctttaacttcatcggtgctgctgttagggtttatacctaagacgtaaggaaaacctaacaaaaatgagtaagcttcagagtgaggccctgcgtgaagccattactcaaattaccaccgctgccaaggaaaacaagcgtaatttcactgagacaattgagctccagattgggctcaagaactacgacccacaaaaggataagcgtttcagtggcaccgtgaaattgcctcacattcctcgtcctaagttgaaggtttgcatgcttggggatgctcagcatgtagaagaggcccaaaagatcggtcttgaatacatggatgttgaaagtctcaagaagcttaacaagaacaagaagctcgtgaagaagcttgccaagaaacaccaggcttttttggcttctgaatctgttatcaagcagattccccgtttgttgggtcctggtctaaacaaggctggtaaattcccgacacttgtttcccaccaggaatccctcgaggctaaggtgaatgaaaccaaggcaactgtcaagtttcaactgaaaaaggtgttgtgcatgggagttgctgtcgggaactgcagcatggaggaaaaacagatttttcaaaacgtgcagatgagcgttaattttcttgtttcgctgttgaagaaaaactggcagaatgtgcgatgtttgtacttgaagactacaatgggaaagcctattcgcatcttttaggtgtttatcgttgtttttgctggaggccagttgttgcaagcatttccctttaatgggtgctgttgtttttgacttgttggatgtttgttttctttttgtattagatgctgttatgaacattatgtttaatggttac

SEQ ID NO: 15632 - DNA, 970 bp, Epimedium sagittatum
gaagctcggcggtacgtttcgtttctccctcttcctccatctactcttctcctacataggtttctcgcttccggctttgtaggtagctgtagaagagctttggaaaacagggaggatgagtaagcttcagagtgatgtgttaagggaatgtatcacaaagatagttgaaaggtccaacactaagaagcgaaagttcacggagactattgagcttcagattggtctgaagaattatgatccccagaaggataagcgtttcagtggttctgtcaagctgccacatatccctcgtcccaagatgaaagtgtgcatgcttggagatgctcagcatgtagaagaggcagtgaagatcggtttggagtttatggacgtggaaggtctgaaaaagctcaacaagaacaaaaagctagtgaagaagcttgccaagaagtaccatgcttttcttgcatctgaagctgtgattaaacagattcctcgtcttcttggtcctggtcttaacaaggcaggtaagtttccaaccctcgtgactcatcaggaagctttggagtctaaagttaatgagaccaaggctatggtcaagttccaacttaagaaggttctttgcatgggagttgctgttggtaacttgggaatggatgagaagcagatcttccagaatgtgcaactcagtgtcaatttccttgtgtctttgttgaagaagaattggcagaatgtaaggtgcttgtatttgaagagttcgatgggcaggcccgaaagaatcttttgatcccacctgcattttgcattttgttactagaactttagcagtactagccttgaaacagtctgtttgtttctttagtttcttatctatcttgggcggaagactatttatatttggaacagctttattttttttaagtttttctatcgagttttggtgacatgagaaggaatatcccttgttctggttattattatttattttttt

SEQ ID NO: 15633 - DNA, 819 bp, Helianthus annuus
gaagtgaagtttcactaaggaaaacctaacaaaaatgagtaagcttcagagtgaagccctgcgtgaggccattactcaaattaccaccgatgccaaagaaaagaaacgtaatttcaccgagacaattgagctccagattggactcaagaactacgacccacaaaaggacaagcgtttcagtggcaccgtgaaattgcctcacattcctcgtcccaaattgaaagcttgcatgcttggagatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccaacgcttgtttcccaccaggaatccctcgaggctaaggtgaatgaaaccaaggcaactgtcaagtttcaactgaaaaaagtgttgtgcatgggagttgctgtcgggaactgcagcatggaggaaaaacagatttttcaaaacgttcagatgagcgttaactttcttgtttcgttgttgaagaaaaactggcagaatgtccgatgtttgtacttgaagacgacaatgggaaagccagttcgcatcttttaggtgtttaactttgtttttggttgagccagttgttggaagcatttccctttaatgggtgctattgtttttgacttgttggaatgttgttttcttattgtattagattttgctatgaacattatggttaatggtta

SEQ ID NO: 15634 - DNA, 909 bp, Rosa hybrid cultivar
gcctcactcagctgtagccgtctcctccttcctctggtttttttaggtttcaccccagttgttccagtaacgatttcgccatgagcaagctgcaaagtgaggcattgagggaggccatctcccagattaagactaattcggagacgaagaagaggaagttcaccgagacagtggagttgcaaattgggttgaagaactatgacccacaaaaggacaagcgtttcagtggttccgtgaagcttccccacattcctcgtcctaagatgagggtttgcatgcttggagatgctcagcatgttgaagaggcagagaagatgggattggcctacatggatgtggaatcgctgaaaaagcttaacaagaacaagaagctggtcaagaagcttgcaaagaagtatcatgcatttttggcttctgaagctgtcatcaagcaaattcctcgtcttttgggccctggtcttaacaaggcaggtaagtttccaactctggtgagtcaccaggaatctctggaggcaaagcttaatgaaacaaaggccatggttaagttccaactcaagaaggttctttgtatgggtgttgccgtcgggaatcttgccatggatgagaaacagatattccagaatgtgcaactcagtgtcaatttcttggtttctctgttgaagaagaattggcagaatgtgagatcattgaacctgaaaagcaccatggggaaagctatccgaatttactaaattcttgcgtttcagccgaggcattcatgtggaagaagagcattagcaaaactatgttgctttttgttgactttagtttaaattcctagcccaaactacaatgcgtaccgtgatttttgtttaaaagtgaatgctcatggataattttgaagggattttgtttttcttaaattatctg

SEQ ID NO: 15635 - DNA, 960 bp, Amsonia hubrichtii
ttttgcagtctcctgaactccaaagaggcagtggacttgttcatctgtggaaggaaaaactaatctttcaccatgagtaagctacagagtgatgctgttaaagaagcaatcgcccagattgttacggattctaagggggataatggggagaaaaagcgtaagttcacagaaactgttgagcttcagattgggctgaagaactacgacccccaaaaggacaagcgttttagtggctctgttaaactcccacatatcccgcgcccgaagatgaagatttgcatgcttggtgatgctcagcatgtggaagaggcagagaagattggtcttgagtatatggatgttgagggcttgaagaaactcaacaaaaacaagaaattggtgaagaagcttgccaagaagtatcatgcttttctggcatctgaagcggtgatcaagcagatcccgcgtcttttgggtcctggtcttaacaaggcaggcaaatttcctaccctggtcactcatcaggaatccttggagtctaaagtaaatgaaacaaaggccacagtcaagtttcagctcaagaaggtcctttgtatgggtgttgctgtgggcaatttggacatggaggagaaacaaattttccagaatgttcaaatgagcgtcaactttctcgtatcactattaaagaagaattggcaaaatgtgaggtgcttgtatctgaagagtaccatggggaggccacaacgcatcttctgagcagtttgttttcatttactggtgttctaaaatcagtttagtttgagtcaaagagtgggcagttggatacactttttggtcaatgtttcagttatttttgcttaccaatgttaatggattcttctgcaattttgaactgagcaatgaaattttagttccagataagacaatttatactttgtattatttttttgttgagctactgtgggtggatcatcaaattgt

SEQ ID NO: 15636 - DNA, 843 bp, Artemisia annua
aaactttacaatcatgagtaagctttcaagtgaagccctcagagaggcgattacaagcatcactactgatgctaaggaaaagaaagtccgtaacttcactgagacaattgagctccagattggtctcaagaactacgacccacaaaaggacaagcgtttttctggtaccgtgaggttgcctcacattccacgtcccaagttgaaggtttgcatgcttggagatgctcagcatgtggaagaggctcaaaagattggtcttgagtacatggatgtggaatcactcaagaagcttaacaagaacaagaagcttgtgaagaagcttgccaagaagcaccaggcttttttggcctctgagtcagttatcaagcagattcctcgtttgttgggacccggtctaaacaaggctggtaagtttcctactcttgtcagtcaccaggaatctcttgaggctaaggtgaatgaaaccaaggcaactgttaagtttcagttgaagaaggtgttgtgtatgggagttgctgttggtaactgcagcatggaggagaagcagattttccagaacgttcaaatgagtgtcaactttcttgtttcgttgttgaaaaagaattggcaaaacgtaaggtgtttgtacttgaagacaacaatgggaaagccagttcgtatcttttaggtgctttctttggtttttgatttggttgttgggagattagtacttgaaagcttttaccgataatggtggctgtcgtttttgaatttttggatttctgtttttctattgtattagatgatgctatagacaatatgtttaatggttgccgagctattatctttactatctgtcttcct

SEQ ID NO: 15637 - DNA, 824 bp, Gerbera hybrid cultivar
agtgttcctacaggagaagtgaagttgaaggaaggaaaattgtatcacgatgagtaagcttcagagtgaagccctgcgagaagctattactcagattaccaccgatgccaaggaaaagaaacgtaattttactgagaccattgagctccagattggactcaagaactatgacccacaaaaggacaaacgtttcagtggtactgtgaagttgccacacattcctcgtcccaagttgaaagtttgcatgcttggagatgctcagcatgtggaagaggctcaaaagaaggccttgaattatggacgttgaagggcttaagaagctgaacaagaataagaagctagtgaagaagcttgctaagaaacaccaagcttttttggcttctgagtctgtcatcaagcagattcctcgcttgttgggacccggtctaaacaaagcaggaaagttccctacacttgttacccaccaagaatccctcgaagctaaggttaacgaaacaaaggccactgtgaagtttcaactgaaaaaggtgctttgcatgggagttgctgtaggaaactgtagcatggaagataaacagattttccaaaacgttcaaatgagcgtcaatttccttgtttcgctactcaagaagaattggcaaaatgtgaggtgtttgtacttgaagacaacgatgggaaagccggttcggatcttttaggttatgtatttttgttttaactctgggctgttgaggtgagtactttgtcttatttaatgtttgttttatcttaattttagatgctaccatgaacattatattaatgtatttttgcttagtctattt

SEQ ID NO: 15638 - DNA, 846 bp, Lippia dulcis
cccaataagaattatcgttagggtttgcgcgtcaatatttatgcttctgaatctgcggctctcattctctcttcttcagtcaattccagccaccgtctcaccacccttgctctagggttttgttcagtgattcggggaactaattgaccgtgaacgatgagtaagcttcagagtgaggcattgagggaggccatcactgtgattgttgcagatgccaaggagaagaagcgcaacttcacagagactgttgagctccagattggtctcaagaactatgatccccaaaaggcaagcgtttcagggggtccgttagattgccccatatcccgaggccgaaaatgaaaatctgcatgcttggagatgcccagcatgttgaggaggcggagaagattggccttgagtcaatggatgtggaagcactgaagaagttgaataaaaacaagaaattggtgaagaagctagcaaagagatatcatgctttcttggcctcagaagcagtcattaagcagattccacgtctattgggacctggtctgaacaaggcaggtaagttccccactctcgtgactcaccaggagtctcttgaatccaaggtgaacgagaccaaggctaccattaagttccaattgaagaaggtgctctgcatgggtgttgctgttggcaacctcgacatggaggagaagcagatcttccaaaatgtccaaatgagtgtcaacttccttgtttcccttttgaaaaagaattggcaaaacgtgaggtgtttgttcttgaagagcaccatgggaaagccgcaacgtatcttctgagaaatttacaaacttctgttattcgactcgtagaaactac

SEQ ID NO: 15639 - DNA, 872 bp, Ambrosia trifida
cggcaagaggtacgacgggggggtggataggaagaagaagaccacaaaaaatagagtaaacttcagagcgaagcccttagggaagccattactcagatcaccaccaatgctgtagaaaagaagcgtaacttcaccgagaccattgagcttcagatcgggctcaagaactacgacccacaaaaggacaagcgtttcagcggtaccgttaagctgcctcacattcctcgtcccaaattgaaggtttgcatgcttggagatgcccagcatgtggaagaggctcaaaagattggtcttgaatacatggatgttgaaggactcaagaagcttaacaagaacaagaagctggtgaagaagctagccaagaaacaccaagcttttttggcttccgaatccgttatcaagcaaattcctcgtttgttgggccctggtctaaacaaagcaggaaagttcccaacactcgttagtcaccaggaatctctcgaggctaaggtgaatgaaaccaaagcaacggtaaagtttcaactgaaaaaggtgctgtgcatgggagttgctgttggcaactgcagcatggaggagaaacagattttccaaaacgtgcagatgagcgttaatttcctcgtttcattgttgaagaagaactggcaaaatgtgagatgtttgtacttgaagacaacgatgggaaagccgattcgcatcttttagatattttgtttgttttttgttttcgaactttgtgtaggtcagttcttggaagctatttccttttaataggttggtgttggttttgtctcttattcgcgttctttgttgattacgattaaacatttatgttttaatggtttaccgcgtatttttatcttgtagaaaaaaga

SEQ ID NO: 15640 - DNA, 836 bp, Flaveria ramosissima
agaattgaagctaacgaggggagaagtgtctgaaaatgagcaagcttcaaagtgatgcccttagagaggcaattactcagatcaccactgatgctaaagaaaagaagcgtaacttcactgaaaccattgagctccagattggtttaaagaattacgatccacaaaaggacaaacgtttcagtggtactgtgaaattgcctcacatccctcgccccaaacttaaagtttgcatgcttggagatgctcaacatgttgaagaggcacaaaaaaaattggtcttgaatatatggatgttaaggggttgaagaagctgaacaagaacaaaaagttggtgagaaacttgctaagaaacatcaagctttcttggcttctgagtctgttatcaagcagattcctcgtttgttgggccccggtttaaacaaagcaggcaagttcccaactctcgttacccaccaagaatctcttgaggcaaaagtaaacgagactaaagcaacagtcaaattccaactgaagaaggtgctctgcatgggagttgctgttggaaactgcagcatggaagaaaagcagatcttccaaaacgttcaaatgagtgtcaatttcttagtttctttgcttaagaagaattggcaaaacgtgcggtgtttgtacttgaagacaacaatgggaaagccggtccgcatcttttaagttcatttgttatgtttttatttttggtttaatgttgaggctagtacccaaaacatatttcccatgagctgggagtagtaatcctttttggctttttacatgtttgtttggcgctatatttttggaccctcagttttagactaataact

SEQ ID NO: 15641 - DNA, 853 bp, Fraxinus spp
agtgaggcccttcgggaagctatctcagtaatcaccactgatgtcaaggagaagaagcgtaacttgtttgagacaattgagctccagattgggactgaaaaactatgatccacagaaggataaacgttttagtggctccgtgaagttacctcacattcctcgtcccaagatgaagatttgcatgcttggtgatgctcagcatgttgaggaggccgaaaaaattggtcttgaatccatggatgtagaggctttaaagaagttgaacaaaaacaagaaactggttaagaagcttgctaaaagatatcatgctttcttagcctccgaagctgttatcaagcagattccccgtctcttaggacctggtcttaacaaggcaggtaagttcccaactctcgttagtcaccaggaatctcttgaatctaaggtcaatgaaaccaaagccacagtgaaattccaactgaagaaggtgctttgcatgggagttgctgttggaaactgtgctatggaggagaagcagatctttcagaatgtgcaaatgagtgtcaactttctagtttctctgttgaagaaaaactggcagaatgtgaggtgcttgtatttaaaaagtacaatggggaagcctcagcgcatcttttaaggagataacattctgtttctgttgatccggctttagggaatagtagtgtggagctaaagcaatggaatatttccctgtaatagcaagtttttggttgtctatggtctctatactttgttcagacgtcatagtgattgttttgtttttctactgagatgggattgatttttgcttactgtaccctcaatatttttatcaggaatagccagtttactg

SEQ ID NO: 15642 - DNA, 1163 bp, Picea glauca
aaacgatagtagaagaggatctatttcatcactttgagaataccaaatttcttgggatataaagatgcatataaatatttgtgaccctcccactaaccatagagatattgaccaaaatataggatctcactgggggtcacaaaaaaggccatagaaggtgtatacgaggaaaccgaaccctaatcaatgatattcacatgtgaacataagtgggatttgtgcaaaaccctagcttggcctcaggattttatttgtgactattcgagggtcgtttggagaagagcagcagtaggacgacgaagaagaggcagaggcagaggcagaggaagcaaggcgcccccccctgtaaacaatgagtaagcttcagagtgacgtgttgagggagggaataactcaggttatgggagaaagcaaggacaagaagcgaaaattcacagagacaatagagttacagatcgggctgaagaactatgacccccaaaaggacaaacgtttcagtggatccgtaaaattgccccacattccccgccccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcagaagcaattattaaacaaattccaagacttcttggacctggtcttaacaaggctggtaaatttcccactcttgtttcacaccaagagtccttggagtccaaggtgaatgaaacaaaagcaacggttaagtttcagttgaaaaaagttctatgtatgggggttgctgtgggaaactgtggaatggaagaaaagcaagtttttcagaatgtgcaattgagtgttaacttccttgtatcactactgaagaagaactggcagaatgtaaaggtgcttatatttgaagactaccatggaaagcctaaccgcatttctgagtgcggaacagagtggagatatttcaatggcacttccttttgtataactattaaacataggttatgttatttagtttcgaccaaacaaatcaatttaatgcaactacttacgaattgaggaagagatgtgctggtaaattgctgttttgaacaataagagt

SEQ ID NO: 15643 - DNA, 858 bp, Raphanus sativus
tttcctctgtttcaccctctcagatacagagattcgtcaattgagagaaactcaagatgagtaagcttcaaagtgaggtacttagagaaggaatcgcagctgttaagggcaaagctgatgagaaaaaacgcaactttgtcgagacagttgagcttcagattggtctcaagaactatgacccacaaaaggacaagcgtttcagtggttctgtcaagctccctcacattcctcgccctaaaatgaagatctgtatgctcggagatgctcagcatgtcgaggaggctgagaagattggactagactatatggatgttgaggctttgaaaaagctcaacaagaacaagaagcttgttaagaagcttgccaagaagtaccatgctttcctggcttctgagtccgtcattaagcagattcctcgtcttcttggtcctggtcttaacaaggcaggaaagttccctacactagtgagtcaccaggagtcgttggaaggaaaggtgaatgagaccaaagcgacagtgaagttccagttgaagaaggttctgtgtatgggtgttgctgttggtaacctttccatggaagagaagcagctctttcagaatgttcagatgagcgttaacttccttgtctcgctcttgaagaagaattggcaaaacgtgaggtgtttgtacttgaagagcaccatgggaccaccacaaaggatcttttgagctctctgctcttttcttctttgaatttttgctttttgtttttgtttcaaagatcttgtgcttcttgagatatggttcggattgatattagcggaactcaggtgctagtttacttttcgttgaacaatataatacggcaatgtttgctttt

SEQ ID NO: 15644 - DNA, 799 bp, Marchantia polymorpha
agaactctcacctgccaaccgaacaggagcatcgagctcgaacgcgatgagtaagctgcagagcgatgtcctcagggaggccatcacccaggtggtgaccgaggctaaggagaagaaccgcaagttcacagaaactgtggaattgcagatcggtctcaagaactacgacccgcaaaaagacaagcgtttcagcggatctgttaagttaccccatgttcccagaccgaagatgaaggtgtgcatgctcggagacgcccagcacgtcgaggaagccgagaagatgggtctcgactacatggacatcgaatctttgaagaagatgaacaagaacaagaagctcgtgaagaagctggctaagaagtaccacgcctttcttgcttcagaggctgtcattaagcagatcccccgtcttttgggtccaggtttgaacaaggctggaaagtttcctgcccttgtttcccatcaagagtctctagaagctaaggtgaacgagaccaaggccatggttaagttccaattgaagaaggtgctctgtatgggagttgctgtcggcaattgcgaaatggaggagaagcagatcttccagaacactcaattgagtgttaacttccttgtctctttgctgaagaagaactggcaaaacgtaagagtcttgtacctcaagacatccatgggaaagccagtccgaatctactagtgctgctgaataattttttggttctcaagccaattatcagggtgaccgcccttgggtttttaccctaaatgctcaaattaatgaaattttaccatttcatag

SEQ ID NO: 15645 - DNA, 832 bp, Marchantia polymorpha
ccttctcagacagtcttgaagacactgtaatccgccggaccgaacaggagcatccagctcgaacgcgatgagtaagctgcagagcgatgtcctcagggaggccatcacccaggtggtgaccgaggctaaggagaagaaccgcaagttcacagaaactgtggaattgcagatcggtctcaagaactacgacccgcaaaaagacaagcgcttcagcgggtctgttaagttgccccatgttcccagaccgaagatgaaggtgtgcatgctcggagacgcccagcacgtcgaggaagcagagaagatgggtctcgactacatggacatcgaatctttgaagaagatgaacaagaacaagaagctcgtgaagaagctggcgaagaagtaccacgcctttctcgcttcagaggctgtcattaagcaaatcccccgtctcttgggtcctggtttgaataaggctggaaagtttcctgcccttgtgtcccaccaggagtctctggaagctaaggtgaatgagaccaaggccatggttaagttccaattgaagaaggtgctctgtatgggagttgctgtcggtaattgcgaaatggaggagaagcagatcttccagaacactcaattgagtgttaacttccttgtctctttgctgaagaagaactggcaaaacgtaagagtcctgtacctcaagacatccatgggaaagccagtccgaatctactagtgctgcatcgtaataatgtgcctaaattatgtaacagggtgatcgcccttgggtttttaccctaaatgttcacatttatgaaacctcgaaggccatttaacggtaaaaaaaaaa

SEQ ID NO: 15646 - DNA, 887 bp, Carthamus tinctorius
ggcgggggtctgtaaccctacttgcagggttcttcttcttccacagaagtgcaggttagcgaaaggagtagtttccgaacatgagtaagctacaaagtgaggccctccgagaggcgattacgcagattactactgatgccaaggaaaagaaacgtaacttcacagagaccattgagctccagatcggtttgaagaattacgacccccaaaaggacaagcgtttcagtggtactgtgaagttgcctcacattccccgtcccaaattgaaagtttgtatgcttggagatgcgcagcatgttgaagaggctcaaaagattggccttgaatatatggatgttgaggctctgaagaagttgaacaaaaacaagaaattggtgaagaaacttgcgaagaaacatcaagctttcttggcgtctgagtctgtcatcaagcagattcctcgtttgctgggacctggtctgaacaaggcaggtaagttcccaactcttgttacccaccaagaatccctcgaggctaaggtgaatgagaccaaggcaactgtgaagttccaactgaagaaggtgctctgcatgggagttgccgttgggaactgcagcatggaggacaaacagatattccagaacgtgcaaatgagcgtaaactttcttgtttctttgctgaagaagaattggcaaaacgtgaggtgcttatacttgaagacaacaatgggaaagccggttcgcatcttttgaagagtgtgcttatgttttggtttttggttgatcttgaggttgctactttaagaggttgtttctcatcaagaggaaatactccattttgttttcgttgctactatatttttagacggctcagttttcagacatctattataattgttctttttatgt

SEQ ID NO: 15647 - DNA, 932 bp, Tragopogon dubius
tatcagctgcttttggtgcgtaactacatcggcacttccaaaccctactacgagggttcttccgggagaattgaagcttaacgaaaggaaaagtctccgaatatgagtaaacttcaaagtgaagccctcagggaggcaattacccaaatcactacagatgcaaaggaaaagaagcgtaacttcacagaaaccattgaactccagatcggtttgaagaactacgacccacaaaaggacaaacgtttcagtggcaccgtgaaattgcctcacattcctcgacccaagctaaaagtatgcatgcttggtgatgcccagcacgttgaagaggctcaaaagattggtcttgagtacatggatgttgaagctttaaaaaagctgaacaaaaacaagaagatggttaagaaacttgccaagaaacatcaagctttcttagcttctgagtctgtcatcaagcagataccacgtttgttgggacctggtctaaacaaggccggtaagtttcccaccctagttacccaccaggaatctcttgagggaaaggtaaatgagacaaaggccacagtgaagtttcaattgaagaaggttctttgcatgggagttgctgtggggaactgcagtatggaagagaagcaaatctttcagaatgtgcaaatgagtgtcaactttcttgtgtctttgctcaagaagaattggcagaatgtgaggtgcctatacttgaagactacaatggggaagccagttcgtatcttttaaggagtttatttgttattctgttttgattttgggttaatgttaagtgagaaaagaagtgttttccttgaacaggaaatagctgtttttgacttgttacatgtttctttggtactttattattactttagacatgatatggatatttttcttgttctatttattagtgttttagaaataac

SEQ ID NO: 15648 - DNA, 864 bp, Gerbera hybrid cultivar
gcctgcaattagggttcttacaagagaagtgaaggttaaggaaaggacgatttttcagccatgagcaagcttcaaagcgaggccctccgtgaggctatcactcagatcacaactgatgccaaggaaaagaaacgtaatttcactgagaccattgagctccagattggcctgaagaactatgacccacaaaaagataagcgtttcagtgggaccgtgaagttacctcacattccccgtcctaagttgaaggtttgcatgcttggagatgcccagcatgttgaagaggctcaaaagatagggctcgagtatatggatgttgaaggtctgaagaaactcaacaaaaacaagaaattggtgaagaagcttgccaagaaacaccaagcttttttggcttctgaatccgtcatcaagcagattcctcgtttgttgggccctggtctcaacaaggccggaaagttccctacacttgttacccaccaggaatcacttgaggctaaggttaatgaaaccaaggcaactgtgaagttccagctgaaaaaggtgctctgcatgggagttgccgttggaaactgcagcatggaagataagcagatctttcagaatgtgcaaatgagcgttaatttcctggtttcgttgctcaagaagaattggcaaaatgtgaggtgcttatacttgaagacaacaatgggaaagccggttcgcatcttttaaggtgttcttattttatcaactgttttgagtttgtggtgttttgagttcggtacttgaagaatattgtccctcctttttcgatcgttagaagtgtcttttttgttttggtactacatcgaacgtcacaaaatattatagcattggtatttgctt

SEQ ID NO: 15649 - DNA, 734 bp, Parthenium argentatum
cctaccttcatcggcgctactgttagggttcctacacagaagagagatttaaggaaggaagacctaactaaaaatgagtaagcttcagagtgaagcccttcgggaagccattactcaaatcaccaccgatgctaaagaaaagaaacgtaattttaccgagaccattgagctacagatcgggctcaagaactacgacccacaaaaggataaacgttttagtggtaccgtaaagttgcctcacattcctcgccccaaattgaaagtttgtatgcttggagatgcccagcatgtggaagaggctcaaaagattggtcttgaatacatggatgttgaaggactcaagaagctcaacaagaacaagaaactagtgaaaaagctagccaagaaacaccaggcttttttggcttctgaatccgttatcaagcaaattcctcgtttgttgggtcctggtctaaataaggcaggaaagttcccaacacttgttactcaccaggattccctcgaggccaaggtgaatgaaaccaaagcaacggttaagtttcaactgaaaaaggtgctgtgcatgggagttgctgttggtaactgcagcatggaggagaaacagattttccaaaacgtgcagatgagcgttaatttccttgtatcgctgttgaagaagaactggcagaatgtgagatgtttgtacttgaagacaactatgggaaagccagttcgcatcttttaggtattgtgtt

SEQ ID NO: 15650 - DNA, 912 bp, Rosa hybrid cultivar
ctcttctcttctctacggtgagaaatcgttggtggattggtcatcttaagtttcgaccatgagtaagcttcagagtgatactctcagggaggctatctctatcatcatggccgcttccaaggaaaagagtcgtaagttcacagaaactatagaacttcagattgggctgaaaaattatgatccccaaaaggacaagcgtttcagtggttccgttaagttgccacacattcctcgtccaaagatgaaggtctgcatgcttggagatgctcagcatgttgaagaggctcagaagatcggtttggagtacatggatgtagaagcgctgaagaagttaaacaagaacaagaaattggttaagaaactggctaagaagtaccatgcctttttagcatcagaagctgttatcaagcagattccccgtcttttgggtcctggtctcaacaaggcaggaaagttcccaacccttgtttctcaccaagaatccctagagtctaaaatttctgagacaaaagcaacaattaagttccaattgaagaaggttctttgcatgggagttgctgtagggaatgtctcaatggaggagaagcaaatcttccaaaatgtgcaattgagtgtgaacttccttgtttcactattgaaaaaaaattggcaaaatgtaaagtgcttgaacctgaagaccactatggggaagccatatcgcatttattagagtcttcacttatttttggagatttgtagctggaggttgtaaggagcctgctccttataggaagtgtgtgtattcaaatggtccagtttttttcttatttgcctattttacttttttgcttaatgcttgttgacgttggtatgctagactttgtattattattgttgaagagtaaactggatttcattttgaaaaaaaaaaaa

SEQ ID NO: 15651 - DNA, 909 bp, Ocimum basilicum
aaaccctaattagggtttcctcatacagaagtgaagttttgaaggagaaaggagaagtatctgagccatgagtaagcttcagagcgaggcccttagagaagccatctctgtaattaagaatgattcggctgagaaaaagaggaagttctctgagactattgagctccagattgggcttaagaactatgatccccaaaaggacaaacgtttcagtggatctgtgaggttgcctcacattccacgtcctaagatgaagatttgcatgcttggagatgctcagcacgtgggggaggcagagaagatcggtttggagtacatggatgtcgagagcctcaagaagcttaataagaacaagaagttagttaagaagcttgcaaagaaataccatgctttcttggcttcagaatccgtcatcaagcagattcctcgtctcttgggtcctggtctgaacaaggcaggtaagtttccaacccttgtttcccaccaagagtccctcgagtctaaggttaatgaaaccaaagctaccatcaagttccagatgaagaaggtgctttgcatgggtgttgctgttggtaattgtgatatggaagagaaacaaatcttccagaatgtgcaaatgagcgtgaacttcttaatttctcttccaaagaagaattggcagaacgtaaggtgcttgttcttgaagagccccatggggaagactcaacgtgtcttttaagacgacaagtctcgttattggagcttttcgtgcattctttttgtaagagatagatattaatgaaaattttggatagtattcatccttgattatgtttttgaatgttacatcactacaaggatcgatcatattgctgagacatttcaagagctctgttctttttaatgttagatgatgatttcatttgaatg

SEQ ID NO: 15652 - DNA, 1007 bp, Papaver somniferum
ttttttttttttcctctcctacacagggtagatatcaggaaaaggttaaaccatgagtaagcttcagagtgaagtgttgagggaggcaatcagccagataggtacagaagctaaggataagaagcgtaagttcactgaaacagtggagcttcagattggtcttaagaactatgatccacaaaaggacaagcgtttcagtggttcagtgaagttgccacatattcctcgacctaagatgaaagtctgtatgcttggagatgctcagcatgttgaggaggctcaaaaaattggacttgaatatatggatgttgaagggctaaagaagctcaacaagaacaagaaattggtcaagaagcttgcaaagaaatttcatgcttttctagcctcggaagctgttatcaagcagattccccgtctccttggtcctggtcttaacaaggcaggaaagtttccaactcttgtgacgcatcaggaatcattggaggccaaggttaacgaaaccaaggcaatggttaagtttcaattaaagaaggtgctttgtatgggtgttgctgttggtaaccttggaatggaggacaagcagatcttccagaacgtccagcttagtgtcaattttctagtttcattgctcaagaagaattggcaaaatgtgaggtgcttatacttgaagagtaccatgggcaagccagttcgcatcttctaagcattgtttttaccaagtatgaatgcagatcctgctatattgtgtggtttttatagatttagctgtaggagataccttgagagttgtaaccagcaagaggtccaaattttgcgaaatatctaaagaaagaaccccagaatattatgtttttattgctcatctatattactagattcttaaattttgtgttatttgaggaatgtggatttttcatggatttaaaatcaaaacatgattgggtatctttcctatcatcccatttagaaggaaaaataagcaggattggaaatcaaagtatcggtta

SEQ ID NO: 15653 - DNA, 952 bp, Papaver somniferum
tgtaccaggaaaataaccatgagtaagcttcagagtgaagtgttgagggaagcaatctcccagatcaataccgaagctaccactaaaaagcgaaatttcactgagacggtggaacttcagattggtcttaagaactatgatcctcaaaaggacaagcgtttcagtggttcagtgaagttgccacatattccccgccctaagatgaaagtctgcatgcttggagatgctcagcatgttgaggaggctcagaagatcggtctcgagtacatggatgttgaaggtcttaagaagcttaacaagaacaagaagttggtcaagaagcttgcaaagaagttccatgcttttctagcctcagaagctgttatcaagcaaattccccgtcttcttggacctggtcttaacaaggcaggtaagttcccaactcttgtgactcatcaagagtcattggaggccaaggtgaatgaaaccaaggctatggttaagtttcaattgaagaaagtgctctgtatgggtgttgctgttggtaaccttggcatggaggagaagcagatcttccagaacgttcagcttagtgtcaactttctagtatcattgttgaagaagaattggcaaaatgtgaggtgcttgtacttgaagagtaccatgggaaagccagtccgcatcttctaagcattacatttctataattgtaagggcaattcctacacgctcttcatgttttgtgagatccctggagggttagatgtagggaatgccccaagtcccgagactctgtaatcagatataggtagtttgcatgagtagcagactttttctgaaatgctcagtaattctttttgtttaattcctgtaattcgttttttctgtttttacttggtagttcagggatacttaaatcttgaaaagataatgatttggcttttctttatgacttgttaaatagatggtttgg

SEQ ID NO: 15654 - DNA, 957 bp, Papaver somniferum
agggttgaagtttgtaccaggaaattaaccatgagtaagcttcagagtgaagtgttgagggaagcaatttcccagatcaataccgaagctaccactaaaaagcgaaatttcactgagacagtggaacttcagattggtcttaagaactatgatcctcaaaaggacaagcgtttcagtggttcagtgaagttgccacatattccccgccctaagatgaaagtctgcatgcttggagatgctcagcatgttgaggaggctcagaagatcggtcttgagtacatggatgtcgaaggtcttaagaagcttaacaagaacaagaagttggtcaagaagcttgcaaagaagttccatgcttttctagcctcagaagctgttatcaagcaaattccccgtcttcttggacctggtcttaacaaggcaggtaagttcccaactcttgtgactcatcaagagtcattggaggccaaggtgaatgaaaccaaggctatggttaagtttcaattgaagaaagtgctctgtatgggtgttgctgttggtaaccttggcatggaggagaagcagatcttccagaacgttcagcttagtgtcaactttctagtatcattgttgaagaagaattggcaaaatgtgaggtgcttgtacttgaagagtaccatgggaaagccagtccgcatcttctaagcattacatttctatacttgtaatggcaattcctacatgctcttcatgtttcgtgagatccctggagggttagatgtagggaatgccctgagagtccagagtctgtaaccagatataggtagtaactgtttgcatgagtagtagacttcttctgaaaatgctcagtaatctttttgtttaattcctgaattcgctttttctgtttttacttgtagttcagggatacttaaatcttgaaagataattatttggcctttctttatgacttgttaaata

SEQ ID NO: 15655 - DNA, 896 bp, Papaver somniferum
aaaaccatgagtaagcttcagagtgaagtgttgagggaggcaatcagccagattggtacagaagctaaggacaaaaagcgtaagttcactgagacagtggagcttcagattggtcttaagaactatgacccacaaaaggataagcgtttcagtggttcagtgaagttgccacatattcctcgacctaagatgaaagtctgtatgcttggagatgctcagcatgttgaggaggctcaaaaaattggacttgagtatatggatgttgaagggctaaagaagctcaacaagaacaagaaattggtcaagaagcttgcaaagaaatttcatgcttttctagcctcagaagctgttatcaagcagattccccgtctccttggtcctggtcttaacaaggcaggaaagtttccaactcttgtgacacatcaggaatcattggaggccaaggttaacgaaaccaaggcaatggttaagtttcaattaaagaaggtgctttgtatgggtgttgctgttggtaacctcggaatggaggacaagcagattttccaaaacgtccagcttagtgtcaatttcctagtatcattgctcaagaagaattggcaaaatgtgaggtgcttatacttgaagagtaccatgggcaagccagttcgcatcttttaagcattgtttttaccaagtatgaatgcagatcgtgctatattgtcactcgggtggtttctatagatttagctgtaggagataccttgagagttgtaaccagcaagaggtccaatttttgcgaaatatctaaagaaagaaacccagaatatcttatgtttcttggtaatgctcgtaggaaatgtaatttacacttttattgcgcatctattctgaccagattctaaaatttgtgctatttg

SEQ ID NO: 15656 - DNA, 969 bp, Papaver somniferum
tttttcctctcctacacagggtagatatcaggaaaaggttaaaccatgagtaagcttcagagtgaagtgttgagggaggcaatcagccagattggtacagaagctaaggataaaaagcgtaacttcactgagacaatggagcttcagattggtcttaagaactatgacccacaaaaggacaagcgtttcagtggttcagtgaagttgccacatattcctcgacctaagatgaaagtctgtatgcttggagatgctcagcatgttgaggaggctcaaaaaattggacttgattatatggatgttgaagggctaaagaagctcaacaagaacaagaaattggtcaagaagcttgcaaagaaatttcatgcttttctagcctcagaagctgttatcaagcagattccccgtctccttggtcctggtcttaacaaggcaggaaagtttccaactcttgtgacacatcaggaatcattggaggccaaggtaaatgaaaccaaggcaatggttaagtttcaattaaaaaaggtgctttgtatgggtgttgctgttggtaaccttggaatggaggacaagcagatcttccagaacgtccagcttagtgtcaatttcctagtatcattgctcaagaagaattggcaaaatgtgaggtgcttatacttgaagagtaccatgggcaagccagttcgcatcttctaagcattgtttttaccaagtatgaatgcagatcctgctatattgtcactcgggtggtttctatagatttagctgtaggagatacctcgagggttgtaaccagcaagaggtccaattttgcgaaatatctaaagaaagaaccccagaatatgtcatgtttcttgataattctcgtaggaaatgtaatttacacttttattgcgcatctattctgaccagattctaaaattttatgctattcatggatttaaaatcaaaacatggttggactggaaa

SEQ ID NO: 15657 - DNA, 1113 bp, Papaver somniferum
gttctcaattcactctctctttcggccgatttttcttcttctccggaaaccctaaaaaggtttctcttgtttcggaggatttgaacatacaaaaaactctcaaccatgagtaagttagcggctgatgttgtgaaggaagcaattgctcagattgttgctgagtctaaagagaagaatcgtaattttactgagactattgagcttcaaattggtttgaagaattatgatccacaaaaggacaagcgtttcagtggttctgtgaggctaccacatatccctcgtcctaagatgaaggtttgcatgcttggggatgctcagcatgttgaagaggctcagagtataggtttagaccatatggatgtggagggtttgaagaggcttaacaagaacaagaaattggtcaagaagcttgctaagaaataccatgctttccttgcatctgaagccgtaattaagcaaattcctcgtcttcttggacctggtctcaacaaggcaggaaaattcccaactcttgttacccatcaagagtctctggagtcgaaggttaatgaaaccaaggccatggtcaagtttcaattaaaaaaggtactctgcatgggtgttgcagtagggaaccttggaatggaggagagacaaatcttccagaatgtgcaactgagtgttaacttcctcgtatcactattgaaaaagaattggcaaaacgtaaggtgcttgtacttgaagagcacaatgggaaaggtgaaccgtgtcttttaagtggaagaaacaagaactctgccacatttatcagcaatattatcaagttctctcttttgagataacttttctagcagttgaatttagttttggttaaatactagcagaaaatttgaattattaattttaaagatcaggatatgttttggtacagtaatttttctagtaagaattttttggacctttggtcttgggtattacttaagtgttccagtttttgtaagtcggtactgtatttctctagctctataggatgaacagatgaagtgtacaagtacaactatacatttcttagaccacattgactgcttagaagctcattcttggttagaatggagaatcgagaatttctctaac

SEQ ID NO: 15658 - DNA, 780 bp, Papaver somniferum
aaaggtttctcttaattcggaggatttgaacatacaaaaaaactctaaccatgagtaagttagcggctgatgttgtgaaggaagcaattgctcagattgttgctgagtctaaagagaagaatcgtaattttactgagactattgagcttcaaattggtttgaagaattatgatccacaaaaggacaagcgtttcagtggttctgtgaggctgccacatatccctcgtcctaagatgaaggtttgcatgcttggggatgctcagcatgtggaagaggctcagagtataggcttagaccatatggatgtggagggtttgaagaggcttaacaagaacaagaaattggtcaagaagcttgctaagaaataccatgctttccttgcatctgaagccgtaattaagcaaattcctcgtcttcttggacctggtctcaataaggcaggaaaattcccaactcttgttacccatcaggagtctctggagtcaaaggttaatgaaactaaggccatggtgaagtttcaattaaagaaggtactctgtatgggtgttgcagtagggaacctcggaatggaggagagacaaatcttccagaatgttcaactgagtgttaacttcctcgtatcattattgaaaaagaattggcaaaacgtaaggtgcttgtacctgaagagcacaatgggaaaggtgaaccgtgtcttttaaggaagtcaggaagaaacaagaactctgcacattatcagcaatagtatcaagttttcacttttgagataacctttctagc

SEQ ID NO: 15659 - DNA, 968 bp, Cirsium arvense
ggatagtcgttcgattacttttctagtagcggcttcaatcgaactgctccaggcgatctttaaaattctaggtttatattgcaccataaatcaccaattcactttgtaatctaacatttacataggtggaggagctgtgcaaaggggaaatctttcaccatgagtaagttaggaagtgaagcggtcagagaagccatcacccagattacgactgaggccaaggagaaaaaccgtaagtttacagagactattgagcttcagattgggttgaagaactacgatccccaaaaagacaaacgtttcagtggcacggttaagttgccacacattcctcgtcctaagttgaaggtctgcatgcttggtgatgctcaacatgttgaagaggcacagaagataggattggaatacatggatgttgaagggttgaagaagcttaacaaaaacaaaaagttggtcaagaagcttgctaagaagcaccaagcttttctggcatctgaatcagtcattaagcagattccccgtctcttgggacctggtctcaacaaagcaggaaaatttccgacacttgttacacatcaggagtcgttggagtcgaaagttaatgaaataaaggcaacagtgaagtttcagcttaagaaggttctctgtatgggggttgctgtaggaaattgcagcatggaagagaagcagatcttccagaatgttcaaatgagcgtaaactttctcgtttctttattgaagaaaaactggcaaaacgttaggtgcttgtacctgaagactaccatggggaagccggtgcgtgtcttttagtaagctgagatttgatgatttttttccaacacatacatttgataacatctgctacaaatggttcgatattttggctttaaatcgagtcattattatcattcttatcttaaatctgtatttttggtatccttagatttgcaatatgatagaagagaatc

SEQ ID NO: 15660 - DNA, 928 bp, Epimedium sagittatum
gggggtgaagctcggcggttgtagaagagctttggaaaacaaggaggatgagtaagcttcagagtgacgtgttaagagaatgtatcacaaaggtagttgaaaggtccagcactaagaagcgaaagttcacggagactattgagcttcagattggtctgaagaattatgatccccagaaggataagcgtttcagtggttccgtcaagttgccacatatccctcgtcccaagatgaaagtgtgcatgcttggagatgctcagcatgttgaagaggcagtgaagataggtttggagtatatggacgtggaaggtctgaaaaagctcaacaagaacaagaaactagtgaagaagcttgccaaaaagtaccatgcttttcttgcatctgaagctgtgattaaacagattcctcgtcttcttggtcccggtcttaacaaggcaggtaagttcccaacccttgtgactcatcaggaagccttggagtccaaagttaatgagaccaaggctatggtaaagttccaacttaagaaggttctttgcatgggagttgctgtgggtaacttgggaatggatgagaagcagatcttccagaatgtgcaactcagtgtcaatttccttgtgtctctgttgaagaagaactggcagaatgtaaggtgcttatatttgaagagttcgatggggaggccggaaagaatcttttgagccatctatattttgttactaaaactttcgcagtactagccttgaaacagtctgtttatttctttagtttcttatctatcttgggcggaatgctattttaaatttggaacaacctgagttttttagttgagttttagagacgtgagaaggaatctctcttattctggttaattttttttggagttgacgatgcaatctttcagatcgtttgcaagttctttagatgttca

SEQ ID NO: 15661 - DNA, 1079 bp, Cirsium arvense
acgcggggaaacgcagggttcttcttcttcttcacacagaagtgcaagttagcgaaaggaatagtttgtgaacatgagtaagctgcaaagtgaagcccttagggaggctattactcagattactaccgatgccaaggaaaagaaacgtaacttcactgagaccattgagctccagatcggtttgaagaactacgacccccaaaaagacaaacgtttcagtggtaccgtgaaattgccacacattccccgtcccaaattgaaagtttgtatgcttggagatgcccagcatgttgaagaggctcaaaagattggccttgaatatatggatgttgagggtttgaaaaagttgaacaagaacaagaagttggtgaagaaacttgctaagaaacaccaagctttcttggcttctgagtctgtcatcaagcagattcctcgtttgttgggacctggtctaaacaaggcaggtaagttccctactcttgttacccaccaagaatcccttgaggctaaggtaaatgagaccaaagcaactgtaaagttccaactgaagaaggtgctctgcatgggagttgctgttggaaactgcagcatggaggacaaacagatattccagaacgtgcaaatgagcgtcaacttccttgtttcgttgctgaagaagaattggcaaaacgtgaggtgcttatacttgaagacaacaatgggaaagccggttcgcatcttttgaagagtttatttatgttttcattttgtaatgttgaggttgctactttaagaggttgttttctatcaaaaggaaatactccattttgttttggttgctactatatttttagatggctcacttcagacatttctataaattgttctttttatgtattagttctttagatttgtctcttcaattttactgtgaacaagaacttcatgatatgagatttctgagttttctgcaaaaaagaaaaagtaccgactgcgactctagatgcataaatagatacatgttacaaggttcttgatctataggcaccttgaatgcaaaacatgttaaaagaaactcccacacctactcgttttcttat

SEQ ID NO: 15662 - DNA, 904 bp, Cirsium arvense
cggcactgccacttcctcctactcctagggttctcttcgaagaagtgaagtttaaggaaggaaaacttatcaaccatgagtaagcttcagagtgaagctctccgagaagccattacccagattactactgatgccaaggaaaagaagagaaattttactgagactattgagctccagattgggctcaagaactacgacccacaaaaggataagcgtttcagtggtacagtgaagttgcctcacattcctcgtcccaaattgaaagtttgcatgcttggagatgcccagcatgtggaagaggctcaaaagataggcctagaatacatggatgtggaagggctcaagaagctcaacaagaacaagaagctggtgaagaagcttgctaagaagcaccaagcttttttggcttctgaatctgtcatcaagcagatcccccgtttgttgggccctggtctaaacaaggctggaaaattccctacgcttgttactcaccaagaatctctcgaggctaaggtgaatgagaccaaagcaactgtgaaatttcaactgaaaaaggtgctgtgcatgggagttgctgtcggaaactgcagcatggaggataagcagattttccaaaacgtgcaaatgagcgtcaactttcttgtttctttattgaagaagaattggcaaaatgtgaggtgtttgtacttgaagacaacaatgggaaagccagttcgcatcttttaggtgttttctttctttgtttctcagagttgttcggtttgaggtcagtacttggtgaaagcatttagtgggtgcttatcgtttttgacttgtcgaatgttgggttttttaatactgtattagatgatgattatgctgctaccatgaacaagtattattcgttttaaaatgcaccaatcga

SEQ ID NO: 15663 - DNA, 861 bp, Fagopyrum esculentum
tcgggggtacccttctctgttttcgctgcacccatcaaactcgagcagccgccatgagtaagctttcgaacgatgccttaagagaggccatatctaccatctccaaatctgccgcggagaagccgaagaagttcaccgagaccatagagcttcagattggtctcaagaactatgacccacaaaaggacaaacgtttcagtggctccgtcaagctcccccacgttccccgccctaagatgaaggtctgcatgctcggagatgcccagcacgttgaagagtctgagaaagttgggctggactcaatggatgttgaagctctgaagaagttgaacaagaacaaaaagttggtgaagaagcttgccaagaaataccatgcctttttggcatccgaagctgtgatcaagcagatcccacgtttgcttggtccggggcttaacaaggcaggaaagttccccaccctggtttcacaccaggagtcattggagaacaaagtgcaggaaatcaagtcaacagtgaagttccagcttaagaaggttctctgcatgggtgttgctgttggaaactgtggcatggaggagaagcagatcttccagaatgttcagatgagcgttaacttccttgtctctttgctgaagaagaattggcaaaatgttcgttgcttgtacctgaagagcaccatgggaaggccagttcgcatcttctaagccttgaaatgttttctagttgcagctgtaatggattgccaattttgttaactttgtttcatgttgcactcaaattcttcaattcaagtttgatactcaatcctcccagcatattagatttgaaattttactacgattgctgattgctgcttcagtt

SEQ ID NO: 15664 - DNA, 707 bp, Flaveria ramosissima
ggcactttgaaaccctactctcagggttctcacggagacgtgaagttaacgagaagagaagtttcctaaaatgagcaagcttcaaagtgatgccctcagagaggcaattactcagatcaccactgatgccaaagaaaagaaacgtaatttcaccgagaccattgagcttcaaattggcttgaagaattacgacccacaaaaggacaaacgtttcagtggtacagtgaagttgcctcacattcctcggcccaagttgaaagtttgcatgcttggtgatgcccaacatgttgaagaggcccaaaaaattggtctagaatatatggatgttgagggtctgaagaagcttaacaagaacaagaagttagtgaagaaacttgctaaaaaacaccaagctttcttggcttctgagtctgtcatcaagcagattcctcgtttgttgggccctggtcttaacaaagctggtaagtttccgacacttgtcacccaccaggagtcccttgaggctaaggtgaatgagaccaaagcaacagtgaagtttcaactaaagaaggtgctgtgcatgggagttgctgttggaaactgcagcatggaggaaaagcaaattttccaaaacgttcaaatgagtgtcaattttcttgtttctttgctcaagaaaaattggcaaaacgtccggtgcttatacttgaagacaacaatggggaagcctg

SEQ ID NO: 15665 - DNA, 700 bp, Helianthus annuus
tagggtttataccgaagaagtgaagtttcactaaggaaaacctaacaaaaatgagtaagcttcagagtgaagccctgcgtgaggccattactcaaattaccaccgatgccaaagaaaagaagcgtaacttcaccgagactatcgagctccagattggactcaagaactacgacccacaaaaggacaagcgtttcagtggcaccgtgaaattgcctcacattcctcgccctaagttgaaagtttgcatgcttggagatgctcagcatgtggaagaggcccaaaagattggtcttgaatacatggatgttgaaggtctcaagaagctcaacaagaacaaaaagctcgtgaagaagcttgccaagaaacaccaggcttttttggcttctgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagcgttaattttcttggttcattggtgaagaaaaactggcagaatgtccgatgtttgtacttgaagacgacaatgggaaagccggttcgcatctttta

SEQ ID NO: 15666 - DNA, 835 bp, Linum usitatissimum
gagctcagtagcttcttccctctagcctctccgactggtaatcatgagtaagcttcagagtgattcgttgagagaagcgatcacaaccatcaagactgctgcacaagagaagccgcgcaagttcaccgagaccgttgagctccagattgggttgaagaactatgaccctcagaaggacaagcgtttcagcggctccgttaagctgccccacattcccaggcctaagatgaaagtctgcatgcttggagatgcccagcacgtcgaggaggctaatgccatgggtctgcaatccatggacgttgagagcttgaagaagctgaacaagaacaagaagttagtgaagaagcttgccaagcagtaccatgcttttttggcttctgagtctgtcattaagcagattcccagacttctcggccctggtctcaacaaggcaggaaagttccccacacttgtgagtcaccaggagtcactcgagtccaaggtgaacgagatcaaggcgacagtgaagtttcagctgaagaaggttctgtgcatgggtgttgcagttggaaacctggacatggacgagaagcagatcttccagaacgttcagatgagcatcaatttcctcgtctcccttctgaagaagaactggcagaacgtcaaggttctgaacctgaagagtaccatggggaaaccagttcagatcttttaaagagggttgtcttcacttgtcatctcgtcttaaagcacttgttttttttgtaaggttggagctttcatagctttatcatttgaagtttgttcttatctgggtgactgcagatatcatactgctaattcagtacaaattttg

SEQ ID NO: 15667 - DNA, 696 bp, Sequoia sempervirens
gcgataacaggactagtgggagagagcaaagagaagaataggaagtttgtggagacgatagagctgcagatagggctgaagaactatgacccccagaaggacaagcgtttcagtggctccgtcaaactacctcacatccctcgccccaagatgaagctctgtatgctcggagatgcccagcatgttgaagaggctgtgaaaataggtctggactacatggatgtggaaggattaaagaaaatgaacaagaacaagaaactggttaagaagcttgcaaagaaatatcatgcttttctcgcatcagaagcaattattaagcagattcctcgacttcttggtcctggtctaaacaaggcaggtaaatttcccactttggtgtcacatcaagagtcattggaggggaaagtaaatgaaaccaaagctacaatcaagttccaattgaagaaagttctctgtatgggtgttgccgtgggcaactgtggcatggaggaaaagcaaatatttcagaatgtccagctgagtgtcaactttctggtgtccttgcttaagaaaaactggcaaaatgttcgttgcctttatctgaagagcaccatgggcaagccatctcggatattctaatctaatactgcaattagttttagcttttgctcaattaactttgagatatgtattgttttgttcgtttaatgtatgagg

SEQ ID NO: 15668 - DNA, 948 bp, Linum usitatissimum
gaatttcgcccattacgccggggggaaaagccgcccgtcaccactcttcttcttctcttgtttcaccgcgagctcagtagcttctttcctctagcctctccgactggtaatcatgagtaagcttcagagcgattcgttgagagatgcgatcacaaccatcaagactgctgcacaagagaagccgcgcaagttcacggagaccgttgagctccagattgggttgaagaactatgacccacagaaggacaagcgtttcagcggctccgtcaagctgccccacattcccaggccaaagatgaaagtctgcatgcttggagatgcccagcacgttgaggaggctaatgccatgggtctgcaatccatggacgttgagagcttgaagaagctgaacaagaacaagaagttggtgaagaagcttgccaagcagtaccatgcttttttggcttcagagtctgtcattaagcagattcccagacttctcggccctggtctcaacaaggcaggaaagttccccacacttgtgagtcaccaggagtcactcgagtccaaggtgaacgagatcaaggctacagtgaagtttcagctgaagaaggttctgtgcatgggtgttgctgttggaaacctggacatggacgagaagcagatcttccagaacgttcagatgagcatcaatttcctcgtctcccttctgaagaagaactggcagaacgtcaaggttttgaatctgaagagtaccatggggaaaccagttcagatcttttaaagaggggtgtcttcacttgtcatctcttgttataaagtacttgtctttttttgtaaggttggagctttcatagctgtatcatttgaagttattcttatctgggtgactgcaggtatcgtactgctaattcagtaaaatttttgctggaaatttgcaatttgtgttagttgttcaccatgtttcgc

SEQ ID NO: 15669 - DNA, 1227 bp, Papaver somniferum
ctcttcactgccgcatagtctctgggtttgcgatagttctctttgattaatagaaggttacaagattagttgaactagatctgcttctagttcaactaatctgttttcgatcactgtcgatccattttctgtttcgatctagaatccttcttcttcgtgtcatctgctgttactaatttgtttatttgtgttatttgtgttgttttggttacagggtagaagtttgtaccaggaaaataaccatgagtaagcttcagagtgaagtgttgagggaagcaatctcccagattaataccgaagctaccgctaaaaagcgaaatttcaccgagacagtggaacttcagattggtcttaagaactatgaccctcaaaaggacaagcgtttcagtggttcagtgaagttgccacatattccccgacctaagatgaaagtctgcatgcttggagatgctcagcatgttgaggaggctcagaagatcggtcttgagtacatggatgttgaaggtcttaagaagcttaacaagaacaagaaaatggtcaagaagcttgcaaagaagttccatgcttttctagcctcagaagctgttatcaagcagattccccgtcttcttggacctggtcttaacaaggcaggtaagttcccaactcttgtgactcatcaagagtcattggaggccaaggtgaatgagaccaaggctatggttaagtttcaattgaagaaagtgctctgtatgggtgttgctgttggtaacctaggtatggaggagaagcagatcttccagaacgttcagcttagtgtcaactttctagtatcattgttgaagaagaattggcaaaatgtgaggtgcttgtacttgaagagtaccatgggaaagccagtccgcatcttctaagcactacatttctataattgcaagggcaattcctacctgctcttcatgtgagacccctggagagttagacttagggaataccctgcgagtcccgagagtctgtaaccagatataggtagtaactgtttgcatgagtagtagactttttctgaaaatgctcagtaaatctttttgtttaattcctgaattcgttttttctgttttttactggtagttcagggatacttaaatcttggaagataatgatttggcttttctttatgacttgttaaatagatgattggctttaccagatttttttagtatatacttggtatgctcatttgtagctcta

SEQ ID NO: 15670 - DNA, 780 bp, Cephalotaxus harringtonia
ggaggcgataacaacggtggtgggagatagcaaggagaagccgaagaagtttgtggagacgatagagttgcagataggcctcaagaattatgatccccagaaggacaagcgcttcagcggctctgtcaagcttccccacatccctcgccccaagatgaagctctgcatgctcggtgatgcccaacatgttgaagaggctgtgaaaataggtttggactacatggatgtagaaggattaaagaaaatgaacaagaacaagaagcttgttaagaagcttgcaaagaaataccatgcttttcttgcatcagaagcaattattaagcagattcctcgactccttggtcctggtctaaacaaggctggtaagtttcctactttggtgtctcaccaagagtctttggagggaaaagtaaatgaaacaaaagccacaataaagttccaattgaagaaagttctgtgtatgggtgttgctgtgggtaactgtggcatggaggaaaagcaaatattccagaatgttcagttgagtgtcaactttctggtgtccttgctcaagaagaactggcaaaatgtgcgctgtctgtatctgaagagtaccatgggcaagccatcgcgtatattctaattgtgcattttagtggtagcttttgctcaatgaactatggaatatgttttgttttattgattagggaaagaggtttaaacaattttgttttgttgatttcggtgtaactttatgctgaagcataagttggccaataggcaaggtccaatgcatgttgt

SEQ ID NO: 15671 - DNA, 716 bp, Flaveria ramosissima
cttcagagtgatgcccttagggaagctattacccaaattaccaccgatgctaaagaaaagaaacgtaatttcactgagaccattgagcttcagattggccttaagaactacgacccacaaaaggacaaacgttttagtggaactgtgaagttgcctcacattcctcgaccgaaattgaaagtttgcatgcttggagatgcccagcatgtagaagaggctcaaaagattggtcttgaatacatggatgtcgaaggactcaagaagctcaacaagaacaagaagctggtgaagaagcttgcgaagaaacaccaggcgtttttggcttctgaatccgtcatcaagcaaattcctcgtttgttgggccctggtcttaacaaggcaggaaagttcccaacacttgttactcaccaggaatctctcgaggctaaggtgaatgaaactaaggcgacagttaagtttcaactgaaaaaggtgttgtgcatgggagttgctgttggtaactgcagcatggaggaaaaacagattttccaaaatgtgcagatgagtgttaatttcctcgtttcattgctaaagaaaaactggcagaatgtgagatgtttgtacttgaagacaacaatgggaaagccagttcgcatcttttaggtgtcaagtctgtttttctttcaaatttgttgcgaggtggtgactgttttgacttatcagatatctgttatgtg

SEQ ID NO: 15672 - DNA, 822 bp, Helianthus annuus
aagaagtgaagtttcactaaggaaaacctaacaaaaatgagtaagcttcagagtgaagccctgcgtgaggccattactcaaattaccaccgatgccaaggaaaagaagcgtaacttcaccgagactatcgagctccaaattggactcaagaactacgacccgcaaaaggataagcgtttcagtggcaccgtgaaattgcctcacattcctcgtccaaagttgaaggtttgcatgctcggagatgctcagcatggggaagaggcccaaaagattggtcttgagtacatggatattgaaggtctcaagaagctcaacaagaacaaaaagctcgtgaagaagcttgccaagaaacaccaggcttttttggcttccgaatctgttatcaagcagattcctcgtttgttgggtcctggtctaaacaaggccggtaaattcccgacgcttgtttcccaccaggaatccctcgaggctaaggtgaatgaaaccaaggcaactgtcaagtttcaactgaaaaaagtgttgtgcatgggagttgctgtcgggaactgcagcatggaggagaaacagatttttcaaaacgttcagatgagcgttaattttcttgtttcgttgttgaagaaaaactggcagaatgtccgatgtttgtacttgaagacgacaatgggaaagccggttcgcatcctttaggtgttttatcgttgtttttggttgagccagtttcaggaagcatttccatttaatgggtgctattgtttttgacttgttggatgtttgttttcttattgtattagatgctgctatgaacattatggttaatggtta

SEQ ID NO: 15673 - DNA, 914 bp, Linum usitatissimum
caggaaccggatttcttttgctcatttgaacgcatccagccatgagtaagcttcagagtgagtcgttgagagaagcaatctcgaccattaagactgctgcacaagagaagccgcgaaagtttaccgagactatcgagctccagattggtttgaaaaactatgacccgcaaaaggacaagcgtttcagtggctctgtcaagttgccccacattcccaggcctaagatgaaggtctgcatgcttggagatgcccagcacgtcgaagaggcaaatgcaatgggtctgcaatccatggatgttgagagcttaaagaagctgaacaagaacaagaagctagtgaagaagcttgccaagcagtaccatgctttcttggcctctgaatctgtcatcaagcagattccccgtcttctcggccctggtctcaacaaggcaggaaagttccctacacttgtgagtcaccaggagtcccttgagtcgaaggtcaacgagatcaaggccactgtcaagttccagctgaagaaggtactctgcatgggtgttgcagtcggaaacttggacatggacgagaagcagatcttccagaatgtccagatgagtatcaacttccttgtctccctgctgaagaagaactggcagaacgtgaaggttctgaacctgaagagtaccatgggaaagccagtacaaatcttctaaaaaccgtgttgggttgtcacttgtggatcgatcggtctgtttttttttgaagtactcctgtaaggttttcaagttctttagctgtgagtggttgaaactatacttcttgtctgtggtttgtactagatgatcatttatgaaagttttgtttcgggttttcgacatttgtttcgtttatggttcctgctcatgttccgccaatgtatgctcttgttagacatt

SEQ ID NO: 15674 - DNA, 3147 bp, Prunus persica
ttatttcttgtcgaatgggtaacgaagcccttcaaatgagtctcccgctagtgctcttgacgatccttacattctcagctctttcagcaacagcttcagcgagcgatcgcagctacaatgtaggagatcatgttcccttgttcgtcaacaaagttggccccttgaacaaccccagtgagacctatcaatactatgatttgccattctgctgcccagatccagtaatccaaaagaaagaatccattggggaagttttgaatggtgatcgtttggccaacaccttatatcagttgaatttcaggcaggacaaaaatggggagagcttgtgccagaaaaagcttaaagttgctgaagttgcgaaatttagggatgctattgttaatgatttttacttccagatgtattatgatgatcttccagtgtgggggttcattgggaaagttgaagatgagagttggactattagtgacaaggggaccaagtattatctattcaaacatgtgctgtttgatgttttttacaatgggaaccaaataatagaaatacgtgcttttagtgatccaaatcatgttgctgatataacagaagatgttgatattgacgttgagttcacttattcggttaaatggaatgcaacatctattcagttccagaacaggatggacagatactcaaaggcctcattactgccagtccgcctgaaaattcattggttctcatttattaactccattgtcatcattgtgcttttgatgggattgcttaccttgctaataatgcgacgcctcaagaatgacctgagaaagtgctctaatgatgaagaagaagacaaggaggttggttggaaatacattcacggtgatgttttcagatatccatccaacatgcccctgttttgtgctgtcttgggtgtgggtacccaactgctcatcatggtctgcatcttattttttctgtcattttttggagtcctctatccctacaatcgtggagctctgttcacttctcttgtctttatatgtactcttacctcaattgtcgctggatacactgctgctgctttccacactcaattttctgtaattggatgggagaggagtgttcttctaacagcgattctctacctgggcccattgtttgtgacatcgtctatccttaatacagttgctatatcttatggggcaacagctgcaataccttttggcaccctcctagcaattcttcttatatatgcatttcttgccattccattgcttgccttaggtggggtgattggatattgtttaaggtctgaatttcaagcaccttgtgctacaaagcaatttccaagagagatccaacgattagcttggtacaggagaacacattgtcaaatgtttatcggtggtctattgccgtttagtgcaattgcccttcagttacaccacctgtatgcaagcatgtggggctataaaatttacactctacctggaattttgtttcttacgttcatcatcctcatcataatgacttcaatcttgactgtcggtttgacatacattcagctttctgttgaagaccatgaatggtggtggaggtcagtgttgtctgggggttcaacggctatttttatgtttgcctatagcatttacttctatgccagatcaaacatgacgggtttcatgcaactatccttctttattggctataatgcttgcatgtgttatgcgttcttcttaatgcttggtgccattagtttccgtgtttccttgatatttgttcgccatatatacggagacgtagataactcacttgccatacacccctatattcatgacgtgtaatgtaaacccccacccattttctctttggttttcctttcttcccacacccaaacacaaaccccagcaagcctccataaaaccccacacagcccctcaacaactccagcctcaaaatgaagagaacccatttctcattcatggaagaaaatcccaacaatatgatcaacatgggcagccaacagattcctgctttttccgggaaaagaaccaaacaccacgaccctaacaatcttgtgggatttcaaagcatgcagcagcctgaggaattgcatggtgatggtgctgatcatcaggtgcagtcgggacgtgagaggctgaaaaggcaccaagaggaggtggctggccgcgtgactatccccgattcatgggatcaggaggagctgctcaaggattggatcgattattctccgtttgatgcgctgttggttccaaaaggactcacttcagctcgtgaggcacttgccatggagggacgtcgagcaagtagttctcaaggagtgctgagaatagagagtagtaaacttcagagtgatactctcagagagggtatttccaccatcatggctgcgtccaaggaaaaaaaccgcaagttcactgagaccatcgaacttcagattgggctgaaaaattatgatccccaaaaagacaaacgtttcagtggttctgttaggttgccacacatccctcgtccaaagatgaaggtttgcatgcttggagatgctcagcatgttgaagaggctgagaagatagggttggattatatggatgttgaagggctgaagaagctaaacaagaacaagaaattggttaagaaactggccaagaaataccatgcctttttggcatcagaagctgttattaagcagattccccgtcttttgggtcctggtctcaacaaggcaggaaaatttccaaccctggttactcaccaagaatctctcgagtctaaggttgctgagacaaaagcaaccattaagttccaactgaagaaggttctttgcatgggagttgctgtggggaatgcctccatggaggagaaacagatcttccaaaatgtgcaattgagtgttaacttccttgtttcacttttgaagaaaaattggcaaaatgtgaagtgcttgaacctgaagactactatggggaagccatatcgcatctattaagaagtcatttactaatttttggatgtaggggctggttatggaaagcctgatacttaataggagttgtgtttttatctgaatggtcaagttttcgtgtttgttggctgttttactttgtttgatggttatcgacattgttatggtagacatgatcatatctt

SEQ ID NO: 15675 - DNA, 834 bp, Ambrosia trifida
aggaaaagttaactgaaaatagagtaagacttcaaagtgaagcccttagagaggcaattactcagatcactactgctgcgaactgaaaagaaacgtaactttaccgaaaccattgagcttcaaattggtttgaagaattacgatccacaaaaggacaaacgtttcagtggtaccgtgaaattgcctcacattcctcgccccaagcttaaagtttgcatgcttggagatgctcaacatgttgaagaggctcaaaaaattggccttgaatacatggatgttgagagtctgaaaaagttgaacaagaacaagaagttggtgaagaaactcgctaagaaacatcaagcttttttggcttctgagtctgtcattaagcagattccccgtttgttggggcccggtcttaacaaagcaggtaagttccctactcttgtttcccaccaagaatctctagaggcgaaggtgaacgagacaaaagcgacggtcaagtttcaacttaagaaggtgctctgcatgggagttgccgttggaaactgcagcatggaagaaaagcaaatctttcagaatgttcaaatgagtgtcaacttcttagtttctttgcttaagaagaattggcaaaacgtgcgatgcttgtacttgaagacaacaatgggaaagccgattcgcatcttttaaagagtttatttgttatgttttcgttttggattaatgttgaggtcagtactggaaaacatatttcccatgaacagggaatagtccttttgctttttacattgtttgtttgagtaaactgtctatttcgtcctgaggtttggctactttttgcctagtttcatt

SEQ ID NO: 15676 - DNA, 830 bp, Fagopyrum esculentum
accttctctgttttcgcctgcagccatcgaactagagcagccgcaatgagtaagctttcgaacgatgccttaagagaggccatatctaccatctccaaagctgcccaggagaagccgaagaagttcaccgagaccatagagcttcagattggtctcaagaactacgatccacaaaaggacaaacgtttcagtggctccgtcaaactcccccatgttccccgccctaagatgaaggtctgcatgctcggagatgcgcagcatgttgaagagtctgagaaagttggtctagactctatggatgttgaagctctgaagaagttgaacaagaacaaaaagttggtgaagaagcttgccaagaagtaccatgccttttggcatccgaagctgtgattaagcagatcccacgtttgcttggtcctggtcttaacaaggcaggaaagttccccactctggtttcacaccaggaatcattggagaacaaagtgcaggaaatcaagtcaacagtgaagttccagcttaagaaggtgctctgtatgggtgttgctgttggaaactgtggaatggaggagaagcagatcttccagaatgttcagatgagcgttaatttccttgtctctttgctgaagaagaattggcaaaatgttcgatgcttgtacctcaagagcaccatgggaaggccagttcgcatcttctaagctttttcatatgttttctagtgttgttgctgtaatggattgccaattttgtttgactttgttttacttcgcactgaaattcttcaattcaagtttgatactcaatcctcccagcatattagatttgaaagttta

SEQ ID NO: 15677 - DNA, 1017 bp, Cannabis sativa
tgtaattgctatgacaacagtaagcttcagagtgaagtcctcagagaggcaattgccactataatgaacgaatcaagggagaagaatcgtaacttcactgagacaattgaacttcagattggtttgaagaactacgatcctcaaaaggacaagcgtttcagtggctccgttaagttgccccacattcctcgtcccaagatgaaggtttgcatgcttggagatgctcagcatgttgaggaggctgtgaaaattaatttggactacatggatgttgaagggttgaagaagttgaacaagaacaaaaagctggttaaaaagcttgcaaagaaataccatgcctttttagcatcagaggctgttattaagcagattcctcgtcttttaggccccggtctcaacaaggctggtaaatttcccacccttgttactcaccaagaatccctggagtctaaagtcaatgagaccaaggccatggttaagttccagctgaaaaaggttctgtgtatgggtgtcgctgtcggaaacctctccatggaggagaagcaggtcttccaaaacgtgcagatgagtgttaatttccttgtttcactcttgaagaagaattggcaaaacgttaggtgtttgttcctgaagaccaccatggggaagccacaacgcgtgttttaaatatttaatctatttttacatgtatggtggagttttgtagtgagatgttttatgaggttgatacttatataaagtattcagttggaattctcaaagttgcttttttacttagttgtttcaaggtttataacatggtcatgtgttttgttaagaactttttattcttgttgcagaatcaatttttgtttacttattgccccctaatttttgaacacatcatataatggtcttaatatttcacagaatgacaagccgtttagatttcatttattcttaatgaaattgtgaaatatttctatcttgttaatggtgatagactaaaccaagtctactttattttaaatattttca

SEQ ID NO: 15678 - DNA, 783 bp, Actinidia deliciosa
cggccgctctagaatactctcgagggcaccgaggggaaacgttgttatttgtcccacaacgaaaatatagcttctctctcgctgccgcgaagtcatcgcccatcgcaaaccctaatctagggttttcatctcagtgcacataagtctgaaggaaggaaaaagtttcagccatgagtaagcttcagagtgaggccttgagggaagcaatctctcaaatttctaatgatgccaaggagaaaaagcgtaacttcactgaaaccattgagctccagattgggttgaaaaactatgatccccagaaggacaagcgatttagtggttccgtgaagttgcctcacatccctcgtcccaagatgaaagtttgcatgcttggtgatgctcagcacgtggaagaggctgagaagataggtttggagtatatggacgtggaagggctgaagaaactcaacaaaaacaagaaactggttaagaaactggctaagaaataccatgccttcttagcgtcagaagctgtcatcaagcagattcctcgtctattaggccctggtctcaacaaagcagggaagtttcctacccttgtcactcaccaggaatctctcgagtctaaagtcaatgagactaaagcgacagttaagttccaactaaagaaggttctctgcatgggagttgctgttggcaactgtagtatggaggagaagcagattttccagaatgtgcaaatgagcgttaattttctggtttcattgttaaagaagaactggcaaaatgtgaggtgcttgtacc

SEQ ID NO: 15679 - DNA, 1001 bp, Quercus alba
acgagtgcgtgagggttttgatttataagatccaaatgcgtcaaatttatacttctcttctgccatcgctcactctctgtaccgcctcccaaaacccttctcttcagaggcatttgaaaaaggtgtatagcgatgagtaagctccagagcgatacattgagggaggtgatatcgcaggtggtgaacaatgcgaaggagaagaagcgcaacttcacggagaccattgagctccaaatcgggttgaagaactacgaccctcagaaagacaagcgtttcagtggctccgtcaagctccctcacattcctcgccctaagatgaagatttgtatgcttggtgatgctcagcacgttgaagaggcagagaaggtgggattggagtatatggatgtggaagggctgaagaagctcaacaagaacaagaaactggtgaagaagcttgccaagaagtaccatgcctttttagcatctgagtctgtgattaagctaattcctcgtcttttgggtcctggtcttaacaaggcaggtaagtttccaacactggtgactcatcaagaatccttggagtcaaaggttaatgaaacaaaagcaatggtgaagtttcaactcaagaaggttctttgtatgggggttgctgttggaaattgcagtatggaggaaaagcaaatcttccagaatgtgcaaatgagtgtcaacttccttgtttcattgttgaagaaaaattggcaaaatgtgaggtgcttgaatctgaagagtaccatggggagcgctgtacgcctttattaagtccatttttgctgtttgtgagagttatgtaggagaagcagcatgagtgaattgtcgtttgagcattatgttcgcaagacattccttggggaattttcctgaggtcctttttgttttcttttgttttggattctttagcttcaaagtttagttaatgatgatatttttgtttaaatttgatgttattggttgagcaaagaaagcttcttatgtttgtt

SEQ ID NO: 15680 - DNA, 1101 bp, Fagus grandifolia
gttctcctctgccatcgctctctcactgcagcgcctctctctacagagcctccattggagaagaagcaagtgaaaagagaatcctctaaccatgagtaagcttcagagcgatacattgagggaggtaatctctcaggtggtgaacaacgcgaaggagaagaagcgtaacttcacggagaccatagagctccaaatcggattgaagaactatgatccccagaaagacaagcgtttcagtggctccgtcaagctccctcatatccctcgccctaagatgaagctttgcatgcttggtgatgcccagcacgttgaagaggctgagaaggtaggattggagtatatggatgtggaagggctgaagaagcttaacaagaacaagaaactggtgaagaagcttgccaagaagtaccatgcctttttggcatctgagtcggtgattaagctgattcctcgtcttttgggtcctggtcttaacaaggcaggtaagtttccaacactggtgactcaccaggaatccttggagtcgaaggttaatgaaacaaaagcaatggtgaagtttcaactcaagaaggttctttgtatgggcgttgctgttgggaattgcggtatggaggaaaagcagatcttccagaatgtgcaaatgagtatcaacttccttgtttctttgttgaagaaaaattggcaaaatgtgaggtgcttgaatctgaagagtaccatggggagcgcagtccgtctctattaagttcattttgctgctagtgagttatttaggagaagaagcctgagagaaatgtcttatgaacactatgtaagcaagacattccttggtgaatgctcctgaggtcctttttgttttcattgttttggattctttagcttcaaattttagttaatgcctgatatttttgttttgatttgatgttattggtgggtgagtaaagaaagctccttgtgtttctttttgggtatggtttagtggcatggtttgattcaggttataaggttattatgtccataaacatgggcgttttgtttcttcttgtaactttcctattatgagagagatccgttgcccttatcaattgaaagaaggaaccggct

SEQ ID NO: 15681 - DNA, 740 bp, Euphorbia peplus
gaacaccttcaaaattcaatcatcatgagtaagcttcagagtgaagcattgagggaggctatcaccactatcatgactgcctccaaggaaaagaagcggaatttcacagagacaattgaactccagatagggcttaagaactacgatccccaaaaggataaacggttcagtggctctgtgaaattgcctcacatccctcgccctaagatgaaggtttgcatgcttggagatgctcagcatgttgaggaggctacagcaattggcctccaatggatggacgtggaggctcttaagaagctcaacaagaacaagaagcttgtgaagaagctggccaagcagtaccatgcctttttggcttctgaatctgtcattaaacagattccccgtcttcttggccctggtctcaacaaggcaggtaagttcccaactcttgtgacccaccaagagtccttggagtctaaggtcaacgagacaaaagccacggttaagtttcagttgaaaaaggtgctttgcatgggtgttgctgttggaaactgtgccatggaggagaagcaagttttccagaacgttcaaatgagcgtgaacttccttgtctctctacttaagaagaactggcaaaacgtgaagtgcctaaacctgaagactacaatgggttctcctcaacgtgtcttttaaggagtttgatttcgaattgcagttgaacttttgagagacagtttcttgataattatagaattttt

SEQ ID NO: 15682 - DNA, 1057 bp, Malus domestica
atgtcgagggtttatctgtcgatatatctcaccacctcccattatcttaaagctcctctgccgccagaaaccctaacgagcccttctcttacattcaggtcagaattcttcgtttggtccggcagcttaagcttcggccatgagtaaacttcagagtgataccctccgagagggtatttccatcatcatgacggcgtccaaggaaaaaaaacgtaacttcactgagactattgaacttcagattgggctgaaaaattatgatcctcagaaggacaaacgtttcagtggttctgttaggttgccacacatccctcgtccaaagatgaaggtctgcatgcttggagatgctcagcatgttgaggaggctgaaaagattgggttggactatatggatgttgaagggctgaagaagctcaacaagaacaaaaagttggttaagaagttggcaaagaaataccatgcctttttggcttcagaagctgttattaagcagattccccgtcttttgggtcctggtctcaacaaggcaggaaaatttccaacccttgttagtcaccaagaatccctcgagtctaaggtttccgagacaaaagcaatgatcaagttccaactgaagaaggttctttgtatgggagttgctgtagggaatgtatccatggaagagaagcaggtctttcaaaacgtccaattgagcgttaactttcttgtttcgctgttgaagaaaaattggcaaaatgtaaggtgcttgcatttgaagactactatgggtaagccatatcgcatctattaagtactttagcttatttcgggagttctttagggagatgagaggttattggagcctgatacataataggaagtgtgtttatctgaatggtcaagttttggtattggttggctgttttacgttgtttaatggtaatcgtcacggtaatgttctactaaatatatatatatattgtcggagtggaagcctggttttgatattttggcgtgagcatatatgtatgaagaacattttctatgtaaggaatgcaatttttcccaattccattga

SEQ ID NO: 15683 - DNA, 941 bp, Linum usitatissimum
tccttcctggtattcagagtttccaatcatgagtaagctgcagagtgagacactgagagaagccatctcagccatcaaagccgctgctaacgaaaagcctcgcaagttcaccgagacagtcgagttacagattgggttgaagaactatgacccccagaaagacaagcgtttcagcggctcagttaagttgcctcacatccctcgccccaagatgaaggtctgcatgctcggcgatgcccagcacgtcgaagaggcgaatgcaatgggactgcaatccatggatgtggaaagcttgaagaagctgaacaagaataagaaactggttaagaagctagcaaagtcttaccatgctttcctggcttctgagtctgttatcaagcagattccccgtcttctaggccccggtctcaacaaggcaggaaagttcccaactcttgtgagtcatcaggaatccctggagtcgaaggtgaacgagatcaaggcaaccgtgaaattccagctgaagaaggttctgtgcatgggagttgcagtaggaaacctcgatatggacgagaagcagatcttccagaatgtgcaaatgagcatcaacttccttgtttccctactgaagaagaattggcagaacgtgaaagtgttgaacttgaagagtacaatggggaaaccacaaagcatcttctgagaaggtttctgtgggacaagattgggactttttgggttttgagtgtaacggttagagaactatagctctaatatttagagggttttgctcaaaagatgcattggacttgcaattcgttaagaaattgttctttctcttgttacattgttgaaacttgttcattgtctctttggaacaatgatgataaacccctaaaagcagagaggagattggttcctcgtacatttgactcatttactgttttaatctacattgttgaaac

SEQ ID NO: 15684 - DNA, 796 bp, Camellia sinensis
gggatcgctcagttatcggctattacaaaccctaatctagggttttcttctctcagaaagtcggaagaaaaggaaaaaagtttcaatcatgagtaagcttcagagtgatgccttgagggaagcaatcacccagattactaatgatgccaaggagaaaaagcgtaacttcactgaaaccgttgagctccagattggactgaaaaactatgatcctcagaaggacaagcgtttcagtggttctgtgaagttgcctcatatccctcgtcccaaaatgaaggtttgcatgcttggtgatgctcagcacgtggaagaggctgagaagataggtttggagtatatggatgtggaggggctgaagaaacttaacaaaaacaagaaactggttaagaaacttgcgaagaaatatcatgccttcttagcatcagaagctgtcatcaagcagattccccgtctattaggacctggtctcaacaaagcagggaagtttcctacccttgtcactcatcaagagtctctcgagtctaaagttaatgagactaaagcgacagtcaaattccaactgaagaaggttctctgcatgggagttgctgttggcaacctcagtatggaggagaagcagatttttcaaaatgtgcaaatgagtgttaattttctggtttcattgttgaagaagaactggcaaaatgtgagtgcttgtacctgagagtaccatggggaaaccagtcgcatcttctaaacttctttctctgtttacggagcaatttagtgtgagcatgcttacagattttctgattga

SEQ ID NO: 15685 - DNA, 1076 bp, Ceratodon purpureus
gttgcgtttcttgtgttcgtctcaattctgccgcaaccatgagtaagcttcagagcgatgtcctcagggaggccatctcccagatcaccaccgccgcgaaggagaagaaccggaagttcacggagaccgtggaacttcagatcggtctgaagaactacgacccccagaaagacaagcgtttcagtgggtccgtgaagctgccccacattccccgccccaagatgaaagtgtgcatgcttggagacgctcagcacgtcgaggaggcgaacaagatcggcatggagtgcatggacgtcgagagcttgaagaagatgaacaagaacaagaagctggtgaagaagatggcgaagaagtaccacgctttcttggcttcggagtctgtgatcaagcagattccccgtctgttgggacccggcttgaacaaggccggaaagttccctgcgttggtgtcccaccaggagtcgcttgaggcgaagatgatggagacgaaggcgatggtgaagttccagttgaagaaggtgttgtgcatgggagttgccatcggtaactgcgagatggaggagaagcagatcttccagaacacccagatgagcgtgaacttccttgtgtccctgctcaagaagaactggcaaaacgtgagggtgctgtacttgaagacaaccatgggtgcccccgtccgtatctactagttttaaaggcgtagacagtcagggccctgaggttagagcggtgaagtattacaaactgtttcaaaacatgctttattgtagtggaagccactttcaatgatttgaatgacaattttgcacgacctgagtttgctttcagtgtttttgtgccggatgtctccaactagttcttccttgttgcgatttacaccttcactcagaatttggatcctgtctaaggttgagacacccatagtcgacagtcgacagatgaccaatagccgatatcttctaattcctagatatgaaagaacagatgtacctcatttgtatatatcggctattggttcggaagtacttttcactttgaaaaattgtacaaatttcaatattgggagataattcatg

SEQ ID NO: 15686 - DNA, 674 bp, Parthenium argentatum
ctttcaaaccctactctcagaggttgaagttaatcagaggaaaagtttctgaaaatgagtaagcttcaaagtgaagcccttcgagaggcaattactcagatcactactgatgcgaaggaaaagaaacgtaacttcactgaaaccattgagcttcaaattggtttgaagaattacgacccacaaaaggacaaacgtttcagtggtaccgtgaaattgcctcacattcctcgccccaaacttaaagtttgcatgcttggagatgctcaacatgttgaagaggctcaaaaaattggccttgaatatatggatgtcgagagtctgaagaagttgaacaagaacaagaagttggtgaagaaacttgctaagaagcatcaagctttcttggcttctgagtctgtcatcaagcagattccccgtttgttgggccctggccttaacaaagcaggtaagttccctactcttgtttcccaccaagaatctcttgaggccaaggtcaacgagacgaaagcgacagtcaaatttcaacttaagaaggtgctctgcatgggagttgccgttggaaactgcagcatggaagaaaagcaaattttccagaatgttcaaatgagtgtcaatttcttggtttctttactcaagaagaattggcaaaatgtgcgatgcttgtacttgaagac

SEQ ID NO: 15687 - DNA, 908 bp, Silene vulgaris
taaaccctaatttttcggttttggtgattgcggtttcgtgatttcatcatgagtaagttatcaagtgaggctgtgagagaagccattgccggcatttctagtgatgctaaggagaagggtaggaagtttacagaaacaattgagctccagattggtctgaagaactatgatccccaaaaggataagcgtttcagtggctctgtgaagttgccccatgttccccgccccaagatgaaagtttgcatgcttggtgatgctcaacacgtagaagaggctgagagaattggaatggaatccatggatgttgaagcgttgaaaaagcttaacaagaacaaaaaattggttaagaagcttgctaaaaagtaccattctttccttgcctctgaatctgttattaagcagatcccccgtttgctcggtcctggtctcaacaaggcaggtaagttcccaactctagttagccaccaagagcccttggaaaacaaagtgaacgagaccaaggctaccatcaaattccagctgaagaaggtgctttgcatgggtgttgccgttggtaactgcagcatggatgagaagcagatcttccagaatgttcaaatgagcgtcaacttccttgtgtcactcttgaaaaagaattggcagaatgtcaggtgtttgtacctgaagagtaccatgggcagaccctaccgcatcttctaagagagttgccgcccaacgttgtttcgattgttcgagttctctgccttttcttttttttccttctattgtggaagtagggtagtggtaatcaatttaaagtttagtatactgagacactcctgaatttcttaatattctgtttgtttcatgatgctcaatgtaacttggagctgcaacgagtcgacgactttatttaatagatttgtttt

SEQ ID NO: 15688 - DNA, 974 bp, Linum usitatissimum
gactgcgagctaaggagctgccaggaaccggatttcgttgatcatttgaacgcattaagccatgagtaagcttcagagtgagtcgttgagagaagcaatctcaactattaagactgctgcacaagtgaagccgcgcaagtttaccgagactgtcgagctgcagattggtttgaagaactatgacccccaaaaggacaagcgtttcagcggctctgtcaagttgccccacattcccagacccaagatgaaggtctgcatgcttggagatgcccagcacgtcgaagaggcgaatgcaatgggtctgcaatccatggatgttgagagcttgaagaagctgaacaagaacaagaagctagtgaagaagcttgccaagcagtaccatgctttcttggcctctgaatctgtcatcaagcagattccccgtcttctcggccctggtctcaacaaggcaggaaagttccctacacttgtgagtcaccaggagtcccttgagtctaaggtcaacgagatcaaggccacagtcaagttccagctgaagaaggttctctgcatgggtgtggctgttggaaacttggacatggacgagaagcagatcttccagaatgtccagatgagtatcaacttccttgtatctcttctcaagaagaactggcagaacgtgaaggttctgaacctgaagagtaccatgggaaagccagtacagatcttctaaaaatcatgttgggttctcgcttgtggatcgatcggtctgtgtccttttttttgaagtactcctgtaaggttttcaacttctttagctgtgagtggttgaaactatagtacttctctgtggcttgtactagaagatcatttataaaagttttgtttctggttttcgacattgttcttccgttatggtgcctgctttgcaccatggccacagttctataatcctacctataatgaagaatttcatagattgaagcggacaattg

SEQ ID NO: 15689 - DNA, 988 bp, Silene vulgaris
agcagccacaaaccctaaacccctctttctctctcctggttttggcgtttgattcatcatgagtaagttatcgagtgatgctgtgagggaagctatctctggtattttaactgatgccaaggataaggaaaggaaatttgttcagacaatcgagctccagattggtctgaagaattatgatccccaaaaggataagcgtttcagtggttccgtcaaattgccccatgttcctcgtcccaagatgaaagtttgcatgcttggagatgctcaacacgttgaggaggctgagagagttggtttggaatcgatggatgtcgaagcattgaagaagcttaacaagaacaagaagttggttaagaagcttgctaagaagtaccattctttccttgcctcagaatctgtcatcaagcagattccccgtttgctcggtcctggtctcaacaaggcaggtaagttccctactctcgttacccaccaagaacctcttgagaacaaggtgaacgagatcaaggccacaatcaagttccaattgaagaaggtgctttgcatgggtgttgctgttggaaactgtgggatggatgagaagcagatcttccagaacgtgcaaatgagtgtcaacttccttgtctccctcttgaagaagaattggcaaaatgttaggtgcttgtacctgaagagtaccatgggaagaccctaccgtatcttctaagaatgttccaactctttttggttcaggttcttgatattatgagtgatcgtttttcttgtcacctgaaagtagttcagtgtatcgtcttgagcgtagaatacttgggaaactctttaatgggcgaacgttatcttgtcagttttgttatgacattgttcgatgactatttattacggatatgcttgttttgttggtcattgggttcgttttgaatctctctttttgttttcttacaagtttctccgtaaagttcccctattaactgttaagggaagttat

SEQ ID NO: 15690 - DNA, 774 bp, Salvia sclarea
ctactagaccttggctgtcactcaattgcagccaccgtctcaccacccctgctctagggattttcttcagtgattcgggcagctaattgaccgtgaacgatgagtaagcttcagagtgaggcgctgagggaagccatcactgtgattgttaaagaagctaatgagaagaagcgcaacttcactcagactgttgagctccagattgggctcaagaactatgacccccaaaaagacaagcgtttcagtggctctgtgaggttgccccacattcccagacccaaaatgaaactctgcatgcttggagatgcccagcatgtcgaggaggctgagaagattggccttgagtccatggatgtggaagcactgaagaagctcaacaagaacaagaaacttgtgaagaagctagcaaagaggtaccatgctttcttggcatcagaagcagttattaagcagattccacgtctcttgggacccggtcttaacaaggcaggtaagttccctactctcgtgactcaccaggagtcccttgaagccaaggtgaacgagaccaaggccactatcaagttccagttgaagaaggtgctgtgcatgggtgtagctgtgggaaacctcgacatggaggagaagcagatcttccaaaacgtgcaaatgagcgtcaacttcctcgtttctcttttgaaaaagattggcaaaacgtgaggtgcttgttcttgaagagcacgatggggaggcctcaacgtattttctaagcagtttataaacttttgttattga

SEQ ID NO: 15691 - DNA, 929 bp, Manihot esculenta
cgtctgctcagcttggtcatactacatcttttctctgccgataaatctctcccttgaggctcacaggagaggaacccgctgtatagcttccaacatgagtaagctccagagtgaggcattgagagaggccatctctactattatgactgcatccaaagagaagaagcggaacttcactgagacaattgagctccaaatcgggcttaaaaattatgatccccagaaggataagcgtttcagtggttcggtgaagctgccacatattcctcgacccaaaatgaaaatttgcatgcttggagatgctcagcatgttgaggaggcagagggaataggtcttcaatggatggatgtggaagcattgaagaaactaaacaaaaataagaaattggtcaagaaacttgccaagcagtatcatgcctttttggcctctgaatctgtcatcaagcagattcctcgtcttctgggtcctggtcttaacaaggcaggaaagttccccaccctcgtgacccaccaagagtccctggagtcaaaagtgaatgaaacaaaagcaacagtcaaattccaactgaagaaggtgctttgcatgggagtggctgttgggaactgtgctatggaggagaaacaagtcttccaaaatgtgcagatgagtgtcaatttcttggtgtctttgttgaaaaaaaactggcagaatgtgaagtgcctacacctcaagactaccatgggagcaccacaacgcgtcttttaagttctttagtttgaatttttcgaagctttgtaccagagttatttacaggagtattttcgcttgaatggtcaatttttctcattgtatggctgtctgttttgttctatggaatttgcgatttaatgatataattttagacttggcttatagcttcaattggagagttgtgaggaaaattgcatat

SEQ ID NO: 15692 - DNA, 737 bp, Hevea brasiliensis
cctgtaggatcctttcttgaaagcttccaatcatgagtaagctccagagtgaggcattgagagaggccatttctactattatgactgcatccaaagagaagaagcggaacttcactgagacaattgagctccaaattgggctcaagaattacgatccccagaaggataagcgtttcagtggctcggtgaagctgccacatattccccggcccaaaatgaaaatttgcatgcttggtgatgctcagcatgttgaggaggcagagggaataggtttgcagtggatggatgtggaagcattgaagaaactaaacaagaacaagaaattggtcaagaaactcgccaagcagtaccatgcgtttttggcttcagaatcagtcatcaagcagattcctcgtcttctgggccctggtctcaacaaggcagggaagttccctacccttgtcacccaccaagagtccctagagtctaaagtgaatgaaacaaaagcaacagtgaagttccagttgaagaaagtgctttgcatgggagtggctgttgggaactgtgctatggaggagaagcaggtgttccaaaatgtgcaaatgagtgtcaatttcctagtttctttgttgaagaaaaactggcagaatgttaagtgcctacacctcaagactaccatgggggcgccacaacgcatcttttaaggaggtctttagttttaattttgaagatgtgtaccagagatctaattaaagaag

SEQ ID NO: 15693 - DNA, 998 bp, Carpinus betulus
gggtttatcagccataccagtcttcccttgctatatatatactctcatctggccgccacaaaccttggatagcgtttctcttcagcagaagaaaatcttttagtgggtctgtggagtgaaagcagtttcaaagatgagtaagctttcaagtgataccttaaaagagtctatctccacaattatggctggatctaaggataagaaacgtaatttcactgagaccattgaactccagattggactgaaaaactatgatcctcagaaggataagcgtttcagtggttctgttaagttaccgcacatccctcgtcccaagatgaaagtgtgcatgcttggagatgctcaacatgttgaagaggcagagaagattggtttggattatatggatgttgaagcattgaaaaagcttaacaaaaacaagaaattggttaagaaactagctaagaaataccacgcctttttagcatcagaagctgtcatcaagcagatcccccgtcttttgggccctggcctcaacaaggcaggcaagttcccaactcttgttactcatcaagaatccatcgagtctaaagttaatgagactaaggctatggtaaagttccaactgaagaaggtgctttgcatgggagttgctgtgggcaatggtgctatggaggagaagcagatcttccaaaatgttcagatgagtgttaatttcctcgtttcattgttgaagaagaattggcagaatgtgaggagcttgtcattgaaaactacaatggggaagccagtccgcgtatactgagatcttttggaaagggaattttgtagtgagctcatgggagctatagtacttataagttctttctttgaatgtcaagttttcttctttgttgggctgtttttccttctgctcttctttgaatatgtagatgccatggtggtagacattgtttgttggagaggtgaacctaattttttcactttcacttgcgctataacatattgttgaatgtttt

SEQ ID NO: 15694 - DNA, 1071 bp, Sarracenia psittacina
tctccgtggagcagccatcgaaagcaaaaatcgtttaccatgagtaagctacaaagtgatgcagtcagggaggctatctcccaaattgctggagatgcaaaagaaaaaaagacgcaactttgtggagacaattgagctccaaattggtttgaagaattatgatccccagaaagataagcgttttagtggttctgtgaaactgccacacatccctcgtcctaagatgaaagtttgcatgcttggtgatgctcagcatgtagaagaggccgagaagataggcttggactatatggatgtggaaggactgaagaagcttaacaagaacaagaaactggtcaagaagcttgccaaaaagtatcatgcttttctagcatctgaagctgtcatcaagcagatccctcgtctcttgggccctggtctaaacaaagcaggaaagtttccaacattggtctctcatcaggaatcccttgagtcaaaagtgaatgaaacaaaagcaacagtgaagtttcaacttaagaaggttctgtgcatgggtgttgctgtgggtaactgtggtatggaggataagcagatattccagaatgttcaaatgagtgtaaactttcttgtttcactgctgaagaagaattggcaaaatgtgaggtgcttgtacttgaagagtaccatgggaaggccagtccgcatcttttaacaagttttgtatttgtggaaagctgtgtagcgaatccacagtttaaaagagccttcttgttttgtttttgtttgggtggttgaggaagaggaagattcactgagctttgtttttgtttttttcatcgattctggtatgaattgctcaaacttgaacttagtatacatccgtgttcttttttgatcaatattggctcatttttgatcaatattggttctttttgatcaatattggctctgttctggtattgattctggtatgaattgctcaaacttgaacttagtatacacgtgttcttacaacttatgattttttttctctcttattccagttataagctacagttttatcgaacattcacaacttctgttataaattct

SEQ ID NO: 15695 - DNA, 3320 bp, Manihot esculenta
atttaattcaacaaatcccttccaaaattaaacctcaaatgaatatccttttcttccttctgtttacgactgcgttctcttttctccggttcgtttgttcttctccggccgatcacagctacaatgtaggagatcctgtacctctattcgtcaacaaagttggtcccttgcacaatcccagtgaaacctaccgctactatgatttgccattctgtcgtccagataatgtaattcgaaagaaagaaacgcttggtgaggtgttgaatggggatcgtttgagtagtgctttgtatgacttgaaattcagggaggacaaaactggggttaccctttgtaagaagaagcttaaaggagatgaagttttgaggtttagagatgctattatcgatgatttctacttccaaatgtattatgatgatctcccgttatggggctttattgggaaagttgaagaacaaagttggattgttggtcagagagagtttaagtattatctgtttaaacacgttcagtttgatgttctttatcgtggcaatcgagtcattgaagtaagtgcttttagtgatccaaatcatgctgtggatataactgaagatgttgatatagatgttgagttcacttattcagttatctggaatgcgacctcagctccatttgagaccaggatggacaaatattcgagggcttcgtttcatccagtacaccagcagatccattggttctcatttgttaactcaatcatcatcattttgctcctgatgggattgctcactgggctttttatgcgacgtctcaggaatgatttgaaaaagtgttctggtggagatgaagaggaagataaagaggttggctggaaatacatccatagtgacgttttcagatacccacataacatatccttgttttctgctgtcttgggcacaggcactcaactgctgacaatggtttgctttttatttgttttggcatttgttggtgtgctatacccttacaatcgtggagccttgtgcacttctttcgtcttggtatatacactcacatctgtggttgggggttataccactgctgctttccacaatcagtttgctcaaactggatggaaaaggagtgttattttcactgggattctgttcctcggtccattgtttgtgatactatccattttgaatatcattgctgtatcttatgggaccacagccacacttccatttggaaccattatggtgatacttctcatacacgtattttttactgttccattgcttgccttgggagggcttcttggttactgtttcaggtctgtatttcaagccccttctgctacaaaaaggtacccaagggagattccgccattaggatggtacaggaaaacacctgctcaaatgtttcttgcaggaattttatgctgtagtgcaattatccttgagttacaccacttatatgcaagcttgtggggctataaaatatgcactctgcccagcattttgtttgtcactttcatcatccttatcttacttaccgcactcttaagtatcgttatgacatacattctgctctccgcagaggaccatcagtggtggtggagatctgtgttgtgtgggggtgcacctgccatttttatgttcagttatggtatctgcttctttgccaggtcaaatatgaggggcttcatgcagctatcatttttcttagggtataatgcttgcatttgctatgcatttttcttgatgctgggtacagtcagttttcgtgcttcattcatgtttgtttcccacatataccatgctgttaagagtgagtgaacaatttccttttaactttgtaatggcctgtcacttttccagtaaactccactcctcctcaaaggcttaagaagggagacgaggtggggtgggagaacacagagagagagagggagagagaggggaaggcaaaatttattaattcttcttgtaacatgtatggagtcttccaagacttgaggatattgaaagcaagagaggaaatctgtgtttgtagtattggaagatgtaaccaacgctataaaccacaaaaaattgctagcatgggaacccctcaaaagtttcctgcattttcctcagaaacaaacaactcagcagcagcaaaattgtctgcaagcgaacatggtaatgaagacagtatttgcggacgtgaaagattaaagaaacatcgacaagaggtggctggtcatgttgtgattccagagagttggggccatgaaaattttcttaaggattggattgattgttcttccttcgacaagttattagccccagatggaatttcatctgctcgccaatctcttgctgctcagggacgacagaaaccaacttccaattctcaacgtttcaggatagcaagtagtaagcttcagagtgaggcattgagagaggccatctctactattatgaatgcttctaaagagaagaagcgtaacttcactgagacaattgagctccaaattgggctcaagaattatgatccccagaaggataaacgtttcagtggctccgtgaagctgccacatatcccgcggcccaaaatgaaaatttgcatgcttggagatgctcagcatgttgaggaggcagagggaattggcctacaatggatggatgtggaagcgttgaagaagttgaacaaaaacaagaaattggtcaagaaacttgccaagcagtaccatgcctttttagcttcagaatctgtcatcaagcagattcctcgtcttctgggtcctggtctcaacaaggcaggtaagttccctaccctggtcacccaccaagagtctctggagtccaaggtgaatgagacaaaggcgacagtgaagttccaattgaagaaggtactttgcatgggagttgccgttggtaattgtgctatggaagagaagcaggttttccagaatgtccagatgagcgttaatttcctagtttctttgttgaagaagaattggcaaaatgttaagtgcctgcacctcaagactaccatggggacaccacaacgcgtcttttaaggagtacacttcagtttactatttggagttgtgtaccagagatctagaatttcttgatatttactggagtattgtgcttgaatggtcaattgccaaattggagagccgttttgttttgttctgttatgtttttgttgaaattgctagtaatgatataattttagacttctgtagagtttttattagagaggtgtgaacttaattttctttgatttgcagtaaaatgttaaacggttttatctcatatgacacatgctatttggtcccattttttgatggcacataagtt

SEQ ID NO: 15696 - DNA, 1180 bp, Eragrostis curvula
ttcggaaaattcacctcagaaaggagggccatcctccctcggtcgtcgccgaggccaaggagaagaacaggaagttcaccgagaccgtcgaactccagatcggcctcaagaactatgatccgcaaaaggacaagcgtttcagtggctctgttaagctgccccacatccctcgccctaagatgaaggtctgcatgcttggtgatgcgcagcatgtggaggaggcagagaaaatgggccttgattacatggacgttgaagctcttaagaagatgaacaagaacaagaagcttgttaagaagcttgccaagaaataccatgctttcttagcctccgaggcgattatcaagcagattccccgtctccttggtcctggtctcaactaggcaggcaagttcccgactttggttactcatcaggagtctctggaatcaaaggtaaacgagacaaaagctacagtcaagttccaactgaagaaggttctttgcatgggtgtcgctgtgggtaacctgtcgatggaatagaatcagatccaacagaacatccaaatgagcgtcaacttcctggtttctttgctgaagaaaaactggcaaagcgtgatgtgcctgtacatcaagagcaccatggggaagccaaacagggtgttctgaattgcctgtgtgaaccgataccgtattgttttctgggatatgtttatgcccttaatctatacaactgtaacgagaatttgtgtctgtgacctcgtgacattgaaaaaaaaacaagtaaacctgttttcttacaacattttttccctctaaaaaaaaaaaaaaaaaaaactaaaagtaactctgtgttgaacctctggctttattcttatttccgcgggcccccttgccggcccgggaacattgggacttttgaccctttttactctataatggacttatattaaaatttacggggccctctttttttatccgatttggaatggaaaatacctcgggtgatacccaactttaaacccttctcaccacatttcccccttcctcccttgtggcgaaacaaagcaaaaaagccccacccgactccctccttactcaaatattgtcctaactttaaatagataaatgaaaccaccccccctacaatgccccacatatctcccttccgggtgttgttgtgggtttatccactcactttc

SEQ ID NO: 15697 - DNA, 845 bp, Fagus grandifolia
tagctagggttccttctctgtcttctgggttttgtttgcaggtggaaaatctgttagtgggtctttggagaaaagagagtttcaaagatgagtaagcttcagagtgatactttaagagaggctatctccactctttttgtcgggtccaatgacaaaaagaggaatttcactgagactattgaactccagattggtttgaaaaactacgatccccagaaggataagcgtttcagtggttctgttaagttgccacacatccctcgcccaaagatgaaggtttgcatgcttggtgatgcacaacatgttgaagaggcagagaagatgggtttagattatatggatgttgaagcattgaagaagcttaaacaaaaacaagaaattggttaagaagcttgccaagaaataccatgcctttttggcatcagaatctgtcattaagcttatcccccgtcttttgggccctggcctcaacaaggcaggtaagttcccaaccctcgtcactcatcaagaatcaattgattctaaagttaatgagacaaaggctatggttaaattccaactgaagaaggtgctttgtatgggagttgctgttgggaatgttgccatggaagagaagcaggtcttccaaaatgttcaaatgagtgttaatttccttgtttcactcttgaagaagaactggcaaaatgtgaggagcttgtcgctgaagactaccatggggaagccagtgcgcgtatactaaaatcttttgtcaagggggttttgtaggcgagctgtaatacttataagtgtgctttgaatcgtcaaattttcttgttggttggctgttttaccattttcttttctct

SEQ ID NO: 15698 - DNA, 974 bp, Fagus grandifolia
agctgagcgcctcatttgctatatatatactctcatcttagccgccacaaaccctagctagggttccttctctgtcttctggtggaaaatctgttagtgggtctttggagaaaagagagtttcaaagatgagtaagcttcagagtgatactttaagagaggctatctccactctttttgtcgggtccaatgacaaaaagaggaatttcactgagactattgaactccagattggtttgaaaaactacgatccccagaaggataagcgtttcagtggttctgttaagttgccacacatccctcgcccaaagatgaaggtttgcatgcttggtgatgcacaacatgttgaagaggcagagaagatgggtttagattatatggatgttgaagcattgaagaagcttaaacaaaaacaagaaattggttaagaagcttgccaagaaataccatgcctttttggcatcagaatctgtcattaagcttatcccccgtcttttgggccctggcctcaacaaggcaggtaagttcccaaccctcgtcactcatcaagaatcaattgattctaaagttaatgagacaaaggctatggttaaattccaactgaagaaggtgctttgtatgggagttgctgttgggaatgttgccatggaagagaagcaggtcttccaaaatgttcaaatgagtgttaatttccttgtttcactcttgaagaagaactggcaaaatgtgaggagcttgtcgctgaagactaccatggggaagccagtgcgcgtatactaaaatcttttgtcaagggagttttgtaggcgagctgtaatacttataagtgtgctttgaatcgtcaaattttcttgttggttggctgttttaccattttcttttctctgaatgcgtagatgtcatggccctagacctctagacttgattttgaatttttgctggagagtagaaccaagttttcatcactcactataa

SEQ ID NO: 15699 - DNA, 1205 bp, Quercus alba
atagagcgagcgcctcacaccagtcattgctttgctatatatactctcattttagccgccacaaaccctagctagggttcccttctctttcttctggtacaaaatctgctagtgggtgtttggaaacaagagagtttcaaagatgagtaagcttcagagtgacactctaagagaggctatctccactctttttgctggatccagagataagaagagaaatttcactgagaccattgaactacagattggattgaaaaattatgatccccagaaagataagcgtttcagtggttctgttaaattgccacacatccctcgcccaaagatgaaggtttgcatgcttggtgatgctcagcatgttgaagaggctgagaagatgggtttagattatatggatgttgaagcattgaagaagcttaacaaaaacaagaaattggtcaagaaacttgccaaaaaataccatgcgtttttggcatcagaatctgtcattaagctgatcccccgtcttttgggccctggtctcaacaaggcaggaaagtttccaactcttgtcacacatcaagaatccattgattctaaagttaatgagacaaaggctatggttaagttccaactgaaaaaggtgctttgcatgggagttgcagtgggcaacgttgctatggaagagaagcaggtcttccaaaatgttcaaatgagtgttaatttcctcgtttcactgttgaagaagaactggcaaaatgtgaggagcttgtcgctgaagactaccatggggaggccagtgcgcgtatactaaaatcttttggcaagggaattttgtaggcgagctgtaattcttataagggtgctttgaatggtcaagttttcttgttggttggctattttacctttttactgttctctgaattcttagatgtcatggccctagaattgttttggaatgtttgttcgagggttgaaccaagttttcattttcacttgccctataatacattgatgaatattaggtcttatatatgttgccgtccagctggagtgaaattgatggtaaaatttaattatgtggatgataaattgctctcattatgtacttgaagtctggcaggctgtgaaaatgtggactagaattaatgcagttcaattagcccttaaatttcttgttttctcgaacagtaatggctgtttggattgaggtgtgaggggagagt

SEQ ID NO: 15700 - DNA, 903 bp, Carpinus betulus
atcgcgagcctccgaagcctcactctaagagcagccattggagaagcgcctgaaacgacaaagctctacccatgagtaagcttcagagcgaaacgcttagggaggtgatctcccaggtgttgaacgccgcgaaggagaagaatcgtaagttcacggagaccgtggagcttcaaatcgggttgaagaactacgatccccagaaggacaagcgtttcagtggctccgtgaaactccctcacattcctcgccctaagatgaaggtctgcatgctcggtgacgctcagcacgtcgaagaggcggagaagataggattggagtatatggatgtggaggctctgaaaaaacttaacaagaacaagaagctggtcaagaagctggccaagaagtaccatgcctttttagcatctgaatccgtcattaagcagattcctcgtcttttgggccctggtcttaacaaggcaggtaagtttcccacactggtgactcatcaggaaaccctggagtcgaaggttattgaagtaaaagcaatggtgaagtttcaacttaagaaggttctttgtatgggcgttgctgtggggaattgcagtatggaggaaaagcagctcttccagaacgtgcaaatgagtatcaacttccttgtttcattgttgaagaaaaattggcaaaatgtgaggtgcttgcatctgaagagtaccatgggatcggcaatcaggctctattgagttcgtttctctgtttacaagatgtcaaaatgttttatgaatgttttgtaagcaagacatcgttgaggaatgctgttatggctttttggttctcctttttggattctttggcttcgaagtttagttaatgctgataatgttgttttaagttgatttttattggtggttgattaaagaaaat

SEQ ID NO: 15701 - DNA, 905 bp, Euphorbia peplus
gcttcagagtgaagcattgagggaggcaattacaactatcatgactgcttcaaaggagaagaagcggaattttactgagacaattgagctccagattgggcttaagaactacgatccccaaaaggataagcgtttcagtggctctgtgaaattgcctcacattcctcgccctaagatgaaggtttgcatgctcggagatgctcagcatgttgaggaggctacagcaattggcctccaatggatggatgttgaggctctcaagaagctcaacaagaacaagaagcttgtgaagaaactcgccaagcagtaccatgcctttttggcttctgaatctgtcatcaagcagattccccgtcttcttggccctggtctgaacaaggcaggtaagttcccaactcttgttacccatcaagagtccttggagtctaaagtcaacgagacaaaagccacagttaagtttcagttgaagaaggtgctatgcatgggtgttgctgtcggaaactgcgccatggaggagaagcaagttttccaaaacgttcaaatgagtgtgaacttccttgtctctctactcaagaagaactggcaaaatgtgaagtgccttaacctgaagactacaatgggttccccacaacgtgtcttttaaggagttagcttttgaattgcagttgaacttgagagacagtttcttgataactatagaaaaatttatttaatgcctcagtctttcaatttggacggctgttttgttttgttttgttgtgatgaaaccagtaggcacactgtaatgttagtttttttgagagatgaacttggtttaccatgtttgccgtaatgtttattttcttactagttgtcatctgttatatgtttgtctaagctgtttgtagcagataatctaagcaatt

SEQ ID NO: 15702 - DNA, 918 bp, Jatropha curcas
cggcgctctaaacatggatccccgggctgaggaattcgaattccacttgcttgttgcggtaatccgtaaaacctgttagagcgtttcttggaacctgccaataatgagtaagcttcagagtgagacattgagagaggctatctctactattatggctgcttctgtggagaagaagcgtaactttactgagacaattgagctccagattggactgaagaactatgatcctcaaaaggataagcgtttcagtggctctgtgaagttgcctcacatccctcgtcctaagatgaagatttgcatgcttggagatgctcagcatgttgaggaggctgaggcaataggactacaatggatggatgtggaagcattgaagaagctaaacaagaacaaaaaattggttaagaaacttgcaaagcagtaccatgccttcttggcttcagaatctgtcatcaagcagattcctcgtcttctgggccctggtctgaacaaggcaggtaaatttcctacccttgtgacccatcaggagtccctagagtctaaagtgaatgaaacaaaggcaacagtgaaattccaattaaagaaagtgctctgcatgggagttgctgttggcaactgtgctatggaggagaagcaagtcttccaaaatgtgcaaatgagcgtcaattttcttgtttccttgttgaagaagaactggcaaaatgtgaagtgcctaaacgtcaagactacaatgggtaacccagttcgcatcttttaaaggagcagcttatttggagttttgagatttttacgagatgtagcattccagttacctgtagaagtgtcttactttaaagatcacattttcttcttggattgttgttatttttgttttgttggaattgctagtaaaattgaaatgcttgattatagttttttatc

SEQ ID NO: 15703 - DNA, 912 bp, Citrullus lanatus
gtaaaaaaaccctagcttcacgtcttctcccaagtctgtagcttctccttaggaaagacaaagctttgaaaatgagcaaacttcagagcgatgctttgagagaagctatttcatctatcttcgctgatacaagtgaaaagaagcgcaactttactgagaccattgaacttcagattggactgaagaactatgatccacaaaaggacaagcgtttcagtggatcagtgaaattgccccatattcctcgccctaagatgaagatttgcatgcttggagatgcctctcatgttgaagaggcagagaacggtttggattatatggacgttgaaggtttgaagaagctaaacaaaaactagaagttaatgaagaaacttgccaagaagtatcatgcctttttagcatctgaagctattattaagcaaattccccgtcttctgggccctgggctcaacaaagggcccaacaaggcaggaaagttccctaccctggtcactcaccaagaatctctcgaatctaaagtaaatgagactaagtcaatggttaagtcccaattgaagaaggttctttgtatgggtgtggccataggcaatgttgccatggaagagaaacaagttttctagaacgttcaaatgggtgtcaatttccttgtttccttgttgaaaaagaattggcaaaacgtgaggtgcttgtacctgaagagtacaatggggaaggcatatcgagtctctgaggaattttcataacttagatagtattgtttgttcttaaattgaagaaggaccaagttgagatgaaattctatatttatgattgatgaaaaatttcctgcttgtttttttgtttagtaaaaaccattagctgcacaatcgttaacacttgtgatgggagtaatgtgtttaaaacacactatta

SEQ ID NO: 15704 - DNA, 801 bp, Citrus sinensis
atgcttcggagaagagaaagagaaacaagtagacgacccctattgtttcagcggaagaaactcaagaaaggaactactacacgttttaattgggtcgggggaaatacaaaagacaagagtgagattgagaatagtaaactatcgagtgaggtgctgagagaggcggtctccactatctgtggggacgcaaaagaaaaaaaccgcaactttgttgaaaccattgagcttcaaattgggttgaagaattatgatcctcaaaaggacaagcgcttcagtgggtctgttaaacttccccacattcctcgtcctatgatgaaagtgtgcatgcttggtgatgcccagcatgttgaacaggctgagaaaatcggtatggactacatggatgtggaagcactcaagaagcttaacaagaacaaaaaacttgttaagaagctggccaagaaatatcatgccttcttagcatctgaagctgtcatcaagcagattcctcgtcttttggggcctggtctcaacaaggcaggcaaggaagttcccaacactggtgactcatcaagagtccctggaagcaaaagttaatgaaacaaaagctgtggtgaagtttcaacttaagaaagttctctgtatgggtgttgctgtgggtaattgcagtatggaggagaagcaggttttccagaatgtgcagctcagtgttaatttccttgtttcattactgaagaaaagttggcaaaatgtaagatgtttgcacctgaagagtaccatggggagaccacaacgcatctactaaagatcattggcttccca

SEQ ID NO: 15705 - DNA, 630 bp, Adiantum capillus-veneris
gtcgcgggagcaagacgaagcagcatgagcaagcttcagagtgatgtgctgagagaagccatcacacagctcgtatcagagtctaaggaaaagaagaggaagtttgtggagacagttgagcttcagattgggctgaagaactatgatccccaaaaggacaagcgctttagtgggtcagttaagcttgcacacatccctcgccccaagatgaaagtgtgcatgttaggagatgcccagcacgtggaagaggcggaaaaaattggccttgattgcatggatgtggatgctttgaagaaaatgaacaagaataagaagctcgtgaagaagcttgcgaagaagtatcatgccttcttggcctctgaagctgtcataaagcagattcctcgccttctgggtcctggtttgaacaaggcggggaagtttcctactcttgtctctcaccaagagtcgctggaggggaaattgaatgagacaaaggctacagttaagtttcagctgaagaaggtgctatgcatgggggttgctgtgggaaaccttgaaatggaggagaagcagctttttcagaatgtgcagctgagtgtgaactttctcgtctcgcttttgaagaagaactggcaaaacgtgagagtc

SEQ ID NO: 15706 - DNA, 759 bp, Zingiber officinale
agaagaagcgcaacttcactgaaacaattgagttacaaattggtttgaaaaattatgatcctcaaaaggataagcgattcagtcgctcagtgaagcttccgcatattccacgccctaaaatgaaagtttgcatgttgggtgacgcacaacatattgaggaggcagagaagataggacttgattacatggatgttgaaagtttgaaaaagatgaacaaaaataagaagcttgtgaagaagcttgctaagaagtaccatgctttccttgcatcagaagctatcattaagcagattcctcgtcttcttggtcctggtcttaataaggcagggaagtttcccacattggtttctcaccaagagactttggagtctaaagtcaatgagacgaaggcaatggtgaaattccaactcaagaaggtcctttgcatgggtgtcgctgtcggcaatgttgccatggaggaaaagcagatttttcagaacgtgcaaatgagcgtgaatttactcgtgtcgttgttgaagaagaactggcaaaatgtccgatgcttgtatctgaagagcacaatggggaaaccctatcgcatcttctaactcttcgtatgcccgagttcgagcttgccgtctcaagatcggactttttagctgaatgtttttcggatatcaatcagtataaaagaacagaagctatcttacagttagtcatttgtttgatcagtctgaaagaacagaaaattcagttatattaatcagtaatatatatatt

SEQ ID NO: 15707 - DNA, 721 bp, Thalictrum flavum
caatcacccaagttactggagaagccaaagagaaaaagcgaaagtttactgagacagttgagctccagattgggcttaagaactatgatcctcaaaaagataagcgtttcagtggttctgtgaagctgccacacattccgcgtcctaagatgaagatttgcatgcttggagatgctcagcatgttgaagaggcagagaaaataggtttggagtatatggatgtagaagggctaaagaaactgaacaaaaacaagaaacttgtgaaaaagctagcaaaaaaataccatgcttttctagcatcagaagctgtcattaagcagattcctcgtcttcttggccctggtcttaacaaggcaggaaaattcccaactcttgtgactcatcaggaatcattggaatcaaaagttaatgaatccaaggctatggtgaagtttcaacttaagaaggttctttgcatgggggttgctgtgggtaatctcggaatggatgagaagcagatcttccaaaatgttcaactcagtgtcaactttcttgtctcattgttgaaaaagaactggcagaatgtgaggtgcttgtacctgaagagctcaatggggaagccattccgtatcttctaaaacattgtaattttgttagattgagtacactttgtaccaaggtagtgagcaggattagaaacttgttttggaaatgctcagatttgtcgtggttgtactattga

SEQ ID NO: 15708 - DNA, 877 bp, Euphorbia peplus
gttgagggaggctattactactatcatgactgcttcaaaggagaagaagcggaatttcactgagacaattgagctccagattgggcttaagaactacgatccccaaaaggataagcgtttcagtggctctgtcaaattgcctcacatccctcgccctaagatgaaggtttgcatgcttggagatgctcagcatgttgaggaggctacagcaattggccttcaatggatggatgttgaggctctcaagaagctcaacaagaacaagaagcttgtgaagaaactcgccaagcagtaccatgcctttttggcttctgaatctgtcatcaagcagattccccgtcttctgggacctggtctgaacaaggcaggtaagttccctactcttgtgacccaccaagagtccttggagtcgaaggtcaacgagacgaaagcaacagttaagtttcagttgaagaaggtgctttgcatgggtgttgctgtcggaaactgcgccatggaagagaagcaagttttccagaatgttcaaatgagcgtgaacttccttgtctccttacttaagaagaattggcaaaacgtgaagtgcctaaacctgaagactacgatgggttctccacaacgcgtcttttaaggagttagcttttgaactgcagtcgaacttgagagacagtttcttgataattatagaattttttattttatgctcgatctttcaatttggacggctgttttgttttgttgtgatgaaaccagtagttacattgtaatgctagtttttttgagagatgaacttgatttaccttgtttgcatgattaatttttagctctgcatctgtaacatgtttgtctatgtggtttgttgcagataactgaagcaatt

SEQ ID NO: 15709 - DNA, 779 bp, Ambrosia trifida
cccggtagtagtctaacgcgtaagaggttaactccggggggccggtcccggttctttcctatacttgacgtcttaggtgttttggtaagtaaagagactaactaaaaatacgagtaaacttacagaagcgaagcccttagggaagccattactcagatcaccaccaatgctgtagaaaagaaacgtaacttcaccgagaccattgagcttcagatcgggctcaagaactacgacccacaaaaggacaagcgttttagcggtactgttaagttgcctcacattcctcgtcccaaattgaaggtttgcatgcttggagatgcccagcatgtggaagaggctcaaaagattggtcttgaatacatggatgttgaaggactcaagaagcttaacaagaacaagaagctggtgaagaagctagccaagaagcaccaagcttttttggcttccgaatccgttatcaagcaaattcctcgtttgttgggccctggtctaaacaaggcaggaaagttcccaacacttgttagtcaccaggaatctctcgaggctaaggtgaatgaaaccaaagcaacggttaagtttcaactgaaaaaggtgctgtgcatgggagttgctgtcggcaactgcagcatggaggagaaacagattttccaaaacgtgcagatgagcgttaatttcctcgtttcattgttgaagaagaactggcaaaatgtgagatgtttgtacttgaagacaacgatgggaaagccgattcgcatcttttagatattgtgtttgttttt

SEQ ID NO: 15710 - DNA, 902 bp, Ambrosia trifida
tctcagggttcttaccgaagaagtgaagctaacgagaacagacatatcccaaaatgagtaagctacagagtgaagctttgagagaggcaattacacagaatcacaactagatagctaaagaaaagaaacgtaaatttcactgaaaccattgagctacaaattggtttgaagaattatgatccacaaaaggataagcgtttcagtggtacagtgaagttgcctcacattcctcgccctaagttgaaagtttgcatgcttggtgatgcccaacatgttgaagaggcccaaaaaattggacttgagtatatggatgttgagagtttgaagaagctgaacaagaataagaagttggtgaagaaacttgctaaaaaacaccaagctttcttggcttctgagtctgtcatcaagcagattccccgtttgttgggtcctggtctaaacaaagctggtaagttccctacacttgttagtcatcaggaatccctagaggcaaaagtgaatgagacgaaagcaacagtcaagttccaactgaagaaggtgctctgcatgggagtggctgttggaaactgcagcatggaggagaagcaaattttccaaaacgtccaaatgagtgtcaatttcttagtttctttgctaaagaagaattggcaaaatgtgcgatgcttatacttgaagacaacaatggggaaacgccggtcgcattacgtttaaggaagtagtttatttgtttgtattgtttttcgtttaggttaattggttaagtctagttgttaggaaagtattattctctatagaacacaagtaacttttagtttttttttgactttactatttgtttttgtttcttgtagtactaactaaactaaattcttaatttacgttacggaattaaacttaaaact

SEQ ID NO: 15711 - DNA, 1105 bp, Eragrostis curvula
aaggggaatctccggctctcgcatcgatgaagaacgtagcaaaatgcgatacctggtgtgaattgcagaatcccgcgaaccatcgagtttttgaacgtaagttgcaaaccgaggtcctcaaggatggcatcgccaatgtcgttaaggatgccaaggagaagaacaggaagttcaccgagacaattgagctacagattggtctgaagaactatgacccgcagaaggacaagcgtttcagcggctctgttaagctgccccatatcccccgcccgaagatgaaggtgtgcatgcttggtgatgcccagcatgtggaggaggctgagaagatggggcttgactacatggatgttgaatctcttaagaaaatgaacaagaacaagaagcttgttaagaagcttgccaagaagtaccacgctttcttggcatctgaggcgatcatcaagcagattccccgtctccttggtcctggtctcaacaaggcaggcaagttcccgacactggttagtcaccaggagtctcttgaatccaaggtcaatgagacaaaagccacggtcaagttccagctgaagaaggttctttgcatgggtgttgctgtgggcaacttgtcaatggaggagaagcagatccagcagaacatccaaatgagcgttaacttccttgtgtcccttctgaagaagaactggcagaatgtgaggtgcctgtacatcaagagcaccatggggaaaccgtacaggttgttctaagttactgtgctccctgtgaagttgataagataccgggccattgaaccgagcttgtcttaaaacctaggtctgttgaaccttacagttttgtggttgtccaggggaatacaaagaagtatttggtcctttatctagtgctttctttaatagaacttgtggaggaatgctcttcggattatgtaattgcagtttgttatggttcaatcttactgctccatgcgtcaatcccggaaaaaaaaaaaaaaaaaaaaaaaaaaatagactctggttttatccctgggttaaccaattcccgggggccccggggggcgcgggaactgggaacgcggggccattccccctaaaggggccaattaaatccc

SEQ ID NO: 15712 - DNA, 800 bp, Citrus clementina
atgcttcggagaagagaaagagaaacaagtagacgacccctattgtttcagcggaagaaactcaagaaaggaactactacacgttttaattgggtcgggggaaatacaaaagacaagagtgagattgagaatagtaaactatcgagtgaggtgctgagagaggcggtctccactatctgtggggacgcaaaagaaaaaaaccgcaactttgttgaaaccattgagcttcaaattgggttgaagaattatgatcctcaaaaggacaagcgcttcagtgggtctgttaaacttccccacattcctcgtcctatgatgaaagtgtgcatgcttggtgatgcccagcatgttgaacaggctgagaaaatcggtatggactacatggatgtggaagcactcaagaagcttaacaagaacaaaaaacttgttaagaagctggccaagaaatatcatgccttcttagcatctgaagctgtcatcaagcagattcctcgtcttttggggcctggctcaacaaggcaggcaaggaagttcccaacactggtgactcatcaagagtccctggaagcaaaagttaatgaaacaaaagccgtggtgaagtttcaacttaagaaagttctctgtatgggtgttgctgtgggtaattgcagtatggaggagaagcaggttttccagaatgtgcagctcagtgttaatttccatgtttcattactgaagaaaaattggcaaaatgtaagatgtttgcacctgaagagtaccatggggagaccacaacgcatctgctaaagatcattggcttccca

SEQ ID NO: 15713 - DNA, 867 bp, Ambrosia trifida
cacttccaaaccctagtttcagggttctcactaaaggttgaagctaacaataagacaagttactgaaaatgagtaagcttcaaagtgaagcccttagagaggcaattactcagatcactactgatgcgaaggaaaagaaacgtaactttactgaaaccattgagcttcagattggtttgaagaattacgatccacaaaaggacaaacgtttcagtggtaccgtgaaattgcctcacattcctcgccccaagcttaaagtttgcatgcttggagatgctcaacatgttgaagaggctcaaaaaattggccttgaatacatggatgtcgagagtttgaagaagttgaacaagaacaagaagttggtgaagaaacttgctaagaaacatcaagctttcttggcttctgagtctgtcatcaagcagattccgcgtttgttgggccccggtcttaacaaagcaggtaagttccctactcttgtttcccatcaagaatctctagaggcgaaggtcaacgagacaaaagcgacagtcaagtttcaacttaagaaggtgctctgcatgggagttgccgttggaaactgcagcatggaagaaaagcaaatcttccagaatgttcaaatgagtgtcaacttcttggtttctttacttaagaagaattggcaaatgtgcggtgcttgtacttgaagacaacaatgggaagccggttcgcatcttttaaagagtttattgttatgttttcatttcatttcgggttaatgttgaggtcagtactggaaaacatatttcccatgaacagggaatggtcctttttggctttttacatgtttgtttggtactatagctttggactccttcggttatatcattg

SEQ ID NO: 15714 - DNA, 731 bp, Brassica rapa
caaagccacgcaagttcactgagaccatcgaactccagattggtctcaagaactacgaccctcaaaaggacaagcggttcagcggttccgtcaagttgcctcacattccaaggcctaagatgaagatctgcatgctcggtgatgcccagcacgttgaagaggctgagaagattgggttggagtctatggatgtggaagcgcttaagaagctgaacaagaacaagaagcttgtgaagaagctagcaaagaagtttcacgctttccttgcttctgaatctgttattaaacagattcctcgtcttcttggtcctggtctcaacaaggcaggaaagttccctactcttgtgagccaccaagagtctttggaagccaaagtgaatgagactaaggcaacagtgaagttccagctcaagaaggttctttgcatgggagttgctgttgggaaccttgacatggaagagaagcagatctttcagaatgttcagatgagtgtcaacttccttgtttcgcttctgaagaaaaactggcaaaacgtgaggtgtttgtacttgaagagtacaatgggtccaccaaaccgtgtgttctaagaagattatctcgaagtttcgcttaagatatcatctttaaggctgagagagatttgattttcatttctgttgtgagccttctacttcttggattaatttcagaatcctttttttggtaggttcaagattttctttataaagaca

SEQ ID NO: 15715 - DNA, 652 bp, Picea glauca
aaattcacagagacaatagagttacagatcgggctgaagaactatgacccccaaaaggacaagcgtttcagtgggtccgtaaaattgccccacattcccgcccaagatgaaggtctgcatgctcggagatgcccaacacattgaagaggctgagaagatcagtcttgactacatggatgttgagggtctgaagaaaatgaacaagaataagaaacttgttaagaagctcgcaaagaagtaccatgcatttcttgcttcggaagcaattattaaacaaattccaagactccttggacctggtcttaacaaggctggtaaatttcccactcttgtttcacaccaagagtccttggagtccaaggtgaacgaaacaaaagcaacggttaagtttcagttgaaaaaagttctatgtatgggggttgctgtggggaactgtggaatggaggagaaacaggtgtttcagaatgtgcaattgagtgttaacttccttgtatcactactgaagaagaactggcagaatgtaaggtgcttatatttgaagactaccatgggaaagcctaaccgcattttctgagtgcggaacagagtggagatatttcaatggcacttccttttgtatactattaaacataggttatgttatttagtttcg

SEQ ID NO: 15716 - DNA, 623 bp, Saccharum officinarum
ttccccataaagtgtcgccgcggtaccgccgggacgtgaattggtgcggacgacccacgcgtgcgcgcgcccagagcccccaaaattttctcctctagcagccatggacgccagcggagccggtggcaaggcgaagaagggtgcggccgggcgcaaggctggcggcccccggaagaagtcggtgtcgcggtccgtcaaggccgggctgcagttccccgtcggccgtatcgggcgctacctcaagaagggccggtacgcgcagcgcgtgggcacgggcgcccccgtctacctcgccgccgtcctggagtacctcgccgccgaggtgctggagctggccgggaacgcggcgagggacaacaagaagacgcgcatcatcccccgccacgtgctcctggccatccgcaacgacgaggagctcgggaagctgctggccggcgtcaccatcgcgcacggtggcgtcctccctcaacccggtgctcctgcccaagaaggtggccgagaaggcggccaaagtccccaaagaaggccgccaagtcccccaagaaggcttagaaagtaggggctccattagcactgtgttgtaacttgtcgtgtttagatctggatgtgttctggtctacttt

SEQ ID NO: 15717 - DNA, 676 bp, Saccharum officinarum
ataccccgccgaccttgcgtccggacacagattgcctctcaactctcgatctctctctcgatttcgaagcgcagcagcagcagcagcaaccgccggccatggacgtgagcggagccggagccggcgggaaggcgaagaagggcgcggcggggcgcaaggccggcgggccgaggaagaagtcggtgtcgcggtccgtcaaggccgggctgcagttccccgtcggccgcatcgggcggtacctcaagaagggccggtacgcgcagcgcgtcggcacgggcgcccccgtctacctcgccgccgtcctcgagtacctcgccgccgaggtgctcgagctcgccggcaacgcggccagggacaacaagaagacgcgcatcatcccgcgccacgtgctcctggctatccgcaacgacgaggagctcggcaagctgctggccggcgtcaccatcgcccacggcggcgtcctccctccactctgtgctcctccccaagaaggtggccgagaaggcggccaaagtcgcccaagaaggccgccaagtcccccaagaaggcctagagtgctctcgtctcttagaggacaagggaggctcctctgctgtcctgttagattagatcatgtttagtgtacctctgtaacgttcttgttcttgctgctaattggaatggtttatctagtact

SEQ ID NO: 15718 - DNA, 1641 bp, Saccharum officinarum
gggttcagttctatatccatggggagtacaccaagtctcacagaggctacacgccagaccttgtggtttcgcacccgggggaactctcctgcagaggaagcctgtgtcaagaaatcagaatttgtttgacgacagctccctcatcctcattgtctacagcatagagaatcaagacaaggcaaaaccaagatcaagggatggcatcagtactggtcgtagccaagctgatgctcaggctctggcctgtgcctctggtggcaaagttgtgagcagcgcatggatcattgactccatagcagcttgcaaccttcaacctctttaaagttaagggagccttccatgctgccctaaatgtgtgcttgcatgcacagtagattgagtaacagacggacagaaaatagtgtaagtatcagtacactaggacagtaaggcctaggccttaggctgctccttcagtccttctagacctcctaggatgctcgcttcaagcggacatttgtatgtttaggcctcgtttagttcagagaattggtgagaaaaatactgtatcagaattcctgtagcatttcgtttgtatttggtaaaaattatctaaattttaactaactaggcttaaaatgttcgttttgcaaagtacaacaaaactgtacaattagtttttgatttcatcaacatttagtactccatgcatttgacgacattttgatgtgacgggaaattttcttttttatagtggaattttgggagaactggggaactaaacaagggcccacatacagacacagattgccactcaactctcaatctctctcccgatctcgagccatggacgtgagcggagccggagccggcgggaaggcgaagaagggcgcggcggggcgcaaggccggcgggccgaggaagaagtcggtgtcgcggtccgtcaaggccgggctgcagttccccgtcggccgcatcgggcggtacctcaagaagggccggtacgcgcagcgcgtcggcacgggcgcccccgtctacctcgccgccgtcctcgagtacctcgccgccgaggtgctcgagctcgccggcaacgcggccagggacaacaagaagacgcgcatcatcccgcgccacgtgctcctggctatccgcaacgacgaggagctcggcaagctgctggccggcgtcaccatcgcccacggcggcgtcctccctccactctgtgctcctccccaagaaggtggccgagaaggcggccaaagtcgcccaagaaggccgccaagtcccccaagaaggcgtagagtgctctcgtctcttgaggagaagggaggctcctccattagtgctgtcctgttagattagatcatgtttagtgtacctctgtaacgttcttgttcttgctgctaattggaatggtttatctagtactagtacatctgtgcattttcgttggttgcaacaagatttcagaaaccagagtttgctacttgcaaaaagtgtgctcaacttctcatagaacctggatttggtaagtgggtcatatagtcataactgaaccgatagaagaaactagatacagtggtatgccagagaccagttgctcctaatggattgtatctctatggaaaaaaaatgtacatgcagcatgcacaaaagaagcag

SEQ ID NO: 15719 - DNA, 828 bp, Saccharum officinarum
cacgctttcctccctcgtatccacggcatctcgccatggacgtgagcggagcgggagccggcgggaaggcgaagaagggcgcgggcgggcggaaggccggcggcgggccgaggaagaagtcggtgacgcggtccgtcaaggccgggctgcagttccccgtcggccgcatcgggcggtacctgaagaaggggcggtacgcgcagcgcgtgggcacgggcgcccccgtgtacctcgccgccgtcctcgagtacctggccgccgaggtgctggagctggccgggaacgcggccagggacaacaagaagacccgcatcatcccgcgccacgtgctcctggccatccgcaacgacgaggagctcggcaagctgctggccggcgtcaccatcgcccacggtggcgtcctccctcaaccccgtgctcctgcccaagaaggtcgccgagaaggccgcggaagtcgcccaagaaggccgccaagtcccccaagaaggcatagggaggccgccattagcgctgtcatgttgaatgctcatgttcagtagatccgtagatggcacggtctctgcgttgtactgtttagtagatctgtctgcattttggttggaaggagatttcagggatcagagttttacttgcaaaatgttctttgatttcagaaatcagattggcaatttgggcacgtttaatagaagaacataattaaataataaaagggcggccgctctaaagaacaagctactacgcatgctgcaactcatagttttaataggaactaattaattattggcgtgttaacacgaatatcggaaacctgacgtaccaataaatgct

SEQ ID NO: 15720 - DNA, 558 bp, Saccharum officinarum
aatctccagagccctttctcgccatggactccaccggcgccggagcgggagggaaggtgaagaagggagcgggcgggcgcaaggccggcgggccgaggaagaagtcggtgtcgaggtccgtgaaggccggactccagttccccgtcggccgcatcgggcgctacctgaagaagggccggtacgcgcagcgcgtcggcaccggcgcccccgtctacctcgccgccgtcctcgagtacctcgccgctgaggttctggagctcgccgggaacgcagccagggacaacaagaagacccgcatcatcccccgccacgtgctgcttgcgatccgcaacgacgaggagcttgggaagctgctggccggcgtgaccatcgcccacggtggcgtgctgcctccactcagttctgctgcccaagaagacggcagagaaggcgtccaaagtcgcccaagaaggctgccaagtcccccaagaaggcatagagtgtcgaggatgatttgatgttaagcgtcgtattcctgtgatgtgtaggttaatggatgtgcttggagattaaccggtc

SEQ ID NO: 15721 - DNA, 556 bp, Saccharum officinarum
aatctccagagcccttctcgccatggactccaccggcgccggagcgggagggaaggtgaagaagggagcgggcgggcgcaaggcaggcgggccgaggaagaagtcggtgtcgaggtccgtgaaggccgggctccagttccccgtcggccgcatcgggcgctacctgaagaagggccgctacgcgcagcgcgtcggcaccggggcccccgtctacctcgccgccgtcctcgagtacctcgccgctgaggttctggagctcgccgggaacgctgccagggacaacaagaagacgcgcatcatcccccgccacgtgctgcttgcgatccgcaacgacgaggagctcgggaagcttctggccggcgtgaccatcgcccacggcggcgtgctgcctccactcggttctgctgcccaagaagacggcggagaaggcgtccaaagtcgcccaagaaagccgccaagtcccccaagaaggcatagagtgtcgaggcagatctgatgtttagcgtcgtattcctgtgatgtgtaggctaatggatgtgcttgagattaaccggtc

SEQ ID NO: 15722 - DNA, 539 bp, Saccharum officinarum
atctcccaagacctactctgaccgccatggattccaccggcgctggagcgggagggaaggtgaagaagggagcgggcgggcgcaaggccggcgggccgaggaagaagtcggtgtcgaggtccgtgaaggccgggctccagttccccgtcggccgcatcggtcgctacctcaagaagggccgctacgcccagcgcgtcggcaccggcgcccccgtctacctcgccgccgtcctcgagtacctcgccgctgaggttctagagctcgccgggaacgctgccagggacaacaagaagacgcgcatcatcccacgccacgtgctgctcgcgatccgcaacgacgaggagctcggtaagctgctggccggcgtgaccatcgcccacggcggtgtgctgcctcaacccggttctgctgcccaagaagacggcggagaaggcgtccaaagtcgcccaagaaggccgccaagtcccccaagaaagcatagactgtccagcctgatccaatgtttagcactaccttgtaccagtgatgcgtagggtgaa

SEQ ID NO: 15723 - DNA, 679 bp, Gossypium hirsutum
gtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggcggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcctgctctagtatcgtccttgtgtcttattgtatgttcgtcttcatcgagaagatcttcagcagtcagagctcgttgtgt

SEQ ID NO: 15724 - DNA, 738 bp, Lotus japonicus
accaaacacattttcattttccctctcttcattccttcgccctcttcaatcgtcccgcgcaagcttctctgagaatctagggtttcggcaatggactccaccgccacaggaaaggtcaagaagggcgccgccggaaggaaagccggaggccccaagaagaagtcagtttccagatcggtgaaggccggtctccaattccccgtcggaagaatcggacgctacctgaagaagggaaggtacgctcagcgtgttggatctggtgctcctgtgtaccttgctgctgttcttgagtatctcgctgctgaggtgcttgagttggctggaaatgctgctcgtgacaacaagaagaacaggattatcccgaggcacgttcttcttgctgtgaggaacgatgaggagcttgggaaattgcttgctggtgtgaccattgctcatggtggtgttcttcccaacatcaaccctgtgcttctgcctaagaagactgctgagaaagctcctaaggaacctaagtctccagcgaagaaggctgcaaaatctcccaagaaagctgctgcttaggttgaattagggtagataatattgggttaaatttcagttttagcttattaccccttttgtttcttctgtatatcgatggttagaagaaaaaaaaatgatcgatgcttttggtttattgtatcacagtgttgctttaaccagtttcactcatcaatgaaaccatcttgttttttggttata

SEQ ID NO: 15725 - DNA, 564 bp, Festuca arundinacea
ggcacgaggctcaaaacaaatctgagcactcttctccgaagcatagcccaccagcttgccatggacgtctcaagcacagcagccggcggcaaggccaagaagggagcggccgggcgcaaggccggcggtcccaggaagaagtccgtgactaggtccgtcaaggccgggctccagttccccgtcggccgcgtcgggcgctacctcaagaagggccggtacgcgccgcgcgtcggcaccggcgcccccgtatacctcgccgccgtcctcgagtacctcgcggccgaggtgctggagctcgccgggaacgccgccaaggacaacaagaagtcgcgcatcatcccgcgccacctgctgctcgccgtgaggaacgacgaggagctcggcaagctgctcgccggcgtcaccatcgcgcacggcggcgtgctgcccaagatcaaccccgtgctgctccccaagaagacggccgacaaggcggccaaggagcccaagtcgccgaagaagacagccaagtcccccaagaaggcgtagagaccatttgcattgcataggttggagtagctggga

SEQ ID NO: 15726 - DNA, 745 bp, Lotus japonicus
ggacgttcgcaatcatctgagtctcacacctgcaatttctcacatcgcgtcaaagtcacgcgcaaccaggaatctagggttcgaacctcgccaatcgccatggacaccggaggaaaatcgaagaaaggtgccggaggaagaaaagctggtggcccaaagaagaagccagtttcgagatcggtgaaggctggtctccaattccccgtcggaagaatcggacggtacttgaagaaaggaaggtatgctcagcgtgtcggaaccggtgctccggtgtaccttgctgctgttctggagtatctcgctgctgaggtgcttgagttggctggaaatgctgctcgtgacaacaagaagaacaggattatcccgaggcatgttctgcttgctgtgaggaacgatgaggagcttgggaaattgcttgctggagtcaccattgctcatggtggtgttcttcccaacatcaaccctgtgcttctgcctaagaagactgctgagaaagctcctaaggagtcaaagtctcctcctaagaaggctggaaagtctcccaagaaagcttagattatcaagttaggctgatttctgattctagattgttcatgttgtgtttggtttgtaaatttgcaattaggtggttcttctgtgataaaaagtattcaatgtgtttgaaagaatgtaattctgatttcactgttgttcttagtatttataataagcaatttctgggattatcaagcttttctgtctcgat

SEQ ID NO: 15727 - DNA, 768 bp, Camellia sinensis
ttgctcggacaaaaaaagcatcacaatagctatatagtggctgtttgtttctcgggaaaatcggtttctgactgagaaagcacaggaagaaaatggatgccggtggaaaggtgaagaaaggtgccgcaggaagaaagggaggcggtccgaagaagaaaccggtttcccggtccgtcaaagccggtttacagttcccggtcggtaggatcagccggtacttgaagaaaggccggtactctcagcgagtcggtaccggtgctccggtctatcttgccgccgtgctcgagtatctcgctgctgaggttttggaattggctggaaatgctgcaagggacaacaagaagaacaggatcataccaaggcatgtgcttctggctgtgaggaatgatgaagaacttggaaagctacttgctggagtgacaattgctcatggaggggtgctacccaacatcaatcctgttcttctccctaagaaaaatgagaaggcaacaaaggagcccaagtctccatccaaggcaaccaagtcaccaaagaaagcctaacttcttaagagtgttaaagagagagtcttgtttacttctctctgtgtatgtaatttccttttctgtttggtatgtaggaaagctagcatcatgttgttagggattgtgtactctttgtttgaatatgcttgttagcacatcagtgttggaaatcacagaaattaaattgttagtttctattcttagttgcgacagaaaaaaacatgtcggccgcctcggcctatgt

SEQ ID NO: 15728 - DNA, 736 bp, Lotus japonicus
ccgtcaccgctcacaaattttcttatcctcctccgctacaatctagggttccggcaatggacaccaccacaggaaaggcaaagaaaggcgccggagggagaaagatcggcggcccaaagaagaagccagtttccagatccatcaaagccggtctccaattccccgtcggaagaatcggccgctacttgaagaaaggccgatacgctcagcgcgtgggaaccggcgctccggtgtacctcgccgctgttctggagtatctcgcggctgaggtgcttgaattggctggaaacgcggcgcgtgacaacaagaagaacaggattatcccgaggcatgtgctgcttgctgtgaggaacgatgaggagcttgggaagttgcttgctggtgtgactattgctcatggcggtgttcttccgaatattaaccctgtgcttctgccgaagaagactgctgagaaggttgccaaggagcctaagtctccggctaagaagggtgtgaaatcgcctaagaaagcttagatttggttttggttaatgtttttagttaattaattaaggtttcatttgtgtgtgtgtgtgtgtgtgtgtgtgtgtgtgtgtgtgtgtgtgtgtgtgtgtgtgtgtgtgtgtgtatattgctgtttaggtctttcttgtgtgatggaaagattaaatgggtttgggataatgtaattctgatctacctctaattgtatcacctgtagggagttttatgcatc

SEQ ID NO: 15729 - DNA, 697 bp, Glycyrrhiza uralensis
gaagttaccaacaccactcactcacacacacacacgatcgcgattcctcacagcgcaccgaagtcactgctagaatctagggttgggatattgcaagatggacgctagcggaaaggtgaagaaaggagcaggagggaggaaaggaggaggaccaaagaagaaggcagttacaaggtcggtgagagccggtcttcaattcccagttggtagaattgggcgttacttgaagaaaggaagatacgctcagcgcgtgggtgccggtgctcccgtttacctggccgcggttctagaataccttgctgctgaggtgcttgagttggctggaaatgcagctcgtgataacaagaagaacaggattatcccgagacacgttttgctggcagtgaggaacgatgaggagcttgggaaattacttgctggtgttaccattgcccatggtggtgttctacccaacatcaacccagtgcttttgcctaagaaggccgacagggctgcaaaggagcccaagtctccttctaaggccaccaagtctcccaagaaggcttagatcagtttctaattttagtttatttgtgttcattttgtgtgtatatgatgatgcatttaggtccttcttatgtaacagaatgatttgttgcgtttgaaacaatgtaattctgatctcactgtgtctccttttagtatccatagccaatcc

SEQ ID NO: 15730 - DNA, 774 bp, Mesembryanthemum crystallinum
cccccctcgagactagcctcaatccatttcctcatttttcagtcaaccaaacaagctccccatttctagagagagaacctagagagagaaagccatggacagcactggaggaaggcaaagaagggagctgctgaaaggaaggtcggcggtccaaagaagaagtccgtttcccggtccgtcaaggccggtctgcaatttccggttggtcgtatcggccggtacttgaagaagggccgatatgctcagcgtgttggtagtggagctccggtttacatggctgctgttctcgagtaccttgctgctgaggttttggagttggctggaaatgcagcaagggacaacaagaagaacagaataatcccaaggcatgtgctgttggccataaggaacgatgaggagctcggaaagcttctttctggagttacaatcgctcatggtggtgttctaccaaacatcaacccagtgttgttgccaaagaagactgctgagaagtcaccaaaggagccaaagtcaccctcaaaggccacaaagtcacccaagaaagcttaaaaagtcagtgatgttgttgatttggttgtgtaggcagtatggaaaggagttggagtttaatcttgtttatgtatgtaatgtttgagaaatggttaggttttcatcaggttagggttttatgatatataatgtaatgggaggttgtaatgggatcaataatttattgattcactcatcttcttcatcttctctgtagtgttttgccattaatgagtaatgacaatg

SEQ ID NO: 15731 - DNA, 540 bp, Artemisia annua
ggagggaaccggtaaaatcaagaagggagcagcaggaaggaaagccggtggaccgcgaaagaagtccgtcactcgatctgtgaaagccgggcttcagtttccagttggaagaattggaaggtatttgaagaaaggtcgttatgctaagcgtgtcggtactggtgctcctgtttatcttgctgcggtcctcgaatatctcgcagctgaagtgttggaattggcgggaaatgcagctagggacaacaagaagactaggattattccgagacatgtgttgttggcgattaggaacgatgaagagcttggaaagttgttgtctggtgttacgattgctcatggtggtgttttgcccaatattaacccggtcttgttgcctaagaaaactgctgctaaagaaccaacaccaaagtctccatccaaagctgcaaaatcgccaaagaaagcatagattagtttgtttgatgtaattgtcgtgttttgttagtaaattcagatgtactcatttctatcaaatggaaatctcttctttctgcttctaaa

SEQ ID NO: 15732 - DNA, 743 bp, Persea americana
attttcccaactcgagacttgagcgataatttggcgagaaatcggagagatggagggaggcgggaaggtgaagaagggagtggcagggagaaaaggtggcggcccgaagaagaagccggtatccagatcagtcaaagccggtctgcagttcccggttggaagaatcggccgatatctgaagaagggacgatattctcagcgagttggaaccggggctcctgtgtatctagcggctgtgcttgaatatctcgcagctgaggtactggaattagctgggaacgctgcacgcgataacaagaagaacaggattatccctaggcacgtgctcctggccgtaaggaacgacgaggaactcgggaagcttctagcaggagtgaccatagcccatggtggggttattcccaacatcaacccagtcctcctccccaagaaaactgctgaaaaagccgccaaagagcccaagtcacctgcaaaagcccctaaatcccctaagaaagctgcttgacatcattttaagtcatcttctttactgttctctctcatcaagcccttgtgtaattgtgggttactttactttgttgtgtagatttgaattaggggatgggagattcaagaaattgaaagtagctttttttcattcttctatgtttctgtttctttagaacctaatgacagtggttttaacttgttaatttcttggagatctttgtgtgtgatttgagccttttagctattttgattga

SEQ ID NO: 15733 - DNA, 755 bp, Actinidia deliciosa
tctgtatccgttatattcttttgagcggggggtagaatcatcatttcgagatggatgctggcggaaaagcgaagaagggggccgccggtaggcgcggaggcggtccgaagaagaagccggtgtcccggtccgtcaaggcgggtctgcagttcccggtcggcaggatcggccggtacttgaagaagggtcgatacgcccagagggtcggtaccggagctccggtctacatggccgccgtgctcgaatacctagcagctgaagtactggagttggctggaaacgcagcccgtgacaacaagaagaacagaataataccaaggcacgttctattggccataaggaacgacgaagagcttgggaggctgttggctggagtgaccatcgcacatggcggagtactgcccaacataaacccagtgctgttgccgaagaagaccgataaggctgccaccaaggaacccaaatcaccctccaaggccaccaagtctcccaagaaagctgcttagttttgctcaatccagtctcagttactgtatgtaatttgtgcttttaggacttttcttttgttgttgtgtaggcctaattgctggaagaaaacaaagaggtgaaaatatcattgtaatcctaatttaggtgttttcagattgatcaatggatggaagtgaaaccatccgtttcacttcctattttgcgctaactcttctcttctttacgcgcatgcacacatatataataaaatataacccccattaatt

SEQ ID NO: 15734 - DNA, 937 bp, Nicotiana tabacum
catctctcgctccgacaatcaagatttccttcaaatctttcatcattttggtctaaaattctaatatctgcaaatggatactagcggaaaagcgaagaaaggtgcagccggaagaagagtcggcggtccaaagaagaagccggttacccggtctgttagagccggtcttcagttcccggtcggtagaatcggtcgatacttgaaaaaaggccggtacgctcaacgtgttggtactggtgctcccgtttacttagctgctgttctcgaatatttggctgctgaagtgttggaattggccggaaatgcagcacgtgacaacaagaagaacaggattattccaaggcatgtgcttttagctgtgaggaatgatgaagagctagggaagttgcttgctggtgtgacaattgcacatggtggtgttcttcccaacattaacccaattttgttgccaaagaaaactggaggtgaaaaggctggcaaagaacataaatctccttccaaagcaaccaaatctcctaagaaggcttagatttagtggctgttataagcctcttgcttttctatctttatttggatcttcattgtatgtaattctggtgttagattgtgttaatgtctttcagggatattaaaaaggaaactagttggaacttgttagatcttgttaggtgttcctctattatcaatcaatgaaacctcttgtttcgattttacaatttcaaaaaaaaattttttttttttgattatatgtatcagtcactaaaaccagtcttcgaccagaaattattgcaagcggtttggacaatcatacttacataaggatcaaacgggctcttttcagaaaagatccatgctttcaagtttcaactctgttctcacataaaaaatttctccaagcaactgctatttcagggtcatagaccagcggccgcatgag

SEQ ID NO: 15735 - DNA, 758 bp, Manihot esculenta
ctataaaatcgttcgacaacacagcagcagtctattgattatttgctgtctttctcactgaagctagatcggcggtttcctctatcggtgttcataaacgggtcggatctttttggcagatggagtctggagggaaagtgaagaagggagccggaggaaggaaaggtgggggtccgaagaagaagcccgtttctaggtcggtcaaagccggcttgcagtttccggttgggagaatcgggcggtacttgaagaaaggaagatattcgcagcgtgttggaactggtgctccagtttacttggccgctgttctcgagtacctagctgctgaggtgctggaattggctggaaatgcagcaagagacaacaagaagaacagaataataccgcggcatgttttgcttgctgtgagaaatgatgaagagcttgggaaattgcttgcaggtgtgaccattgctcatggaggagtccttccaaatatcaaccctgttctgttgcccaaaaagagtgaaaaagctgcaaaggaaccaaagtctccctctaaggccaccaagtcccccaagaaggcttaagtgctttcttcctagctgaaagccaatttgggtgcctcaactcttctgctttggttgtatgtaattttgggttattttgttgtaggggaagtttgaaacattgtgtagtccctttgatcactgtaatactattttaggattgacatttttagattaatgcaatgaaacttcttgtttctgtttcttgga

SEQ ID NO: 15736 - DNA, 606 bp, Liriodendron tulipifera
tatcggcgagattgagctcgagaaatcacgagaaagagatggagtcgaccggaaaggtgaagaaaggcgctggtggaaggaaaggaggcggtccgaagaagaagccggtctccagatcggtcaaggccggtctgcagttcccggtcggtaggatcggtcggtatttgaaaaagggccgatattctcagcgtgtcggaaccggtgcgccggtttatctcgcagctgttctggaatatctcgcagctgaggttcttgaattggctggaaatgccgcccgtgacaacaaaaagaacagaatcatcccaaggcatgtactgttagcagtgaggaatgatgaagagcttggaaagcttttgcatggtgtgacgattgctcatggaggagttcttcccaacatcaaccctgttcttcttccaaagaaaactgcagagaaggctgccaaagagccgaagtcccctaccaaggctgccaaatctccaaagaaggcttgatttgaatcccgtctcttcaagcctcttctgtctctctgcccttcttcctcttcttcttcttcttgtatgttactactgctgtgggtcccagtccagatggtttgatgtggggagg

SEQ ID NO: 15737 - DNA, 751 bp, Medicago truncatula
atccaacgctcagaatctccttcaatctagtatataatcattccaacgatttttcatctattctcacttcatcgcaattcaaaatcttccatttcccactttcacaccaaattcacagcaacaaatctagggttcgaaaatggacgcaagcacaaaggcaacgaagaaaggagcaggaggaagaaaaggcggaggaccaaggaagaagtcggtaacaagatcaatcagagccggacttcaattcccagtgggaagaatcggccgttacttgaagaaaggtcgatatgctcaacgtgtcggcaccggtgctcctgtttacttagccgctgttcttgaatatcttgctgctgaagttcttgaattggctggtaatgctgctcgtgataacaagaagaataggattattccaaggcatgtgttgttggctgtgaggaatgatgaagagcttgggaaattgcttgctggtgttaccattgctcatggtggtgttcttcctaatattaaccctgttcttttacctaagaaaagtgaaaaacctgttaaggagcctaaatctccttctaaggctaaaaagtctcctaagaaggcttagattaggtttctgtgatctagggaatcagatttaatgatttgaatgaatgtgataattgatgactaaacgatttgattttaaaaccgaatgatccttttaaccacggtagacggttcaaagagagcagttgacaacgtctgctccaattttggtttagtt

SEQ ID NO: 15738 - DNA, 666 bp, Gerbera hybrid cultivar
aaatccatcactcgcttctgtaaacatcgccggagaaagatggacggagccggaaaagcgaagaagggcgcaggaggaaggaagggcggcggtccaaggaagaaggcggttactcgttcagtcaaagctggtctacagttccccgtcggtagaattgggcggttcctcaagaaaggccgttatgctcagcgagtcggctccggtgctccggtttacctcgccgccgtcctcgaatacctcgccgccgaagtgctagagttagctggaaatgctgcgagggacaacaagaagaacaggattatcccaaggcatgttcttctcgccatcagaaacgacgaggagcttggaaaattgcttgctggagtcaccattgctcacggcggtgttcttccaaacatcaaccctgtgttgctgcccaagaaggctgctgctgccaaggaaccaaaatcgccatcaaaagcaaccaaatctccgaagaaagcttagtaagattgttgtgttttgtaatttgtaagtgtgggattctctttcttctccccaatttgtgttagtattttgggtgatttggaagaagagctaggtttaatttagttgatatgaggtgtttgtatgttggtgtttgatccattttaatcaatgaaacctcttgtttcttttaaaaaaaaa

SEQ ID NO: 15739 - DNA, 503 bp, Artemisia annua
aatcacacactcactaaaacacacacacattcttcatcattttaaaaaaaaaaaaaatggagggaaccggtaaaatcaagaagggagcagcaggaaggaaagccggtggaccgcgaaagaagtccgtcactcgatctgtgaaagccgggcttcagtttcccgttggtagaattggaaggtatttgaagaaaggtcgttatgctaagcgtgttggtactggtgctcctgtttatcttgctgcggtcctcgaatatctcgcagctgaagttttggaattggcgggaaatgcagctagggacaacaagaagactaggattattccaagacatgtgttgttggcgattaggaacgatgaagagcttggaaagttgttgtctggtgttacgattgcgcatggtggtgttttgcccaatattaacccggtcttgttgcctaagaaaactgctgctaaagaaccaacaccaaagtctccatcgaaagctggaaaatcgccaaagaaagca

SEQ ID NO: 15740 - DNA, 580 bp, Gerbera hybrid cultivar
ttcacttaatcacttgtctatacgtcgccggagacatggacggagccggaaaagcgaagaagggcgccggaggaaggaaaggaggcggtccaaggaagaaggcggttacacgttccgtcagagccggtctacagttccccgtcggtaggatcgggcgtttccttaagaaaggacgatatgctcagcgtgttggaaccggtgctccggtttacctggccgccgtcctcgaatacctagccgctgaagtgctagaattggccggaaatgcggctagggataacaagaagaacagaataatccctaggcatgttctattggccattaggaatgatgaagaacttggaaaattacttgccggtgttacaattgctcatggtggtgttcttccaaacattaatccaattttattaccgaagaaaacagctgctaaggagcctaaatccccgtctaaatccaccaagtctccaaagaaagcttgatcagatatctttcttagaattgtgttcttattgtggtagattgtagggccatatgcttgtatgttggggttgctttaattaatgaaaccgcttgtttctta

SEQ ID NO: 15741 - DNA, 544 bp, Gerbera hybrid cultivar
tatttattcacctgtgcaaatcgccgaaaaaagatggacggagccggaaaagtgaagaagggcgccggaggaaggaaaggcggtccaaggaagaaggcggttactcgctcagtcagggccggtctacagtttccggtcggtaggatcgggcgtttccttaagaaaggacgttatgctcaacgtgttggaaccggtgctccggtttacctagccgccgttctcgaataccttgccgccgaagtgcttgaattagctggaaacgctgctagggacaacaagaagaacaggataatccctagacatgtcttgttagccattaggaacgatgaagaacttggaaaattactagctggagtaacgattgctcatggtggtgttcttccaaacattaaccctattctcttgcccaagaagacagctgctaaagaaccaaaatcgccttcaaaatctgccaaatctcctaagaaagcttgattagggtatcttgttatattgcattgtttttgggttagtttatatggtgatttgttagcttgtttatggt

SEQ ID NO: 15742 - DNA, 817 bp, Persea americana
ttgagcgatatttcggcgagaaattggagaaatggagggaggcgggaaggtgaagaagggagcggcagggagaaaaggtggcggcccgaagaagaagccggtctccagatcagtcaaagccggtctgcagttcccggttggaagaatcggccgatatctgaagaagggacgatattctcagcgagttggaacgggcgctcctgtgtatctcgctgctgtgcttgaatatctcgccgctgaggtactggaattggctgggaacgctgcacgtgataataagaaaaacaggatcatccctaggcacgtgctcttggctgtaaggaacgatgaggagctgggaaagcttctagcaggagtgaccatagcccatggtggggttattcccaacatcaaccctgtcctccttcccaagaaaactgcagaaaaggcagccaaagagcccaagtcatcttcaaaagcccctaaatctcctaagaaagctgcagctgcttgatatgacatcattttaagtcctcttctttactgttctctgtcttcaatcccttttgtaattgtggatttactttacctttgttgtgtagactaggggatgggagatttaaaccattggaattagcttttttttttcttagaacttaatggcagtggttttagcttgttaatttctagaagatctttgtgtgtgatctgaaccttgtggcaagttggatttgcaaaatttgatgtgtagttagtgtctaaaatgagggttttgatgtttatggagctaatagtatgaattgggaatttgattttttcttaatattaaaaggagtag

SEQ ID NO: 15743 - DNA, 695 bp, Jatropha curcas
ggctgtacgataaacatcatatttttctctctctctctcttaaacgggtcggactttctgcggacatggacgccggagctaaagtcaaaaagggtgccggtggtaggaagggtggaggcccgaagaagaagcctacttctaggtccgttaaggctggccttcagtttcccgttgggaggatcggtcgttacctgaagaagggaaggtatgcgcagcgggtcggatccggagctcctgtttacttggctgctgtgctcgagtacctagctgctgaagtacttgagttggccggtaatgctgccagagataataagaagaatagaataataccaaggcatgtattgcttgccgttaggaatgatgaagagcttggaaagttgcttgcaggagtgacaattgctcatggaggtgttcttcccaatattaaccctgttctattgcccaagaagtcagagaaggcagcaactaaggaacccaagtctccatccaagggaacaaagtctccaaagaaagcttaggccattccagttattattctcttatgctcttgttgtatgtagttttgccatattttgttaatttgtaggacgaagttgatggattttgataaaattgtgtagtcccttgatctttgtgatactatgttaggattgacatatgagattaatggatgaaactactggtttctgtttttc

SEQ ID NO: 15744 - DNA, 737 bp, Tragopogon dubius
acgctctctctctctttacctcacctcaagtcaaaaactcgccggaaaacctctactccctccatttgtaccgatcattttctggaatggagaccagtgggaagttgaaaaagggtgctgctggaaggaaggccggcggtccgaagaagaagtcagtcacccgttccgtcaaggccggtcttcagttccccgtcgggagaatcggtcggtacatcaagaatggacgatacgctaagcgtgtgggtaccggtgctccggtttacctcgctgccgttctcgagtaccttgctgctgaggtgttggagttggctggaaatgctgctagagataacaagaagagcaggatcataccaaggcatgttttgttggctgtgagaaatgatgaagaacttggaaagcttctagctggtgtgacgattgctcatggtggtgttcttccaaacatcaatccagttcttttgccaaagaagaatcttgataaagctgaaaaagaaacaaccaaatcaccaaagaaagcagccaaatccccgaagaaagcttaggtgttgaagaaaagagatctgtaatgctctgtttgtatttattcaccttctgttggtgatgtaagtttgatgcgttttggggtagatttagaagtgttgtattttgggttgtttaagttagggtgtaggattgaagaagaatctctctttttccttaatgaaatatttagtttagcacaaaaaaaaaaaaaaaaa

SEQ ID NO: 15745 - DNA, 792 bp, Orobanche aegyptiaca
attcatttcgttttctctccgacaaaaacaaatggacgccagtgggaaagtgaagaagggagccgccgggaggaagatcggcggaggtccgaggaagaaatcggtcactcggtccgtcagagccggtctccagtttccggttggcaggatcggccgttatctgaagaaaggccgctatgctcagcgggttggtaccggtgctccggtctacgtggctgctgtgctcgagtaccttgctgctgaggttctggaattggctggaaatgccgcaagagacaacaagaagaacaggataattccgagacacctgttgctcgctgtgaggaacgatgaagagctaggaaagcttcttgcgggtgttacgattgctcatggtggagttataccaaacattaatcctgtgcttttgccgaagaagaatgagaaggtcggcgagaaggcacctaaatccccagcaaaggccacgaagtctccgaagaaggcttgaattagtgttattgttggtattggatagtgttactgtagagcattttgtgcttttaatgtattttgaatgagtttaaaattaatggaagattgtttacatttagtaagcatatatgctgtgaattgtttctatttacagctgaatgatttgtccaggtttattaagccatatggcaatatattgaaaattagatctgtgaacaaattataatgctattggaattagcaatggattgaaaggtaaaccttattaggaaatgagtgtaccattgtaatcctattttgagtttggacttattttgattt

SEQ ID NO: 15746 - DNA, 611 bp, Gerbera hybrid cultivar
ttcggtaccggaaattttaccagtctagccgtcggagatcaaatggacgccggaacaaaggtgaagaagggtgccgccggcaggaaggctggtggtcccaagaagaaaccggtttcccggtccgttaaggccggtcttcagttccccgtcggcaggatcggccggtatctgaaaaaaggccggtacgcgcagcgcgtcggtaccggagctccggtataccttgcagccgttctcgagtaccttgctgctgaggtattggaattagctggaaacgctgcaagagacaacaagaagaacaggatcatacccagacatgttcttttggcagttaggaatgatgaagaacttggaaagcttcttgctggtgtgacaattgcccatggaggtgttattcccaatattaatccagttcttttgccaaagaaggctcatgataaagcaacaaaagagccagcaaaatctccatcaaaagcaacaaaatctcccaagaaaggttagccattgaagaacaggttctatgtggttctttctcaccctttcttgtatgtggtgacatcttaatttgatggtgattttagggtttaggatcattgttacctgatattttgaat

SEQ ID NO: 15747 - DNA, 733 bp, Bruguiera gymnorhiza
ggtatcgctcatccaacatcacgtatatccattatcgttcgatcttcttatcttgtcttgtttttgctcgttttgtctgtctgtttctcgaggaaaaggaaaatagtttagcggtcttgatttggaaatatcctgggccatggatactacagcaaaagtaaagaaaggagcaggaggccggaagggaggcggtccaaagaagaagccagtgtcccgatccgtaaaggctggtttgcagttcccagttggacggattggccgatacttgaagaaaggccgatactctcagcgtgtcggaactggagctcccgtctacctcgctgccgtgctggaatatcttgctgctgaggtattggagttggcaggcaatgcagccagagacaacaagaaaaacagaatcatccccaggcatgtgctcttggctgtgaggaatgatgaggaactcgggaagcttcttgctggtgttactatagctcatggtggtgtgctgcccaacatcaaccctgtcctgctaccaaagaaatcagagaaggcaatcaaggagccaaagtcgccatccaaggccaccaagtcgccaaagaaggcttagcctagtttctattttgtctccgtacctgtaatcttcccattgtgtacgggcctatctgtacgagatctttatgtttttggaatgtaggaacatgagtagttcaatttcctagcttcagcacagaacaacctgtctattccagat

SEQ ID NO: 15748 - DNA, 751 bp, Manihot esculenta
ggtgattctttaatcattgttcttaaacgggtcagatctttatcggcagatggagactggaggaaaagtgaagaagggagccggagggaggaaaggcggaggtccgaagaagaagcccgtttctaggtcggtcaaagcaggtctgcagtttcccgttgggagaatcggccggtacttgaagaaagggagatattcacagcgtgtaggaactggtgctccggtttacttggccgctgttctcgagtacctagcagctgaggtgctggaattggctggaaatgcagcaagagacaacaagaagaacagaataataccaaggcatgttttgcttgctgtgagaaatgatgaagagcttggaaagttgcttgctggtgtgaccattgctcatggaggtgtccttccaaatatcaaccctgttctgttgcccaaaaagagtgataaagctgcaaaggaaccaaagtctccctctaaggccaccaagtcccccaagaaggcttaagcctttatacctcactcaaagccaatctgggtgcctcaactcttctgctcttgctgtatgtaattttgttgtaggggaaacttgtctgaaacattgtgtagttcctttgatcattgtaataccatgttaggattgacattttagattaatggaatgaaacaactaaattatgttctttatttatttgtgtttcatttcggatgcatatgttgtggttgacatgagatgttgctttatgaaatcttattgccc

SEQ ID NO: 15749 - DNA, 742 bp, Manihot esculenta
acacactctctttcacaaacaccaaatcggcgatttccatttttaatctttatttggccagatggaaaccggagggaaagtgaaaaagggagccggagggaggaaaggtggagggccaaagaagaagcccacttctagatcggtcagggcgggtttgcagtttcccgttgggagaatcgggcggtatttgaagaaaggaagatattcgcagcgggtcggaactggggctccagtttacttggccgccgttctggagtatctagctgctgaagtgctggaattggctggaaatgcagcaagagacaacaagaagaacagaataataccaaggcatgtattgcttgctgtgagaaacgatgaagagcttggaaagttgcttgcaggtgtaacaattgctcatggaggtgtacttcccaatattaatcctgttctgttgcccaaaaagactgagaaagccaccaaggaacccaagtcaccatctaaagccactaaatctcccaagaaggcttaggccaatttcagttccctaaccattctgtcttctgtatgtaatttagggttcattgctggtttattttgtaggtaaagttgtttgaatcaatttgtagtccattagatctttgtaataccatgttaggatttgacctattaagattaatggattgaaactacttgtttcctcttctttaagaagagtagagaatatatttccttcaatatatattttttttgcttcctattt

SEQ ID NO: 15750 - DNA, 653 bp, Pseudoroegneria spicata
ctggctctctccatcccaatcccgacctaccgcccgctcccgcaagccatggacgcctcaggcaccgtcgcgaagggcaagaagggcgcggccgggcgcaaggccggcgggcccaggaagaagtcggtgacgcggtccgtgaaggccgggctccagttccccgtcggccgcatcgggcgctacctcaagaagggccgctacgcccagcgcgtcggcaccggcgcccccgtctacctcgccgccgtcctcgagtacctcgccgccgagctgctggagctcgccgggaacgccgccaaggacaacaagaagagccgcatcatcccccgccacctgctgctcgccgtccggaacgacgaggagctcggcaagctgctggccggcgtcaccatcgcgcacggcggcgtgatccccaagatcaacccggtgctgctccccaagaggacggcggagaaggagggcaaggcgcccaagtcccccaagaaggccgccaagtcgccgaagaaggcataagagagtgcgttctgtatcgtttaggcttgtgctgtgtagtgttcgtctgaataggggtgtgaaggtgttccgtctagttgtcgatgtaccttgtgttgtgttcatgttcatggaagaaattcagaaatctctctgagttccca

SEQ ID NO: 15751 - DNA, 658 bp, Antirrhinum majus
gagtcaatttgcgtttagtaacaaaagaatggaaactggtggtaaaataaaaaggagctgcaggtagaaagatcggcggtccaaagaagaaaccagtctcccggtccacaaaagccggtctacagttcccggtcggcaggatcggccggtacttgaagaaaggccgatacgcacagagagtcggaaccggagctccggtttacatggccgctgtgctggagtaccttgctgctgaggttttggaattggctggaaatgcggcgagggacaacaagaagaacaggattattcctcgtcatttgttgcttgctgtgaggaatgacgaggagcttggtaagcttctggctggtgtgacgattgcgcatggaggagttttgccgaatatcaacccggttctgttgccgaagaagtcggagaaggcagcagagaaggcggcgaaatcgccatcaaaggctaccaagtctcctaagaaggcttagatgatgttgttgtattgggagatttagtggcattgttgtttttctaagttttgagttagtctgtatgtagttgaattagcggtgttggtatgtagaagaaatgttgttcataactcatgttcaactgggtctgttagatttagctgcatttgaaatgaatcaaagagattggtactgtt

SEQ ID NO: 15752 - DNA, 736 bp, Saccharum officinarum
cgcttcctccaaaccccaatcatcacttccctccaaatcccatttccctctcaacacccgcgactcgcgagatggacggcggcggcacgaaggtgaagaaggcggcggcggggcggaagctgggcggcggcgggccgaagaagaagccggtgtcgcggtccgtcaaggccgggctgcagttccccgtgggccgcatcgggcggtacctgaagaaggggcggtacgcgcagcgcgtcggcacgggcgcgcccgtctacctcgccgccgtcctcgagtacctcgccgccgaggtcctggagctggcgggcaacgcggcgcgcgacaacaagaagaaccgcatcatcccgcgccacgtcctcctcgccatccgcaacgacgaggagctcggcaagctgctggcgggcgtcaccatcgcgcacggcggcgtgctgcctccactccgtcctcctccccaagaaggccgccgagagggctgagaaagtcgcccaagaaggccgccgccaagtcgcccaagaagtagtagtgccccgtctcgtctcatctgattctgatctcagcttggctgagtggtcgtggatccttttgctgttcttgcgtgtctgtgtatgtagtgatgcgtcgcctcatgtgtcgtgtgtctcgatcgatctagttctggttcaatctctagctgtagtggtggttggtgatgggatctccatgttacctaagatttaatgaaaacaagaggaagtgc

SEQ ID NO: 15753 - DNA, 682 bp, Cynara scolymus
cggggacatcattctctcaacaatccatcactcatttctgtagagcttttgagaaattcagagagatggagggaaccggaaaagtgaagaagggcgccggaggaaggaaaggcggtggtccgaggaagaagtcggtgacgcgttcagtaaaagctggtttacagttccccgtcggtaggattggccgttacctgaagaaaggacgttatgctcagcgagttggaaccggtgctccggtttatcttgccgccgttctcgaataccttgccgcagaagtgctggaattagctggaaatgctgctagagacaacaagaagaatagaatcatcccaagacacgtactgttagccataaggaacgatgaggagcttggaaaattgttggcaggagtaacaattgcacatggtggtgttcttccaaacattaaccctattctattgcccaagaaaactgctaccaaggaacctaaatctccatccaaagccgctaaatctccaaagaaaactgcctagatgaatctgattagactattctccttttgtatctgtaattttaagcatctgtttcttacaacccttcatgtttgttgattgggtagtttgagataagagttgcagaatagtttatatcatcagagaatattgaatttgaatgaatgaaaccacttgtttctttttttttg

SEQ ID NO: 15754 - DNA, 726 bp, Petunia hybrida
gcggggcctcatctcacgctccacaatcaaatcctcttacattttttgtttgtgtctaaatttaatttaattatcttcaaaaatggagactggtggaaaagtgaagaagggtgctgctggtagaaggggtggcggcccaaaaaagaagccggtttcccggtctgtaagagccggtctacaattcccggtcggtagaattggccgttacttgaaaaaaggtcgttatgctcaacgtgttggtactggtgctcctgtttatttagctgctgttcttgaatatttagctgctgaggtgttggaattggctggaaatgcggcaagggacaacaagaagaacaggataataccaaggcatttgttattagctgtgaggaatgatgaagagttgggaaagcttcttgctggtgtgacaattgcacatggtggtgttttaccaaatattaacccagtgctgttgcccaagaagactggtggcagtgaaaaggctggcaaagaacctaaatctccatccaaagctaccaaatcaccaaagaaagcttaagatttagtgattttgtggaagcttttgttgtttttgtatgtaatccttggtgttagattgtgttgatttcatgtttaaggagaaagaaactagttttaactttgttagatgtgttgttaagtgtcttcttctattatcaatcaatgaaacctcttgtttcgaaaaaataatataattcgaattca

SEQ ID NO: 15755 - DNA, 801 bp, Orobanche aegyptiaca
ctttcatagcgcattcttttccacatttattttgtcccaattccttctctatcagacaaaaatggaagccggtggtaaagttaagaagggagccgctgggaggaagatcggcggcggtccgaggaagaagtcggttacccggtccgtgagagccggtctgcagtttcctgttggcaggatcggccgttatctgaagaagggccgctatgctcagcgggttggtaccggtgcaccggtgtacgtggctgctgtgctcgagtaccttgctgcagaggttttggaattggctggaaatgcagcgagagacaacaagaagaacaggataattccaagacatctgttgctggctgtgaggaatgatgaagagcttggaaagcttcttgctggagttactatcgcacatggtggagttataccaaacattaatcctgtacttttgcccaagaagaatgaaaagaccgctgagaagacacccaaatccccagcgaaggctgccaagtcgccgaagaaggcttaaattagcgtttattacatagtgttattgtagaggtggttatttctgtaacaaattttatcgcatgagatgtggtaatatatttttgtaacttaattgaatttttctatcagcatttgtcacatttaagtgtattttaaaataaattgcatgtagtatacattaaatttatattaccaattaaattagggaaaacagcttaggttgcaaaggagtgtatataataaggcttgagaagattgcaaagaagcagatggcgattctattcttcataggtaattacgtat

SEQ ID NO: 15756 - DNA, 722 bp, Ipomoea nil
ggtgctcaatcctccgcattaagcgctccaatctttttatacccaaagagtttagcttaatttagcttatcattccatggatgctccggcggcgaagataaagaagggtgccggcggccggaaaggcggcggcccgaagaagaagccggttacccgctccgtccgtgccgggcttcagttcccggtgggtaggatcgggcgttacctcaagaagggccgctatgcccagcgtgtcggcaccggcgctcctgtttacatggctgccgttctcgaatacctggctgccgaggttttggagttggctggaaatgcagcgagggacaacaagaagaacaggatcattcccagacatgttcttttggctgtgaggaacgatgaggagctggggaagttgttggctggggtgaccattgcccatggtggggtgctgcccaacataaaccctgtgttgttgcccaagaagagtggatctgaggcaacaaaggagccaaaggcaaaggctgccaagtcccccaagaagaaggctgcttgatttgatagtgtagattagtggggttttgtcccttgtttctgtatgtgacttggggccattctttgcttatagaaggtgtaattgttagttgtgttgtaaacgtaatgtttggttatcaattaatgaaactctttttcatttctattgtctatggactctgctttgttgaattatattgttgggttcaaat

SEQ ID NO: 15757 - DNA, 679 bp, Artemisia annua
acgcagtactccgacggggaccacaacctcaaacactctcaaaacaaacactcattcatcatttttataagtaaaaaatggacgggaagaagggagcagcaggaaggaagccggcgggccacgaaagaagtcagttactcgttccgttaaagccgggcttcagtttccagttggtagaatcggaaggtatttgaagaaaggccgttacgctaagcgtgttggaaccggtgctcccgtttatctcgctgcggttcttgagtatctcgcagctgaagtgttggaattggcgggaaatgcggcaagggacaacaagaagactaggattattccgagacatgtgttgttggcgataaggaacgacgaagagcttggaaagctgttgtctggagtcacgattgctcacggtggtgtttgccgaatattaacccggtcttgttgcctaagaagactgctgctaaagaatcgacaccaaagtctcctaagaaagctgcaaagtctcctaagaagactgctgcatagattagtttgatgtaatttttaatggttagatgtaatcacttctatgtaatggaaattgattatttctgtttattctccttgtttttaatattgtatttagtctgcaaatttgataattatgattatggtttagagaataaacatgtttttttatatgtac

SEQ ID NO: 15758 - DNA, 661 bp, Tragopogon dubius
tcaatcacttctttacatagatatacattcatagccataaagagaaatggaaaccaccggaaaagcgaagaagggtgccggaggaaggaagggaggcggcccaaggaagaagtccgtgtctagatccaccaaagctggtcttcaattccccgtcggtagggtcggacgttaccttaagatcggacgttacgctaaacgtgttggaaccggtgctccggtctacctcgccgctgttcttgaatacctagccgctgaagttttggagttggctggaaatgctgcaagggacaacaagaaaagcaggatcatccctagacatgttcttttggctattaggaatgatgaagaacttggaaagcttttgggcggagtaaccattgctcacggtggtgttcttccaaacatcaaccctgttcttttaccaaagaaatctgctgtaactgagccaaagtctccatcgaaagctgctaaatcaccaaagaaagcagcaaaatctcccaagaaaactgaataggtttatgtagtgtgagtgttgttcatctgtttgtgtatttgtagttagatttcatatggagttagttttctaacaattgcgtttgtttagatgatatttcgtatgttgttacctttgtgttcatcaatggaagaaaccacttgtttt

SEQ ID NO: 15759 - DNA, 649 bp, Heritiera littoralis
tctgtattcgaagcgatggatgccggagggaaagtgaagaagggagcaggaggaaggaaaggaggcggtccaaagaagaaaccggtttcgcgctctgtgaaagccgggttgcagtttccggtcggtcggatcggtcggtacttgaagaaagggcgttactctcaacgtgtcggaaccggtgctcccgtgtacctcgctgctgttcttgagtaccttgctgctgaggtcctggagttggctggtaatgctgcaagagacaacaagaagaataggatcattccgaggcatgttcttctggctgtgaggaatgatgaggaacttgggaagctgttggctggtgtgactattgctcatggtggtgttttacccaacattaacccggttcttctaccgaagaaaaatgagaaggcggtgaaggaacccaagtcgccatcgaaggctacaaagtctccaaagaagtcacttaagaaggcttagtctagtctttgcttattatttctcgtgtgtgtagcttcctttgtgtactctggctgtagaaaaatgttgatgttggtaggaattcagggccattgtagttctaattgtctgtgttgtctaaaacaaactgtgttttgaatgaatgacatgaaatttccatgacctgattcta

SEQ ID NO: 15760 - DNA, 808 bp, Senecio madagascariensis
cagaaaaccaattaaagatcaccaaagcttatataaatcacccccaatcatttcctatcttcacgctccgacaacaactcgccggaaacctaacaaactcccatttttcaaaatctccggccatcaaaatggaagccggtggaaaggcaaagaaaggagcagccggaaggaaagccggcggacctaggaagaaatccgtcacacggtcggtgaaagccggacttcagttccccgtcggtagaatcggccggtatttgaagaaaggccgttatgctaaacgtgtaggtaccggtgctccggtttacctcgctgccgtcctcgaataccttgctgctgaggttttggaattagctggaaatgctgctagggacaacaagaagactagaattataccgaggcatgttttgttggcggtgaggaatgatgaagagcttggaaagcttctagctggtgtaacgattgctcatggtggtgttcttcctaatattaacccggttcttttgcctaagaagtctcagtctggaaaagagcctgctagtaaatctccggttaaagcgactaagtcaccaaagaaaggtgctgctgcttaaatgttgaaggagtagatggacgatttgtgtgtatgtattgttgtttggtgaagtaggatggttttaactgaatcgtgtttttaggggaggtttagaaggattgtgtatgctcattgttgatttttaggatgtaggtatgattgtatgaagaagaatctctctttttcgatatcttgacaattgttaattttctgaagttataaagcgtttttagcatt

SEQ ID NO: 15761 - DNA, 834 bp, Artemisia annua
aacagtggtatcaacgcagtactccgacggggacacacactcatttcaccttcaaaaacacacacataacaaaaatcaaatcaaaaaatggacgcttcaaaaactaagaagggagccggtggacgtaagggaggcggtccaaggaagaagtcggtgacccggtctgtgaaagccgggcttcagtttccggtcgggagaattgggaggtatttgaagaatggaaggtatgctaagagggttgggactggtgctccggtttatcttgctgctgtccttgagtaccttgctgctgaagttttggaattggctggaaacgcagcaagggacaacaagaagaccaggatcatcccaaggcacgttctattggcaatcaggaatgatgatgagcttggaaagttgttatctggagtgacaattgcacacggaggagtgcttcccaacattaacccagtcttgttgccaaagaagaccgctgcaaaggagcccaagtcaccaagtaaaggaaagtctcctaagaaggctgctgccactgctgctgagtagattgggtagtgtttgggttgtgggtgttctgggtttgtaatttgtagttaatgaatgattatgtggtcagttgtttgtttaggttgttatggttatgtgttgttgatcgttggttattaatgaagaaacttcttgtttcagtatcttcttttgttattcaattcatttgaagtttgcttatttgatctatttctgatttctaaaccattgtgcttgtgtgaggtggttttgatacatctgtaaagtgaataaattttatccagtgtttattttaattcaaatgtcgagcgt

SEQ ID NO: 15762 - DNA, 740 bp, Artemisia annua
acgagtgcgtgtggtatcaacgcagtactccgacggggacacacactcatttcaccttcaaaaacacacacataacaaaaatcaaatcaaaaaatggacgcttcaaaaaccaagaagggagccggaggtcgtaagggaggcggtccaaggaagaagtcggtgacccggtctgtgaaagccgggcttcagtttccggtcgggagaattggaaggtatttgaagaatggaaggtatgctaagagggttgggactggtgctccggtttatcttgctgctgtccttgagtaccttgctgctgaagttttggaattagccggaaacgcagcaagggacaacaagaagaccaggatcatcccaaggcacgttctattggcaatcaggaacgatgacgagcttggaaagttgttatctggagtgacaattgcacacggaggagtgcttcccaacattaacccagtcttgttgccaaagaagaccgccgcaaaggagcccaagtcaccaagtaaaggaaagtctccaaagaaggctgctgccactgctgctgagtagattgggtagtgtttgggttgtgggtgttgctgggttgtttgtaatttgtagttaatgaatgattatgtggtcagttgtttgtttaggttgttatggttatgtgttgttgatcgttggttattaatgaagaaacttcttgtttcagtaaaaaaaaaaaaaaaaaacatgtcggatctagaatacgcactcgt

SEQ ID NO: 15763 - DNA, 682 bp, Artemisia annua
tcaacgcagtactccgacgggacacacactcatttcaccttcaaaaacgcacacacataacaaaaatcaaatcaaaaaatggacgcttcaaaaaccaagaagggagccggtggacgtaagggaggcggtccaaggaagaagtcggtcacccggtctgtgaaagccggtcttcagtttccggtcgggagaattggaaggtatttgaagaatggaaggtatgctaagagggttgggactggtgctccggtttatcttgctgctgtccttgagtaccttgctgctgaagttttggaattggctggaaacgccgcaagggacaacaagaaaacccgaatcatcccaaggcacgttctattggcaatcaggaacgatgacgagcttggaaagttgttatctggagtgacaattgcacacggaggagtgcttcccaacattaacccagtcttgttgccaaagaagaccgcagcaaaggagcctaagtcaccaagtaaaggaaagtctcctaagaaggctgctgccactgctgctgagtagattgggtagtgtttgggttgtgggtgttgctgggttgtttgtaatttgtagttaatgaatgattatgtggtcagttgtttgtttaggttgttatggtttatgtgttgttgatcgttggttattaatgaagaaacttcttgtttcagta

SEQ ID NO: 15764 - DNA, 714 bp, Artemisia annua
gcagtggtatcaatgcagtactccgacgggaacagggtcaacgcagtactccgacggggacacacaatcatttcaccttaaaaaacacacacataacaaaaatcaaatcaaaaagatggacgcttcaaaaaccaagaagggagccggtggacgtaagggaggcggtccaaggaagaagtcggtcacccggtccgtgaaagccggtcttcagtttccggtcgggagaattggaaggtatttgaagaatgggaggtatgctaagagggttggtactggtgctccggtttatcttgctgctgtccttgagtaccttgccgctgaagttttggaattggcaggaaacgcagcaagggacaacaagaagacccgaatcatcccaaggcacgttctattggcaatcaggaacgatgatgagcttggaaagttgttatctggagtgacaattgcacacggaggagtgcttcccaacattaacccagtcttgttgccaaagaagactgccgcaaaggagcctaagtcaccaagtaaaggaaagtctcctaagaaggctgctgccactgctgctgagtagattgggtagtgtttgggttgtgggtgttgctgggttgtttgtaatttgtagttaatgaatgattatgtggtcagttgtttgtttaggttgttatggttatgtgttgttgatcgttggttattaatgaagaaacttcttgtttc

SEQ ID NO: 15765 - DNA, 672 bp, Artemisia annua
aacgcagtactccgagggggacacacactcatttcaccttcaaaaacacacacataacaaaaatcaaatcaaaaaaatggacgcttcaaaaaccaagaagggagccggtggacgtaagggaggcggtccaaggaagaagtcggtgacccggtctgtgaaagccggtctccagtttccggtcgggagaattggaaggtatttgaagaatggaaggtatgctaagagggttgggactggtgctccggtttatcttgctgctgtccttgaataccttgctgctgaagttttggaattggctggaaacgcagcaagggacaacaagaagacccgaatcatcccaaggcacgttctattggccatcaggaacgatgacgagcttggaaagttgttatctggagtgacaattgcacacggaggagtgcttcccaacattaacccagtcttgttgccaaagaagaccgccgctaaggagcctaagtcaccaagtaaaggaaagtctccaaagaaggctgctgccactgctgctgagtagattgggtagtgtttgggttgtgggtgttgctgggttgtttgtaatttgtagttaatgaatgattatgtggtcagttgtttgtttaggttgttatggttatgtgttgttgatcgttggttattaatgaagaaacctcttgt

SEQ ID NO: 15766 - DNA, 678 bp, Artemisia annua
caacgcagtactccgacggggacacacactcatttcaccttcaaaaacacacacataacaaaaatcaaatcaaaaaaatggacgcttcaaaaaccaagaagggagccggtggacgtaagggaggcggtccaaggaagaagtcggtgacccggtctgtgaaagccgggcttcagtttccggtcgggagaattggaaggtatttgaagaatggaaggtatgctaagagggttgggactggtgctccggtttatcttgctgctgtccttgagtaccttgctgctgaagttttggaattggctggaaacgcagcaagggacaacaagaagaccaggatcatcccaaggcacgttctattggcaatcaggaacgatgatgagcttggaaagttgttatctggagtgacaattgcacacggaggagtgcttcccaacattaacccagtcttgttgccaaagaagactgcagcaaaggagcctaagtcaccaagtaaaggaaagtctcctaagaaggctgctgccactgctgctgagtagattgggtagtgtttgggttgtgggtgttgctgggttgtttgtaatttgtagttaatgaatgattatgtggtcagttgttttgtttaggttgttatggttatgtgttgttgatcgttggttattaatgaagaaacttcttgtttca

SEQ ID NO: 15767 - DNA, 653 bp, Artemisia annua
aaaacacacacataacaaaaatcaaatctaaaaaatggacgcttcaaaaaccaagaagggagccggtggacgtaagggaggcggtccaaggaagaagtcggtgacccggtctgtgaaagccgggcttcagtttccggtcgggagaattggtaggtatttgaagaatgggaggtatgctaagagggttgggactggtgctccggtttatcttgctgctgtccttgagtaccttgctgctgaagttttggaattggcaggaaacgcagcaagggacaacaagaagacccgaatcatcccacgacacgttctgttggccatcaggaacgatgacgagcttggaaagttgctatctggagtgacaattgcacacggaggagtgcttcccaacattaacccagtcttgttgccaaagaagaccgccgcaaaggagcctaagtcaccaagtaaaggaaagtctcctaagaaagctgctgccactgctgctgagtagattgggtagtgtttgggttgtgggtgttgctgggttgtttgtaatttgtagttaatgaatgattatgtggtcagttgtttgtttaggttgttatggtttatgtgttgttgatcgttggttattaatgaagaaacttcttgtttcagtaaaaaaaaaaaaaaaa

SEQ ID NO: 15768 - DNA, 689 bp, Pseudoroegneria spicata
tcgcactcggcaatcagcagtcaggcaatccccacgcacatctctccacttcccgaatcctttctccacctccagcgcagcagctcgccatggacgcctcagccaccgtagccaccgggaaggcgaagaagggcgcggccgggcgcaaggccggaggccccaggaagaagtccgtgtcgcggtccgtcaaggccgggctccagttccccgtcggccgcatcgggcgcttcctcaagaagggccgctacgcgcagcgcgtcggctccggcgcccccgtctacctcgcggccgtcctcgagtacctcgccgccgagctgctggagctcgcaggcaacgccgccaaggacaacaagaagagccgcatcatcccccggcacctgctgctcgccatcaggaacgacgaggagctcggcaagctgctcgccggcatcaccatcgcgcacggcggcgtcatccccaacatcaacccgctgctgctccccaagaagacggccgagaagtcgcccaaggagcccaagtcgcccaagaagaccaccaagtcccccaagaaggcttaggttcattgcttagttaggctgtagctgggatggacggatgggtgtgcttcaggatacttaagttcgaagtagactgttctgccgtgtcgttgtattttctgactgatttcaatggaacaataagttgcttta

SEQ ID NO: 15769 - DNA, 661 bp, Artemisia annua
agcactgtagaagcagtggttcaacgcagtactccgacggggacaacaatcacacacactcaaaacacatttataaacacacacacacattttataaaaatcaaatggagggaaccggtaaaatcaagaagggagcagcaggaaggaaagctggtgggccacgaaagaagtcggttaccagatctgttaaagctgggcttcagtttccagttggaagaattggaaggtatttgaagaaaggtcgttatgctaagcgtgttggtactggtgctcccgtttatctcgctgccgtcctcgagtatctcgcagctgaagtgttggaattggctggaaatgcagcaagggacaacaagaagaccagaataatcccaaggcatgtgttgttggcgataaggaacgatgaggagcttggaaagttgttgtctggagttacgattgctcacggtggtgttttgccaaacatcaacccggtcttgttgcctaagaagactgctgctaaagaatcaaccccaaagtctccatccaaagttggaaaatcgccaaagaaagctgctgcttagattagtttgatgtggttgatgtgatagtgaattgaagttaatgtagtttgtatgattagatgtaatcatttaaattgaatgaagaccacttgtttctgttt

SEQ ID NO: 15770 - DNA, 637 bp, Antirrhinum majus
gcggccgcactcaaatcttctctgttcttcaatatctcaacaacaaatggaagctggtggtaaattgaagaagggagctggaggcagaaagggcggtggaccgaagaagaaaccggtgacccggtccgttcgagccggtctgcagtttccggtcggcagaatcggccggtacctgaagaaggggaggtacgctcagcgtgtcgggaccggagctccggtttacatggcggctgtgctggagtaccttgctgctgaggtgttggagttagctggaaatgcagctagggacaacaagaagaacaggattattccgaggcacgttctgcttgctgtgaggaacgacgaggagcttgggaaactgttggctggagtgacgattgctcacggtggagtcttgccgaacatcaacccggttcttctgcctaagaagtcggagaaggccacaactgagaaggcgacgaagtctccatcaaaggctaccaaatcgcctaagaaggcttagtttataagctgtgttgttgtgttgtggaactgaatgatgtggttgttttatggttaggaaatgtggtgtataaaatgtagtttcgttctccttcaaactgttctgatttggatttaatggagaaattgttagcgg

SEQ ID NO: 15771 - DNA, 681 bp, Camellia sinensis
gatttctcggctgtttgttttctcgggaaactagtttcctgactggaaatcctgagaaaatggagaaggtcaagaaaggtgcaggtggaagaaagggcggcggtccgaagaagaaacccgtttcccggtccgtcaaagccggcctccagttcccggtcggccggatcggccgatacttgaagaaaggccgctactctcagcgcgtcggaaccggcgctccggtctacctcgccgccgtgctcgagtacctcgctgctgaggttttggaattggctggcaatgctgcaagagacaacaagaagaacaggatcataccaaggcacgtgcttttggctgtgaggaacgatgaggaacttggaaagttacttgcagtcgtgactattgctcatggaggggtgcttcccaacatcaaccccgttcttcttccaaagaaaagtgagaaggctgcaaaggagccaaagtctccgaccaaggcagccaagtcacctaagaggaaagcttaacttctcagagtgttgaagaaagccttatctgctcttagttatttctctgtatatgtatttcgttttctgttgtgttatgtaggaaatcttcttgttgtaaggaactattgcagtctttgtttcaaatcgttattatgacatctttgtttgaaatcaaagaaattaaattcctagttgc

SEQ ID NO: 15772 - DNA, 751 bp, Camellia sinensis
acatcagattagaggattagattgttctcattgtagtcttcgggtgcaaaatagtcattttaagtcgtgaaaattttatcagagatggacggtgccggaaaagtgaagaagggtgctggagggaggaaaggcggcggtccgaagaagaaaccggtgtcccggtccgtcaaggccggtctacagttcccggtcgggaggattggccggtacttgaagaagggtcgctatgctcagcgagtcggaaccggagctccggtttacatggctgctgtgcttgaatacctagctgctgaagtgttagagttggctggaaatgctgctcgtgacaacaagaagaacagaatcattccgaggcatgtgctattagcggtgaggaacgacgaagagttgggaaaattgctagctggagtgacgattgcacatggtggagtgttacccaacatcaacccagttctgttgccaaagaagactggcagtgctgcaaccaaagaacccaaatctccatcaaaggccacaaaatctcccaagaaagctgcttagggaaaccatttggttgtttcctcttttccctctgtatgtaattttgggtttagaacctgcttgttttgttgcttgctgcttagggaaatttgtgagaagaagaaaaatagcagttgtaatcgtttttagtgttttttatattagtggctttgtcgattggatcaatggattgaatctcgtgttgattattgaaaaatttcgtctagtttga

SEQ ID NO: 15773 - DNA, 851 bp, Coffea canephora
cggccggggggggggaaatacagaaaagagaaaaagatctcgactgtgcttttaagtacctattgatgtgagactagtctcatatttcccggccggtctactactcgcagtctaatttcggggggccattgtgagttgagagttgagattagggagaaaatggagagcgcaggtggaaaagtgaagaaaggagctggtggaaggaaagggggcggtccaaagaagaagccagtgtcccggtccgtgaaggccggtttgcaattccctgtcggcaggatcgggcgttacttgaagaagggtcgctactctgagcgtgtgggaaccggcgctcctgtctacatggctgccgtcctcgagtaccttgccgccgaggttctggagttggctggaaatgctgcaagagacaacaagaagaacaggatcataccgcggcatgtgttattggctgtgaggaatgatgaagagcttgggaaacttctagctggtgtgactattgctcatgggggagtgcttcccaacatcaatccagttctccttccaaagaagaatgaaaaggcagcaaaggagcctgttaagtctccagctaaggccacaaagtcacccaagaaggcctaatctgtcattcgtgaataagaggacttgtcgtcctgtgaatttctttgtatgtagttcctgtatctgttggtcgtatgtagaagagggtcagagatttttagaatttaggattgactgttgcttctgatggtcccaaattcttggattatgatgaatgaaacgaatttttagcttattaaaacacattcagtttcctgtgcgcgtattaatgtgaaagatctttacatttgacttcc

SEQ ID NO: 15774 - DNA, 662 bp, Orobanche aegyptiaca
tctttcgtttcttatttttttcattttattttctgtcatttccttctccaccagacaaaaagaatggaagttagtgggaaagtgaagaagggagccgctgggaggaagattggcggcggtccgaggaagaagtcggttacccgatccgtgcgagccggtctccagtttccggttggcaggatcggccgttatctgaagaaaggccgctatgctcagcgggttggtaccggtgctcctgtctacgtggctgctgtgcttgagtatcttgctgctgaggttctggaattagctggaaatgcagcaagagacaacaagaagaacagaataattccgaggcatctgttgcttgctgtgagaaatgatgaagagcttggaaagcttcttgctggagttacaattgctcatggtggagtcataccaaatattaaccctattcttttgcctaagaagactgataaggccgctgaaaagacaactaaatccccagcgaaggccaccaagtctccaaagaaggcttaattcagcgttattgcattgtgttattgtagaggttgttatcggattcttgtaacaaattttatcgcatgagatgtgattatgaatctattttgaaacttaattgatttttttgtcgcatttaccacatttactaattaagacag

SEQ ID NO: 15775 - DNA, 659 bp, Artemisia annua
aagcatggtatcaacgcagtactccgacggggacaacaatcacacacactcaaaacacatttataaacacacacacacattttataaaaatcaaatggagggaaccggtaaaatcaagaagggagcagcaggaaggaaagctggtgggccacgaaagaagtcagttacccgatctgttaaagctgggcttcagtttccagttggaagaattggaaggtatttgaagaaaggtcgttatgctaagcgtgttggtactggtgctcccgtttatctcgctgccgtcctcgagtatctcgcagctgaagtgttggaattggctggaaatgcagcaagggacaacaagaagaccagaataatcccaaggcatgtgttgttggcgataaggaacgatgaggagctcggaaagctgttgtctggtgttacgattgctcatggtggtgttttgccaaacattaacccggtcttgttgcctaagaagactgctgctaaagaatcaacaccaaagtctccatccaaagttgggaagtctcctaagaaagccgctgcttagattagtttgatgtcgttgatttgatagtgaagttagtgtagtttgtatgattagatgtaatcgtttaaattgaatgaaaaccacttgtttctgtttaaactacagtgct

SEQ ID NO: 15776 - DNA, 575 bp, Artemisia annua
aaatggagggaaccggtaaaatcaagaagggagcagcaggaaggaaagccggtgggccccgtaagaagtcggttaccagatctgttaaagccgggcttcagtttccagttggaagaattggaaggtatttgaagaaaggtcgttatgctaagcgtgttggtactggtgctcctgtttatctcgctgccgtcctcgagtatctcgcagctgaagtgttggagttggctggaaatgcagcaagggacaataagaagaccagaataatcccaagacatgtgttgttggcgataaggaatgacgaggagcttggaaagttgttgtctggagttacgattgctcacggtggtgttttgccgaatatcaacccggtcttgttgcctaagaagactgctgctaaagaatcaacaccaaagtctccatccaaagttggaaagtcgccaaagaaagctgctgcttagattagtttgattgtgatttggggtgttttcttttggttggtttcgtagagaagttagtgtagttaatttgattagatgtaatcgtttctactgaatgaaaactacttgtttctgttt

SEQ ID NO: 15777 - DNA, 645 bp, Artemisia annua
tactccgacggggaccacattcacacacactcaaaacacacacacacacattcatcacttacccatttataaaaaaacaatggagggaaccggtaaaatcaagaagggagcagcaggaaggaaggccggtgggccccgaaagaagtcggttactcgatctgttaaagctgggcttcagtttccagttggaagaattggaaggtatttgaagaaaggtcgttatgctaagcgtgttggtactggtgctcccgtttatctcgctgccgtcctcgagtatctcgcagctgaagtgttggaattggctggaaatgcagcaagggacaacaagaagaccagaataatcccaaggcatgtgttgttggcgattaggaatgacgaggagcttggaaagttgttgtctggtgttacgattgctcacggtggtgttttgccaaacattaacccggtcttgttgcctaagaagactgctgctaaagaatcaacaccaaagtccccatccaaagttggaaagtcacctaagaaagctgctgcttagattagtttgatgtcgttgatttgatagtgaagttagtgtagtttgtatgattagatgtaatcgtttaaattgaatgaaaaccacttgtttctgttctaaactacagtgct

SEQ ID NO: 15778 - DNA, 605 bp, Artemisia annua
cacacacattcatcacttactcatttctttaaacaatggagggaaccggtaaaatcaagaagggagcagcaggaaggaaagccggtgggccccgtaagaagtcggttaccagatctgttaaagccgggcttcagtttccagttggaagaattggaaggtatttgaagaaaggtcgttacgctaagcgtgttggtactggtgctcccgtttatctcgctgccgtcctcgagtatcttgcagctgaagtgttggaattggctggaaatgcagcaagggacaacaagaagaccagaataatcccaaggcatgtgttgttggcgataaggaacgacgaggagcttggaaagttgttgtctggagttacgattgctcacggtggtgttttgccgaatatcaacccggtcttgttgcctaagaagactgctgctaaagaatcaacaccaaagtctccatcgaaagttggaaagtcgccaaagaaagctgctgcttagattagtttgattgtgatttggggtgttttcttttggttggtttcgtagagaagttagtgtagttaatttgattagatgtaatcgtttctactgaatgaaaactacttgtttctg

SEQ ID NO: 15779 - DNA, 795 bp, Camellia sinensis
atccgaaacgctccttttggacaatttctaggtcggagtggattgttaatattctgttttttcagggtcagaattgtctttttcgacctcggaatttacacagatggatgccgctaaagtaaagaagggtgccgcagggaggaagggcggcggtccgaagaagaagccggtttcccggtccgtcaaggccggtctgcagttcccggtcggaaggatcggccggtacttgaagaagggacgctactctcagcgggtcggaaccggcgctccggtctacctcgccgccgtgctcgaatacctagctgctgaagtacttgaattggcgggaaatgcagcccgtgataacaagaagaacagaatcatccctagacacgttcttctggcagtgaggaatgacgaagagctcggaaaattgctggctggtgtgacaattgcacatggtggtgttcttccaaacatcaaccctgttctcttgccaaagaagtctgacaaggccaccaaggaacccaaatctccatccagggccaccaagtcccccaagaaagctgcttgagctttatcctctcacccaaattcatttccctctgtatgtatatttgggcttagaacaacttgtttggctgatttttaggggaaattagtgaaaaagtgtgtcatggtttttactctgtttatgttaggatttcctattgattccatggatgaaatgaaaccactcgtttcttttgtttggttatttggtttgcccgtcaatcatagttcattttcattttcaatggtcacagctttcttgat

SEQ ID NO: 15780 - DNA, 737 bp, Saccharum officinarum
cgcttcctccaaaccccaatcatcacttccctccaaatcccatttccctctcaacacccgcgactcgcgagatggacggcggcggcacgaaggtgaagaaggcggcggcggggcggaagctgggcggcggcgggccgaagaagaagccggtgtcgcggtccgtcaaggccgggctgcagttccccgtgggccgcatcgggcggtacctgaagaaggggcggtacgcgcagcgcgtcggcacgggcgcgcccgtctacctggccgccgtcctcgagtacctcgccgccgaggtcctggagctggcgggcaacgcggcgcgcgacaacaagaagaaccgcatcatcccgcgccacgtcctcctcgccatccgcaacgacgaggagctcggcaagctgctggcgggcgtcaccatcgcgcacggcggcgtgctccctccactccgtcctcctccccaagaaggccgccgagagggctgagaaagtcgcccaagaaggccgccgccgccaagtcggccaagaagtagcgtgcctgcctcgtctcatctgatcctgatctcagcttggctgagtggtcgtggatccttttgctgttcttgcgtgtctgtgtatgtagtgatgcgtcgcctcatgtgtcgtgtgtctcgatcgatctagttctggttcaatctctagctgtagtggtggttggtcatgggatctccatgttacctaagatttaatgagaacaagaggaagtgc

SEQ ID NO: 15781 - DNA, 857 bp, Juglans hindsii x Juglans regia
gggggctccacgatttccattttcagtccaatttcttcttctggtcgtttctcgaggaaattctccttttgcatcaaatttttttcggtcatggaaacggggggaaaggtgaagagaggtgctgcagggaggaagggaggcggtcccaagaagaaaccggtgtcccggtccgttaaagcgggtctgcagttcccagttggacgaatcggccggtacttgaagaaaggccgttactctcagcgtgtgggcaccggtgctcctgtttacctcgctgctgtacttgagtacctagctgctgaggttttggagttggctggaaatgccgcaagagacaacaagaagaacaggattatcccaaggcatgtgctactggccgtgaggaacgatgaagagctcgggaagcttctcgctggtgtgaccattgcccatggaggtgtccttcccaacatcaaccccgtccttctgccaaagaagcctgacaaggttgctaccaaagagcccaagtctccatctaaggccaccaagtcccctaagaaggcctgacccttcgcacaatgtgttgaacaaagtctttgtgtctctgtatgtaatttcctatctgtatttgttgcttgtaaggaagttcatgtccgtagaatttaggataccattgtactgctcgttgtttctgtccttgtagaacatcctttgctttaaattaatcagatcaaattgcagcccagttcgaatttctcgtctgttgcttcattgctaggagtcctagcaatgcccaggttgatcatgaaaatttggatcaaatatgaaggagcagggcaacgttgaaagtggagatgggaaacttttgagagtctgaaaca

SEQ ID NO: 15782 - DNA, 619 bp, Taraxacum officinale
tcaaaacccaaaacaaattcatccataattcctttcttcagagcattttagagatggagtcaaccggaaaggtgaagaagggagccgcaggaaggaaagccggcggtccaaggaagaaggcggtgacccgttcagtcaaagccggtcttcagttcccggtcggtagaatcggccggtttttgaagaaaggacgttatgctcaacgtgttggatccggtgcacccgtctaccttgctgctgtccttgagtacctagcagcagaagtgttggagttggctggaaatgcggctagggacaacaagaagaacagaataatcccgagacatgtgttgttagctattaggaatgatgaggagcttggaaagcttttggctggagttaccatcgctcatggtggtgttttgcctaacattaacccgattcttttgcccaagaagactgctgctaaagaacctaagtctccatcgaaggctactaaatctcccaagaaagcaaagtagtttagttagatatgtataagaagactttgtttttgtcttttgtttgtctggttttagagtagtttatatgttcagatgtgttcaacctctagaagaatgaaacgacttgtttttttaaa

SEQ ID NO: 15783 - DNA, 588 bp, Carthamus tinctorius
gcggggatatcaattaatcatcacttgtcaacaacacagcgagaaaaaggagaaaaaatggagactaccggaaaagcgaagaagggcgccggtggccggaaaggaggcggtccaaggaagaaggcggtgactcgctccatcagagctggcctccagttccccgtcggcaggatcggccgttaccttaagaacggccgttatgctaagcgcgtaggtaccggtgctccggtctacctcgccgccgtcctcgaataccttgccgctgaagttttggaattggcagggaatgcagcaagggacaacaagaagaacagaataatcccaagacatgttctgttggcaatcaggaatgatgatgagcttggaaagctgttggctggagtgacaattgcacatggtggtgttcttcccaacatcaacccaattctgctgccaaagaagacagctgcaaaggagcctaaatcaccatcaaaagctaccaaatctccaaagaaagctgattaggttatgaagataatgaaatggtgttgtttatctcttgtctgtaatttgtagttaatttggaaatggaatttagttttctcctaa

SEQ ID NO: 15784 - DNA, 654 bp, Solanum melongena
atcgtctctccgacaatcaattttctcttacaatcaatcaattgttgaaatggagtctaccggaaaagtgaagaagggtgccggcggcagaaagggaggtggcccaaagaagaagcctgttacccgttctgtcaaggccggtcttcagttccccgtcggtcgaattggacggtacttgaagaaaggtcgatacgctcaacgtgttggttctggtgctccggtttacttggccgccgttcttgaatatttggctgctgaagtattggaattggctggaaatgctgctcgtgataacaagaagaacagaatcattccaaggcacttgcttttggctgtgaggaatgatgaagaattagggaaacttcttgctggtgtgacaattgcacatggtggtgttcttccaaacatcaacccagttttgttgccaaagaagactggagctgagaaggcacctaaatctccatctaaagctacaaagtctcccaagaaggcttagatttgataactgtttctctttgtatgtaattctgttgttagaatgtgcttgttgattgtctttgtccttcagggatattacagaaggatttaattgggattactgttagatctttttagatttttctctgttatcaatcaatgaaacctcttgtttcc

SEQ ID NO: 15785 - DNA, 604 bp, Orobanche aegyptiaca
atatctccttcttcttattcatttcgttttctatcagatcagaaaaaatggaagccagtgggaaagtgaagaagggagccgctgggaggaagatcggcggtggtccgaggaagaaatcggttacccggtccgtgagagccggtctccagtttccggttggcaggatcggccgttatctgaagaaaggccgctatgctcagagggttggtaccggtgctccagtctacctggctgctgtgcttgagtaccttgctgctgaggttctggaattggctggaaatgcagctagagacaacaagaagaacaggataattccgagacatctgttgcttgctgtgaggaacgatgaagagctcggaaagcttcttgctggtgttacgatcgctcatggtggagttataccaaacattaaccctattcttttgcctaagaagaatgacaaggtcggtgagaagacccctaaatccccagcaaaggccaccaagtcacctaagaaggcctaaattagtgttgtcgatattggatagtgttagtgtagagccttttgtgcttttaatgtattattggtaatgattttgaaattaatggaaaattgtttacattt

SEQ ID NO: 15786 - DNA, 610 bp, Artemisia annua
ggaccacaatcacacacactcaaaacacattaaacacacacacacattttataaaaatcaaatggagggaaccggtaaaattaagaagggagcagcaggaaggaaagctggtgggccccgaaagaagtcagtaactcgatccgtgaaagccgggcttcagtttccagttgggaggattggaaggtatttgaagaaaggtcgttacgctaagcgtgttggtactggtgctcccgtttacctcgctgccgtcctcgagtatctcgcagctgaagtgttggaattggctggaaatgcagcaagggacaacaagaagaccagaataatcccgagacatgtgttgttggcgataaggaatgacgaggagctcggaaagttgttgtctggagttacgattgctcatggtggtgttttgccgaatatcaacccggtcttgttgcctaagaagactgctgctaaagaatcaacaccaaagtccccttccaaagttggaaagtctcctaagaaaaccgctgcttagattagtttgatgttgttgatttgatagtgaagttattgtagtttgtatgattagatgtaatcatttctactgaatgaaaactacttgtttctg

SEQ ID NO: 15787 - DNA, 647 bp, Artemisia annua
gattcacacacactcaaaacacacacatattcatcaactactcatttgtttaaaaaatggagggaaccggtaaaatcaagaagggagtagcaggaaggaaggctggtgggccccgtaagaagtcggttaccagatctgttaaagccgggcttcagtttccagttggaagaattggaaggtatttgaagaaaggtcgttatgctaagcgtgttggtactggtgctcccgtttatctcgctgccgtcctcgagtatctcgcagctgaagtgttggagttggctggaaatgcagcaagggacaacaagaagaccagaataatcccaagacatgtgttgttggcgataaggaacgacgaggagcttggaaagttgttgtctggtgttacgattgctcacgggggtgttttgccgaatatcaacccggtcttgttgcctaagaagactgctgctaaagaatcaacaccaaagtctccatccaaagttggaaagtcgccaaagaaagctgctgcttagattagtttgattgtgatttggggtgttttcttttggttggtttcgtagtagttaagttttagtgttgttaatttgattagatgtaatcgtttctactgaatgaaaactacttgtttctgtttaaatgtcgagcgt

SEQ ID NO: 15788 - DNA, 651 bp, Artemisia annua
tactccaacgggctctcgcgcaaatttaggttctcttagaagaccaaaagtattgttggcgggtcaagtgataccattttcttccagcctgaacacgaaaaacacacaaacacattcatcacttacccatttataaaaaacaatggagggaaccggtaaaatcaagaagggagcagcaggaaggaaagctggtgggccccgaaagaagtcggttactcgatctgttaaagcggggcttcagtttccagttggaagaattggaaggtatttgaagaaaggtcgttatgctaagcgtgttggtactggtgctcctgtttatctcgctgccgtcctcgagtatctcgcagctgaagtgttggagttggctggaaatgcagcaagggacaataagaagaccagaataatcccaagacatgtgttgttggcgataaggaatgacgaggagcttggaaagttgttgtctggagttacgattgctcacggtggtgttttgccgaatatcaacccggtcttgttgcctaagaagactgctgctaaagaatcaacaccaaagtctccatccaaagttggaaagtctcctaagaaaactgctgcttagattagtttgatgtggttgatttgatagtgaagttagtgtagtttgtatgatta

SEQ ID NO: 15789 - DNA, 950 bp, Saccharum officinarum
gtcgacccacgcgtccggagaaatcgaacgcgaaagagggtgacgagagaggggagagagaaagagaggcggggaaggagagcacgggggcttgatcggagatggatgccggagcaaaggtgccgaagaaggccgcggcggggcgtcgcggcggcggcggccccaagaagaagccggtctctcgctccgtgaaggccggcctccagttccccgtcggccgtatcggccgctacctcaagcagggtcgctacgcccagcgtatcggcaccggcgcccccgtctacctcgccgccgtcctcgagtacctcgccgccgaggtcctcgagttggcggggaacgcagcgcgggacaacaagaagaaccggatcatcccgcggcacgtactgctggcgatccgcaacgacgaggagctcgggaagctgctggccggcgtcaccatcgcgcacggcggggttctgcccaacatcaaccctgtgctgctccccaagaagaccgctgctgctgccgccaaggagggcaaagagaagaagtcacccaagaaggcggccgccaagtcgcccaagaaggcggcagccgcataggcccccggcaatgccggtgccctgtctggctgtctctcgctctctttctctgtccgctctgaactgaaacgctcctagctgtcgttgtcggtcaaggtcgttgttgcttgatgcacttgttgtggttgttcgtgtgtaattgcgtgcctttcgcccaatcagcatgtactgtgtaggttgacactggtctaggtttcgatctgggaaacgctggtttagattcaaggagtgtgatctgtgaagggcaggggagggggtgggatctgtgaatcattaggtgctgtttgtaataagattgcgaagatgtgtaaaatccgttctgtgcttccattccctgcttgattgtctggatgcgatatcttttccact

SEQ ID NO: 15790 - DNA, 752 bp, Artemisia annua
ccggggacaacaaaaacaaatacaaaaacaacttcatcttcatccaaatccaaacaatcttttacatttctaaaaatggaaacaggtggaaagaaaaagggagcagcaggaaggaaagggccagcagggccaaggaagaagtcggtgacaaggtctgtgaaagctggccttcagtttcctgttgggagaattggaaggtatttgaaaaatgggaggtatgcgaaacgtgtgggtactggtgctcctgtttatcttgctgctgtccttgagtaccttgctgctgaggttttggagctagctggaaatgctgcaagggacaacaagaagtcaaggatcataccgagacatgttctgttggctataaggaatgacgatgagcttggaaagttgttatctggtgtgactattgctcatggtggtgttcttccaaacatcaacccggttctgttgcctaagaagagtgccacaaaggaatctacccccaagtctccagcgaaagcggccaagtccccaaagaaagctgctgcttagttattgaagaaatgtaaccctttgtgatgtaggttgacttgacttttatcgtgttgtagggttatgtaggagaattgtatgctggtttgtttatgttaggacctaggtggctaggtatgaagaagaatctctcttcttcgttatcagaattttttagtttccgaatgtatgaaaatgtgtaagcttcaatttgaatgggtactacatttgattgcaaaaaa

SEQ ID NO: 15791 - DNA, 741 bp, Artemisia annua
cggggacaacaaatacaaaaacaacttcatcttcatccaaatctaaatccaaacacaaactttttatatatttctaaaaatggaaacaggtggaaagaaaaagggagcagcaggaaggaaagggccatctggcccaaggaagaagtcggtgacaaggtctgtgaaagctggccttcagtttcctgttgggaggattggaaggtatttgaaaaatgggaggtatgctaaacgtgtgggtactggtgctcctgtttatcttgctgctgtccttgagtacctcgctgctgaggttttggagctagctggaaatgccgcaagggacaacaagaagtcaaggatcataccgagacacgttttgttggccatcaggaatgacgatgagctaggaaagcttttatctggtgtgactattgctcacggtggtgttcttccaaacatcaacccggttctgttgcctaagaagagtgccacaaaggaatctacccccaagtctccagcgaaagcggccaagtccccaaagaaagctgctgcttagttattgaagaaatgtaaccctttgtgatgtaggttgacttgacttttatcgtgttgtagggttatgtaggagaattgtatgctggtttgtttatgttaggacctaggtatggagaagaatctctcttctttgttatcagaatttttagtttccgaatgtatgaaaatgtgtaagcttcaatttgaatgggtactacatttgattgc

SEQ ID NO: 15792 - DNA, 751 bp, Artemisia annua
aaaaacaaatacaaaaacaacttcatcttcatccaaatccaaacaatcttttacatttctaaaaatggaaacaggtggaaagaaaaagggagcagcaggaaggaaagggccagcagggccaaggaagaagtcggtgacaaggtctgtgaaagctggccttcagtttcctgttgggagaattggaaggtatttgaaaaatgggaggtatgcgaaacgtgtgggtactggtgctcctgtttatcttgctgctgtccttgagtaccttgctgctgaggttttggagctagctggaaatgctgctagggacaacaagaagtcaaggatcattccaagacatgttttgttggctataaggaatgacgatgagctaggaaagttgttatctggtgtgactattgctcacggtggtgttcttccaaacatcaacccggttctgttgcctaagaagagtgccacaaaggaatctacccccaagtctccagcgaaagcggccaagtccccaaagaaagctgctgcttagttattgaagaaatgtaaccctttgtgatgtaggttgacttgactgttatcgtgttgtagggttatgtaggagaattgtatgctggtttgtttatgttaggacctaggtggctaggtatgaagaagaatctctcttcttcgttatcagaatttttagtttccgaatgtatgaaaatgtgtaagcttcaatttgaatgggtactacatttgattgcaaaagatggtgatgttt

SEQ ID NO: 15793 - DNA, 735 bp, Artemisia annua
caacaaatacaaaaacaacttcatcttcatccaaatctaaatccaaacaaacttttttaacatttctaaaaatggaaactggtggaaagaaaaagggagcagcaggaaggaaagggccagctgggccaaggaagaagtcggtgacaaggtctgtgaaagctggccttcagtttcctgttgggagaattggaaggtatttgaaaaatgggaggtatgctaaacgtgttggtactggtgctcctgtttatcttgctgctgtccttgagtaccttgctgctgaggttttggagctagctggaaatgctgctagggacaacaagaagtcaaggatcataccgagacatgttctgttggctataaggaatgacgatgagcttggaaagttgttatctggtgtgactattgctcacggcggtgttcttccaaacatcaacccggttctgttgcctaagaagagtgccacaaaggaatctacccccaagtctccagcgaaagcggccaagtccccaaagaaagctgctgcttagttattgaagaaatgtaaccctttgtgatgtaggttgacttgactattattgtgttgtagggttatgtaggagaattgtatgctggtttgtttattttaggatctaggtatgaagaagaatctctcttctttgggttatcagaatttttagtttccggatgtatgaaaatgtgtaagcttcaatttgaatgggtactacatttgattgc

SEQ ID NO: 15794 - DNA, 727 bp, Artemisia annua
caacttcatcttcatccaaatctaaatccaaacacaaacttttatatttctttctaaaaatggaaacaggtggaaagaaaaagggagcagcaggaaggaaagggccagcagggccaaggaagaagtcggtgacaaggtctgtgaaagctggccttcagtttcctgttgggaggattggaaggtatttgaaaaatgggaggtatgcgaaacgtgtgggtactggtgctcctgtttatcttgctgctgtccttgagtaccttgctgctgaggttttggagctagctggaaatgctgcaagggacaacaagaagtcaaggatcataccgagacatgttctgttggctataaggaatgacgatgagcttggaaagttgttatctggtgtgactattgctcatggtggtgttcttccaaacatcaacccggttctgttgcctaagaagagtgccacaaaggaatctacccccaagtctccagcgaaagcggccaagtccccaaagaaagctgctgcttagttattgaagaaatgttaccctttgtgatgtaggttgacttgacttttatcgtgttgtagggttatgtaggagaattgtatgctggtttgtttattttaggatctaggtatgaagaagaatctctcttctttgggttatcagaatttttagtttccgaatgtatgaaaatgtgtaagcttcaatttgaatgggtactacatttgattgcaaaa

SEQ ID NO: 15795 - DNA, 740 bp, Zingiber officinale
gaggggaaggtaggacgcggggggattgtttcgcgactctcgcccaattgtatcaggggtcttttcggtccaaaccggcacgttacactcgagggcggagatggagacaggtggcaaggcgaggaagggcgccggcggccggaggggcggcggcggacctaagaagaagccggtctctcgatcggtgaaggccggcctccagttccccgtcggtcgcatcggccgctacctcaagcacggacgctacgcgaagcgcgtcggcaccggcgctcccgtctacctcgccgccgtgcttgaataccttgcggccgaggtgctggagctggcggggaacgcggcgagggacaacaagaagacccggatcgtaccgcggcatgtgctgctggcgattaggaacgacgaggagctagggaagctcctcgctggcgtcacgatcgcccatggaggggtgctgcccaacatcaacccagtgctgttgccgaagaaaaccgccagcaaggagcccaagtcgccgagtaagcccgccggcaaatcgcccaaaaaggcttgatttggagctccagttctcgcccttgttctttatccgtaagtaatttttatggtaaaattagcttctttttcccccttttgtctggtggactggtggaatgtaatgtggatgactgatgtgatcgaactaagcagtattaacctgtgcaatctagtatgattctaattcttgttattcgcgttacatcttt

SEQ ID NO: 15796 - DNA, 580 bp, Cucumis sativus
aaaaccattcccgcaagttcaatccttctcatcgtcatatccactcacccaattccattttcttctcctacccttttgattttacggtgacccgactctagttcccatggaaaccggcggcaagttgaagaagggagctggtggaagaaagggcggtggcccgaagaagaagccggtttcgcgttccgttaaggccggcctccagttccccgttggtaggatcggtcgatacttgaagaatggacgatatgctcgtcgtgttggtactggagctcctgtctacttggccgccgttcttgagtatcttgccgctgaggtgttggaattggctggaaatgcagccagagacaacaagaagaacagaataattcctagacatgtattgttggccataaggaatgatgaagaacttgggaaattgcttgctggtgtaacaattgcacatggtggtgttcttccaaacataaacccagttcttttgccaaagaaaagtgagaaagcaactactaaagaaccaaaatctccatcaaaggctcctaaagcaactaaatctccaaagaaagcttagattttttttttt

SEQ ID NO: 15797 - DNA, 647 bp, Solanum melongena
atcatctctccgacaatcaatttttcttacaatcaaatagttgttgaaatggagtctaccggaaaagtgaagaagggtgccggcggcagaaagggtggtggtccaaagaagaagcctgttacccgttctgtcaaggccggtcttcagttccccgtcggtagaattggacggtacttgaagaaaggacaatacgctcaacgtgttggttctggtgctccggtttacttggccgccgttcttgaatatttggctgctgaagtattggaattggctggaaatgctgctcgtgacaacaagaagaacaggattatcccaaggcacttgcttttggctgtgaggaatgatgaggaattagggaaacttcttgctggtgtgacaattgcacatggtggtgttcttccaaacatcaacccagttttgttgccaaagaagactggagctgagaaggcacctaaatctccatccaaagctacaaagtctcccaagaaggcttagatttgattactgtttctttttgtatgtaattctgtttttagaagctgttgattgtcctttatggatattgaaatgggattagttggaactactgttagatctttgttagtttttcctccattatcaatcaatgaaactccttgtttcgactc

SEQ ID NO: 15798 - DNA, 829 bp, Orobanche aegyptiaca
catatattcttttcttcatttctttttctatcattcacttctaccacaccaaagaaatatggaagccagtgggaaagtgaagaagggagccgctgggaggaagatcggcggcggtccgaggaagaagtcggttacccggtccgtgagagctggtctccagtttccggttggcaggatcggccgttatctgaagaaaggccgctatgcgcagcgcgttggtaccggtgctccagtatacgtggctgctgtgcttgagtaccttgctgctgaggttctggaattagctggaaatgccgcgagagacaacaagaagaacaggataattccgagacacctactgcttgctgtgaggaacgatgaagagcttgggaagcttcttgctggagttacgattgctcatggtggagttataccaaacatcaatcctgttctgttgcctaagaagaatgagaaggacggtgagaagacacctaaatccccagcaaaaaaggccaccaagtctccgaagaaggcataaattagtgtttattgttgaatctgtgatcgaatcacttttgttttcatcaggggttatgttcttgtgtttaggcggagacggtgtttataacttttgtagtaatttgtattttatcctttttagtagttattctgttaaatcccattatttaaatttaatggaaagacagtttccttttcaatttcatatgaatttttttttttttttatttttgacttgttcttcgctggactttgcgtttgaattttcttggaactttttccagtagcacaaaactccgtttatttccacaccggatagttattctttggt

SEQ ID NO: 15799 - DNA, 1056 bp, Saccharum officinarum
gaaccagccaagagccatcagtctccactgtgactgtgactccgtgagctgcctgccctgcacactccccgcaccgccgcaccagctcagcaatcatggctcgcctactcctcctcgccgccgccgcagcggcgttcctggccgcgtcggctgcatcgccggtggccagcgacttcatccgcaagtcgtgccgcgcgacgcagtacccatcagtgtgcgagcagagcctggcgtcgtacgggggctccccgccgccgcggagcccgcgggagctggcgcgcgcggcgctgtccgtgagcgcggaccgcgcgcgcgccgcgtccgcgtacgtgggccgcctctgcggcggctccggctccgggggttcccgtggcgccggcgcaaagggcgcgaagaaggggtcggggtctgcggcatcggcggcgggccccgtgcgcgactgcctggagaacctggcggacagcgtgggccacctccgcgacgcggcgcaggagatgggcggcgccgggatgtcccgcgcgggcacgcccgcgttcaagtggcacctcagcaacgtgcagacctggtgcagcgccgcgctcaccgacgagaacacctgcctcgacggcctctccgcccgcggcgtcgacgccggcacgcgcgcagccatccgcggcaaggtcgtcgaggtcgcgcaggtcaccagcaacgcgctcgccctcgtcaacaaggtcgggccagggtactagcccaagacccaggcccagatctaggcccaagctcagtccatataacaccccttggccccagatggaccagatgttcgttgttatgcgtcggttagaaaaaaaaaaactagttcggttttccatgtgttttttttaactagtgcttcctgcatatatatgctttgcttgtgtggtgtaagatacagttaagggcgataaacttgtattttgggtggtgagaagtacagtaagacgtatgtactcctctgtccgatcctgtcacggcaaataaagctaagtgtcatcgttaacatggatatggtctttgaaaatatacattcttttacac

SEQ ID NO: 15800 - DNA, 1234 bp, Nicotiana tabacum
cacgacattctcctctctcaaaattagcaaagctcaaatttaacatcttatgagtctattttttggtgaacaaatggctaaggacactgaagttggcacagaatacgccccaaaagactaccaagacccaccccctgcacccttaattgaccctgaggagctaggaaaatggtcattttacagagccataatagctgaattcatagccactttattatttctctacattactgtcctcactgtgattggatacaagagccaaattgaccctgaccataacggtgaacaatgtggtggtgttggaattctaggaattgcatgggcatttgggggcatgatttttgtccttgtttattgtactgctggtatttctggtggacatattaaccctgctgttacatttggactattcttggctaggaaagtgtcgttggttcgcgcaattatgtatatgttggctcagtgtttaggagccatctgtggttgtggtttggtgaaggcatttcagaaggcgtactatgttaagtatggtggtggtgctaatacgttgaatgatggttataatacaggtaccggtttgggtgctgaaattattggcacatttgttcttgtttacactgtttttgctgctactgatcctaagagaaatgccagagactctcatgttcctgtgttggcaccacttccaattggatttgctgtgtttatggttcatttggctacaattcctgtaactggaactggtattaacccagctagaagttttggagctgctgttatttatggtaaagaaaaagcatgggatgaccaatggatattttgggttggacctttcattggagctgcaattgctgcattttaccatcaattcatattgagggctggagcagtcaaagcacttggttcattcaggagcaatgcctaattaatcacgagaatctgcaattgtatatttgagaaaagtctctctaaattatgcttttcatttagtagagtggtcttggttgtttggcactttttttaaaatgtgccaaatatttgtcagtgctgcttttcttcttgtttcccttgcttgttttttgtttgtgtatgtaatttttcttatgcttgtttaagatgcaaaataatggaatgtgtaagactattatatttaacttttttttttcaccaaattaatatacaaaatagcattttgttcacttggaaaaggaatatgacaaattattcttactgg

SEQ ID NO: 15801 - DNA, 1172 bp, Antirrhinum majus
ggaattcgcggccgctcaaacattctattctataacacaaatattcctcatttttctctctagcaaaaaagagaagaagtgaaaatggcaaaggatgctgaggctggaaccgaatacggagccaaggactaccacgacccgccacccgccccgctattcgaccctgaggagttgggcaaatggtcattttacagggccataatagctgagtttgttgccacactattgtttttgtacataactgtattgacagttattggttacaaaagccaaagcgccaccgatgagtgcggtggcgtcggtattctcggcattgcttgggcctttggtggcatgatctttgttcttgtttactgcaccgccggtatttctggagggcacatcaaccccgcggtgacgttcggccttttcctcgcccgaaaagtgtctttggtccgaactattctctacatagtggcgcaatgcctcggggccatctgcggttgcggactagtgaaagcgttccagaagtcgtactacaatagatacggcggaggcgctaatagcctggcagacggttacagcaccggcaccggattggcggccgagattatcggaacttttgtccttgtttacactgtcttctctgccactgaccccaagagaagtgccagagactcccatgttcctgttttggcaccacttcctattggatttgctgtctttatggttcatttggctactattccaatcacgggtacgggtattaacccggcccggagttttggagctgctgtgatctttggcagtgagaagtcctgggacgatcattggattttctgggttggaccactaattggagcagctattgcagcaatttaccatcagtacattttaagggcaggagcaattaaggctttgggatcattcaagagcactcctaattactgagaatcaactcaggaaacgcaaattatggattggatttaagatattgcaatgtctaaaggacttcagctcattgaagaaattgtaaattaagtcaaaatgtgtgataggggtgtgaggggcagttgttttaagtgtgcccatgtttttctttgttttgttttggcaactcttttcttcggtttatggtgttttaagctttgaaataatcgtaataatacgaacttccaagttccaagtgttta

SEQ ID NO: 15802 - DNA, 919 bp, Carthamus tinctorius
atccctctctctcactctcagaatcatatatagaattaattttgggcatatacataatatatggggaaggacgttgaggttggtggtcatgattacggtgcaaaagattaccaagaccccccgccggctaaacttttcgacgccgaggaactaaccaaatggtctttctacagagccatcattgctgagttcgttgcaaccctcttgttcctttacatcaccgtcttgactgtcatcggatacaagtcacagaccgaccccatccacagccccgaccaatgcggtggcgttggaatcctcggcatcgcttgggcctttggcggcatgatcttcattctcgtatattgcaccgccggcatctccggtggacacattaaccctgcagtcacattcgggttgttcttggctcggaaggtgactctaccaagggcggtcatgtacattgtggctcaatgcttgggtgccatctgcggttgtggtctggtgaaggctttccaaaagacttactacgacgattacggtggtggtgccaacgagctcgccgatggctacaacaaaggcacgggtttgggtgcggaaatcatcggcacctttgtgctcgtatacaccgtcttctcagccactgatcccaagagaaatgcccgcgattcccatgtccccgtgttggcacctcttccaatcggattcgcggtgttcatggttcacctggccacaatcccaatcaccggcaccggaatcaaccctgctcgtagtttcggtgcagccgtcatctatggaaaagacaaagcatgggatgatcaatggttattctgggtgggaccgatgatcggagccgccattgctgccatctaccaccagtatgtgttgagagcaggagcagtgaaagctcttggatccctcaggagcaatgcctaggaaa

SEQ ID NO: 15803 - DNA, 1404 bp, Juglans hindsii x Juglans regia
tgtgttggtcccggggatcggccattacggccggggacccatcacaaccacaaaacacaacacacttccctactgttcatttcctctttctgaaaactctttgttctttcgctgatctgtgatcatcagttgcttgtgaagccaagacgtaattagtgagaaaaatgggaaaggacgttgagggtgcggagcagggagagtactcggccaaggactaccaggatccacctccggcgcctttgatcgacccggaggagctgacaaagtggtccttctacagagctctgatagcggagttcatagccactcttcttttcctttacatcacagtcttgactgtgatcgggtacaaggtccagagttctgcccccgacgccgacgattgcgctggagtcggcattctcggcatcgcttgggcctttggaggcatgatcttcatcctcgtttactgcaccgccggtatctctggaggacacattaacccggcagtgacgttcgggctgttcctggctcgaaaggtgtcgttgataagggcggtgctttacatggtggcgcagtgcttgggagccatatgcggagttgggcttgtgaagggcttccaaaagactcactacaaccagaacggaggtggtgccaacgaactggcaccagggtacaacaagggcgttggactcggggctgagatcatcggtacctttgttcttgtctacactgttttctcagccactgatcctaaaaggagcgccagagactctcatgttcctgtgttggcaccactccctattggcttcgctgtgttcatggttcacctagcaacaatcccaatcaccggtactggtatcaacccagctagaagtttcggagccgcagtgatctacaaccaggacaaggcctgggatgaccaatggattttctgggttggaccatttattggagctgcaatagctgccttctatcaccaattcatcctcagagcaggagccattaaggctctaggttccttcagaagtaacgcttaagcttttcctccccgaccatgaaataatatcctcaaagatcgatggagatggatggtcatcatgattcaaaagaataacaatatcatagtgcatgcatgcaagttgtctgatcagggtccccttttatctatcagtttctgtttctcatgggttggagagctgtaaatggaggaccatggaattgtagataaacatggctatgggcagggtgtttctttcttcttttttattttttttccctttgatctgcatgtatttatgtactgctgattctcttccttgtttatccgtaatttattttgctttttggtgtactcatgttgtttctaccttaagctattaaaatgggttgtggacttgtggtcctgataactcctcagtgtcc

SEQ ID NO: 15804 - DNA, 1173 bp, Actinidia deliciosa
cacagtgtgtgcggagaatcccccctcaccacttgcgatctctctctctctctctctctctctctctctagaaagtgatccaataaaatgggcaaggacacggagatgacggagcaggggtctttctcggcgaaggactaccaggatccgccgccggcgccgctgatcgacccaaaagagctggggaagtggtcgttctacagggccctgattgcggagttcatcgccactctcctcttcctatacataacggtgttgacggtgattgggtacaagagcaacaagagcgcagacccgtgcgacggcgtgggcatactgggcatcgcctgggcctttggaggcatgatcttcgtccttgtctactgcaccgccggtatttctgggggtcacattaacccagcagtgacgttcgggctattcctggcgaggaaggtgtcgttgatccgggcggtgatgtacatggtggctcagtgcttgggggccatatgcggcgtgggcctggtcaaggcattccagaactcctactacgacaacaacgggggcggcgccaacatgctcgcctccggctacaataagggtaccggtttgggagcagagatcatcggaacctttgtcctcgtctacaccgtcttctctgccaccgatcccaagaggagcgccagagactcccatgtccctgtgttggcaccacttccgattgggtttgcggtgttcatggttcacctggccaccatcccagtgacggggacgggcatcaacccagcaaggagttttggagctgcagtcatctacaacaaatccaaggcttgggatgaccattggatattttgggttggacccttccttggtgcagccattgcagccttctaccaccaattcatcttgagagcaggagccattaaagctctgggctcattcaggagcagctcccatgtctgatagatttgtcattggatcagcaaccaaacaacaaaaagtttcaaaccatatcatcaaataataatggaattagcttttgtattgcgtttgaaggtttcttaatttggatcgaccttagtctctctgatttatatatatcatggatggttaagagctgagtggagaacagcacttgagaggcatggaaatgtagattcaaaaaagtctcttttggaaagggaaagtttttatgta

SEQ ID NO: 15805 - DNA, 1066 bp, Mesembryanthemum crystallinum
atcaccaaaagcacctctcaagtctaccacaaccctttctctctcttgtttctctctctaaaaccacacacgccatgactaaggacgtggaggtggcagagcagcaagctcctgagttctcggcaaaggactaccatgaccctccaccggccccgctgatcgatttcgaggagctgagaaaatggtccttttaccgggctgttatagctgagttcattgccactcttttgtttctctatatcactgtccttacggtgattgggtacaagagccagactgatcccaacacgaacgctgaccaatgtggcggggttggcatccttgggatcgcctgggcctttggtggcatgatcttcatccttgtctactgcaccgctggtatctctggagggcacatcaacccagcagtgacctttgggttgttcttggcaaggaaggtgtcactgattaaagcagtgctatacatggtagcacagtgcctaggtgccatctgtggtgtggggtttgtgaaggccttccaaaaggcctactatgtgaggtatggtggtggcgccaacgaaatggcttccggctacaccaagggtactggtctcggtgctgagattattggcaccttcgttcttgtctacactgtctttgctgccactgatcccaagagaaacgctagagattctcacgttcctgtattggcaccacttcctattgggttcgcggtgttcatggttcacttggccaccatcccaatcaccggcactggcatcaacccagctagaagtttcggagctgccgtgatctacaaccaacagaaggcctgggatgatcattggattttctgggttggaccattcattggggctgcaattgcagcattctaccatcagtacattctaagagctgctgcaatcaaagctctcggttccttcaggagctctgcataatttgtgaaggaatcatttccttttaactcctctgggttaattggctaatggcatctactatggagttataaaaggagagaggaacaaatgaaattgtagataaaagaaaaaccaggaaaaaaacaatg

SEQ ID NO: 15806 - DNA, 1343 bp, Carica papaya
gtgctcacactccaaacacggccaaagagtttcatctactccattctccctggttctcttctgcttctctccgaattctgagaaatagttgagcgataatgacgaaggatgcaggagagcatggatccttctctgcaaaggattaccacgacccgccaccggcgccgttgttcgacgccgtggaactgaccaaatggtcgttctacagagccttgattgccgagttcattgccactctgctctttctctacgtcactgtcttgacggtgatcgggcacaagagccagcacgctgctgaccagtgcggcggcgttgggatactcggcatcgcttgggctttcggaggcatgatcttcattctcgtttactgcaccgctggtatttctggtggtcacataaacccggcagtgactttcggtctgttcttggcccggaaggtgtctctggtgcgagccgtgatgtacatggtggctcagtgccttggcgccatctgcggagtgggtttggtgaaggctttccagaaatcgttctacaacaggttcggcggcggcgccaacaccctcgcagacggctacaacgtaggcaccggactgggtgcggagatcatcggaaccttcgttcttgtctacactgtcttctccgccaccgatcccaagagaagcgccagagactctcatgtccctgttttggctccactgccaattgggtttgctgtattcatggttcacctggccaccattccagtaactggcactggcattaacccagccaggagcttcggagctgctgtcatcttcaacgacaaaaaggcctgggatgaccattggattttctgggtaggacccttcattggtgcagcaatagcagccttctaccaccagttcatcttgagagctgcagctgtcaaggctcttggatcattcaggagccaaagccatgtctgatttctgatcctacccatcatcttcttgcttccttgttacctaacttattgtttttaatttatggggggaagaagaagaagaagaaagaaagaaaaagcagaagaagagttgaaagaaaataatgggggagaaaaagtgcttttgtggttgtgaagcttttaccttttatttatggggatggtaaatgtgatggggaattgtagattaaagtctcctttttccttttttcttaagaaaaatttggtgccttttgggtatctttggttttcattttgggttccatttatagggcacttgccttagaatttactttcacaaagtgttctatcactatctcttcctttctatatatattctctactttggtactcattaatattttaccatgcttttatctct

SEQ ID NO: 15807 - DNA, 1071 bp, Raphanus sativus
aaataatattaaatggcgaaagatgtggaaggagcagagggagtcacagcgagggactacgaagatccaccgcctactccctttttcgacgcggaggagctcacgaagtggtctttgtacagagccgtcatcgccgagttcgtagccactctcctcttcttatacatcaccgttttgactgtcatcggctacaagatttcctccgacactaaggccggaggcgatgaatgcggtggcgtcggaatcctcggcatcgcctgggctttcggcggcatgattttcattcttgtctactgcaccgccggtatctcaggtggtcacataaacccggcggtgacgttcggcttgttcttggcccgcaaggtatcgctggttagagcggtgctatacatggtggctcagtgtttgggtgccatatgtggagttgggttcgtgaaagcctttcaaagcgcttactacgtgcgttacggcggaggagcaaactctctggccgatggatacagcacagggacaggactcgccgcagagatcattggaacttttgttcttgtctacactgtgttctccgccacagaccccaaaagaaatgcacgtgactcccacgttcccgtgttggcgccacttccgattggatttgcggtgttcatggttcacttggccactattccgatcaccggaaccggtattaacccggccaggagtttcggagccgcggttatctacaacgagtccaagccgtgggatgaccactggatattctgggtgggaccattcattggagccgccatcgctgcattttatcaccagttcgttctaagagcttccggttccaagtcccttgggtccttcagaagtgcggcctaaggaaacaattacaaaatggttgttatggtgtgtgtacaaatttggcaagttctaaaactgtgctctctgttttttttcttttgcctttcctaatttgtggcatcagtgtgggatataagtgaatgcttgtgtgatgggggaaaataatcttactgaaatcaaatttgtttttgtctcaacatttacaaaagaaaaaatgttagtaag

SEQ ID NO: 15808 - DNA, 1162 bp, Raphanus sativus
aaccacacaacagagaagcaaaagaaaaaccattttttggaaagaaaaaaaactccaaagaaagtagatatggcgaaggacgtggaagccgtttctggagaagggtttcagacaagagactatcaagatccaccaccggcgcctctgtttgatccggaggagctgaccaagtggtctttttacagagcagtcattgccgagttcgttgctactctcctcttcttgtacatcaccgttttgacagtcatcggttacaagattcagaccgatagtactgccggcggcgttgactgcggtggagttggtatcctaggtatcgcttgggcttttggtggcatgatcttcatccttgtttactgcaccgccggtatctctggtggtcacattaacccggcagtgacatttgggctactcttggcacgtaaagtgtcgttggttagagccatattgtacatggtagctcagtgtttgggtgcgatatgtggagttgggttcgtcaaagccttccaaagctcttactacgtccgttacggcggtggagccaactctctagccgacggctacagcacaggaaccggcctcgccgcagagatcattggtacttttgttcttgtctacaccgtcttctccgccactgaccctaaacgcagtgccagagactcccacgttccagtgttggcgccacttccaattggatttgcggtgttcatggtgcacttggctaccattcccatcaccggaactggtattaacccggcaaggagtttcggagcagccgttatcttcaacgagagcaagccctgggatgaccactggatattttgggtgggaccatttattggagctgcgattgctgcattctaccaccagttcgttctgagggcttcaggttccaagtctcttggatctttcagaagtgctgcaaacgtctaaataatcactcatctccaccgtagcagattctgaaataataaagatgataaatcttttttctctatgtacaaaattatccaaatcagttccagtctgttattttcttaaatgtgtgttttctacttgctctttttcgttgagtgtaattgttcttatattaggccaatgccaagtttatcaagtgactggaattgaaaataaaaaaaggttatggttgagtttgcgtttt

SEQ ID NO: 15809 - DNA, 1225 bp, Raphanus sativus
ggaaaaccagagcacatgttcctctcactaaccacacaacagagaagcaaaagaaaaaccatttgttggaaagaagaaaaaaccaaagaaagtagttatggcgaaggacgtggaagccgtttccggagaaggttttcagacaagagactatcaagatccacccccggcgcctctatttgatccggaggagctgaccaagtggtctttttacagagcagtcattgccgagttcgttgctactctcctcttcttgtacatcaccgttttgacagtcatcggttacaagattgagaccgatagtactgccggcggcgttgactgcggtggagttggtatcctaggtatcgcttgggcttttggtggcatgatcttcatccttgtttactgcaccgccggtatctctggtggtcacattaacccggcagtgacatttgggctactcttggcacgtaaagtgtcgttggttagagccatattgtacatggtggctcagtgtttgggtgcgatatgtggagttgggttcgtcaaagccttccaaagcgcttactacgtccgttacggcggtggagccaactctctagccgacggctacagcacaggaacaggcctagctgcagagatcattggtactttcgttcttgtctacaccgtcttctccgccactgaccctaaacgcagtgccagagactcccacgttccagtgttggcgccacttccaattggatttgcggtgttcatggtgcacttggctaccattcccatcaccggaactggtattaacccggcaaggagtttcggagcagccgtcatcttcaacgagagcaagccctgggatgaccactggatattttgggtgggaccatttattggagctgcgatagctgcattctaccatcagttcgttctgagggcttcaggttccaagtctctcggatctttcagaagtgctgcaaacgtctaaataatctctcatctccaccgtagcagattctgaaataataaagatgataaatcttttttctctatgtacaaaattatccaaatcagttccagtttgttatcttcttgtttgtgttttctacttgctcttttgtggattttcgttgagtgtaattgttcttatattaggccaatgccaagtttatcaagtgactggaattgaaaatcaaaaaaaggttatggttgagtttgggttttcatgtataaacccacattttttttggta

SEQ ID NO: 15810 - DNA, 1191 bp, Carica papaya
acacttacatctactaatcgcaattaccactgtgattaccaattaatcaacacttaattaacgatgacgaaggacgtggaggttgcggagcaaggggagttctcggcgaaagattaccacgaccctccaccggcgccgttaattgacgtcgaggagctgacgaaatggtcgttttacagggcactaatcgcggagttcgtagccacacttctgttcctatacgtaacggtgttaacggtgatcggacacaaaagccagactgatttaacgaaggccggcaccgacgtgtgcggcggcgtcggccttctcggaatcgcttgggccttcggcggcatgattttcatccttgtttactgcactgctggaatctctgggggacatataaacccggcggtgacgttagggttgtttttggcgcgaaaggtgtcgttgatccgggcgattatgtacatggtagcacagtgtttgggtgctatctgcggtgtgggattggtcaaagcgtttcaaagttcattctataataggtatggtggtggggccaactcgctgaatggtgggtacaacaaggggactggattgggtgcggagataatcgggacctttgttcttgtctacacagtgttcgcggccactgatcctaagagaaatgcacgggactcccatgttcctgtatgggcgccgctcccgattgggtttgctgtgttcatggttcacttggctacgattccaataactggaactgggattaacccagctaggagttttggagcttgctgtgattttcaacgatgagaaagcctgggatgaccactggatattctgggtcggaccatttattggagctgcaattgctgcaatttaccaccagtacgttctcagagccgcagccattaaagctcttggatccttcagaagcaatgcttaattaattaagcttaattactgccgtcgataattatcaattatcaatcaataaacaaattaatgggcaaaatttgggtgatggtgataaaaattattaaaacaacaaaaaaaaaagaaaaaaagaaagagtgcttgcaatgcaaagtctgtgatcttgagggtttcttctgcaacatctctttatgatctctcttatggattatagagagagagagataacccatgaaattgtaaataaaaatattttatgaatttcttttttttttt

SEQ ID NO: 15811 - DNA, 930 bp, Nicotiana tabacum
gccggggacctaaaaacagagttttcagcaacagagtactgttgaatagatagtgatgggaaaagacgtagaagcagcaacggagttttcagcaaaggactacacggacccaccgccagcacccttgattgattttgaggagctgaaacaatggtctttttacagagctgctattgctgagtttattgccactttgttatttctttacgtaactgtactcactgtgattgggtacaagcaccagtcggacgttgacgctaatggcgacgtctgtggcggcgttggcatccttggtattgcttgggcatttggtggcatgatctttgttcttgtttactgcactgctggtatctcagggggacacattaacccggcagtgacatttgggctgttcttggcgaggaaagtgtcactgatcagggccttggtgtatatggtagcacagtgcttgggtgcaatatgtggtgtgggttttgtgaaggcttttcagagcgcttactacgacagatacggtggaggtgctaatgtgatggctgctggccatacaaagggtgtcggtcttgctgctgagatcattggtacctttgttttggtctacactgttttctctgccactgaccccaaaagaagcgccagagactcccatgtccccgtattggctccacttcccattggattcgcagtattcatggtccacttagccaccattccaatcaccggaaccggtatcaatccggctaggagtttcggagcggccgtgatttacaaccaggacaaggcatgggatgagcactggattttctgggtcggtccatttatcggagccttcgccgccgccgcctaccaccagtatatcctccgagctggtgccgtcaaagctctcggttccttcaggagcaatgcctaagacttctcattgctcaatatgat

SEQ ID NO: 15812 - DNA, 1366 bp, Mesembryanthemum crystallinum
aattcggcaccttcatcacttcactctctgctctccctctctctttgctacccaaaccagagttgagcaattgaactccaatttccaaccaaaaatggcgaaggattttgaaacaggaggaggagaagtgagagatgtagccaaggactaccaagacccgccaccatcgccgctgtttgatatggaagagctaactaagtggtcgttttacagggcgctaattgctgagtttattgcaactctcttgttcttgtacatcactgtcttgactgtgattgggtacaaacaccagtcggatcccctcgtcagcggcgccgacgctggttgcggtggtgttggcatccttgggattgcctgggcctttggtggcatgatctttattcttgtttactgcactgccggtatctctggtgggcacatcaacccagcagtgacattcgggctgttcttggcccgaaagctgtctctaatccgagccattatgtacatggtagcccaatgcttgggagcaatttgcggtgttgggtttgtaaaggctttccaaagtgcttattataacaagtacggaggtggagccaacgagctaagcgtcggctacagcaagggaacaggattagctgctgagattattggcacttttgttcttgtttacaccgttttctccgccactgacccaaaacgcagtgctagggactctcatgtgcccgtattggcacctcttccaattgggtttgccgtgttcatggttcacttggccaccatcccaattaccggcacaggtatcaaccctgctcgtagtcttggtgctgctgtgatctacaacaacaacaaggcctgggatgatcagtggattttctgggtcggaccgttcattggggctgccatcgccgccatctaccaccaatacatcttacgagctggcttcatcaaagcacttggttcttttaggagctcaacctcaaacgtgtgatcaccataagggatccatttctgtgaaagcagtgtggattttggttacagcaaggattggttgttgcttatttttcttaatctgcctaaaagagtgggatttgaggctttgcaaagttgtaaataagattttagttgtcatttggtggaaaaggtttgtctacctaagtcattgtttgtgtttcatggcccatgggcacttcttttcattgtgtgcctaatgtgggtatcattttctagttgattctcttttctctctccctttttttattatttttttttatttttgggtcttttcttctctttgtggaacctttttctgaatttgatgaataaatgtcgaattgatttactgatttctccattttaagaaatgaattatctccattgtagtatt

SEQ ID NO: 15813 - DNA, 1306 bp, Pseudoroegneria spicata
cccaagccccacctccatttttctagttagtctcttgcagggctgcagcgagaacaaacagcaaagccacgccgatggcgaaggacgaggtgatggagaccggcggcggcggcgacttcgctgccaaggactacacggacccgccgccggccccgctgatcgacgcggcggagctggcctcgtggtcgctgtaccgcgccgtcatcgccgagttcatcgccacgctgctcttcctctacatcaccgtggccaccgtcatcgggtacaagcaccagacggaccccgcggtgaacgccgccgccgacgcggcgtgcggcggcgtgggcgtgctcggcatcgcgtgggccttcggcggcatgatcttcgtcctcgtctactgcaccgccggcatctccggcggccacatcaacccggccgtgaccttcggcctcttcctggcgcgcaaggtctccctggtccgcgcgctgctctacatgattgcgcagtgcctcggcgccatgtgcggggtcggcctcgtcaaggccttccagagcgcctacttcgtcaggtacggcggcggcgccaacacgctcgccgccggctactccaagggcaccggcctcgccgcggagatcatcggcaccttcgtgctcgtctacaccgtcttctccgccaccgaccccaagcgcagcgcacgcgactctcacgtcccggtgctggcgcccctcccgatcggcttcgccgtgttcatggtccacctggccaccattccgatcaccggcaccggcatcaacccggccaggagcctgggcgccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcataagaagctatccatgtcatctgcatgcaagattgaagcaatggcgacctgtgttgtgtccatccagagacaaaaggcgcttttacaacttctcaacagttcagttggccgctgcaatgcaatggtcgtgttatttatgtgtcggcagctgcatatgcgtagtacgtggttggcttcttccatgtgcccggtcctgcgtgccgtgtgttgtaatccggtccatgggatcgatcgcttgtcttaattagcccgcattgcttttcctatttaaatttagcgaccatatgattatgatcgatccaaccttgtatccagtcatcaaatccatcaagcatcccgagtggtggtactcttgctttcta

SEQ ID NO: 15814 - DNA, 1199 bp, Lotus japonicus
ttcagatagagctcattctctgtgcaagctttatctgagagaaaaacactccactctctgttcttcttcttcctcctcctcccatggcgaaagacatcgaaaccgaagcaccgcgaggtgatcagttggcacacaaggactaccatgacccaccaccagcaccgctcttcgacaccaccgagctcaccaagtggtccttctacagagccctcatcgccgagttcgtcgccaccctgctcttcctctacatcaccgtcctcaccgtcatcggctacagcagccaaaccgaccccgctaacaccaccgacccttgcggcggcgttggcatcctcggcatcgcttgggccttcggcggcatgattttcatcctcgtttactgcaccgccggcatctcagggggtcacataaacccggcggtgacgttcggtttgttcctggcgaggaaggtttcactggtcagagctttgttctacatggtggctcagtgtttgggagccataagcggtgttgggttggtgaaggcttttcagaaaagctactacaacaggtaccatggcggtgcaaacatgcttgctgatggctactccaagggaactggtttgggcgctgagattatcggcacctttgtccttgtctacaccgtcttctccgccaccgatcccaagagaaacgccagagattcccatgttcctgttttggcacctcttccaattgggtttgcagtgttcatggttcacttggccaccatccccatcactggaaccggaatcaaccctgctagaagcttcggagctgctgtcatatacaacaacgagaaggcatgggatgaccagtggatcttctgggtgggacctttcattggtgctactattgctgcaatctaccaccagtacgtgttgagagctcaagcggcgaaggctctaggttcttttaggagctccggccacctgtaatgttgtgcagccaagcagctacaatgagtgcttaattgtatgatttattattggtggattggaatttgtatatcgatcctaatcaccgtgtattttactattttcgaaagacatgttcttgtttgttaattgatttatgtatttttaagtgtcaacatttgaaatgtgcactcattgatcatgctctgttttgctatatggtttaagttttactagtagtttttgtttttgtttttgtggaatttg

SEQ ID NO: 15815 - DNA, 1101 bp, Raphanus sativus
acaaaacaggaacaataaccaaaaacacatattcttgatatattaaaaatattaaatggcgaaagaagtggaaggagcagagggattcgcggcgagggactacgaagacccgccgccaactccgtttttcgatgcggaggagctgaccaagtggtctttgtacagagccgtcatcgccgagttcgtagccactctcctcttcttgtatgtcactgttttgactgtcatcggctacaagatttcctccgacactaaggccggaggcgacgagtgcggaggtgtcggaatcctcggcatctcatgggctttcggtggcatgatattcatccttgtctactgcaccgccggtatctcaggtggtcacataaaccctgcggtgacgttcggcttgttcttggcaaggaaggtatcgttggttagagcggtgctatacatggtggctcagtgtttgggtgctatttgtggagttggtttcgtcaaagctttccaaagctcttactacgtccgttacggcggaggagcaaactctctagccgatggatacagcacggggacaggactcgctgcagagatcatcggaacattcgtcctggtctacactgttttctctgctacagatcccaaaagaaacgcacgagactcccacgttcccgtgttggcgccacttccaattggatttgccgtgttcatggtacacttggccactattccaatcaccggaaccgggattaacccggccaggagttttggagccgcggttatctacaatgagtccaagccgtgggatgaccactggattttctgggtgggaccattcatcggagctgcgatagctgcattttatcaccaattcgtcctaagggcctctggttccaagtccctcggctccttccgaagtgcagcttgaatttagccacacaaaacaaaatagcaattacaaaatgattgttattatgtatgtacaaaattggcaactttggttttaaaatctatgctctgttttattccttttgtctttcctaatttctggcttcattgtgggatatgtgaatgtttgtgtacttggggaaaacaatcaatgaaatcaaattgtttttgcct

SEQ ID NO: 15816 - DNA, 1100 bp, Raphanus sativus
acaaaacaggaacaataaccaaaacacacatattcttgatatattaaaaatattaaatggcgaaagaagtggaaggagcagagggatacgcggcgagggactacgaagacccaccgccaactccgtttttcgatgcggaggagctgaccaagtggtctttgtacagagccgtcatcgccgagttcgtagccactctcctcttcttgtacgttactgttttgactgtcatcggctacaagatttcgtccgacactaaggccggaggcgacgagtgcggaggtgtcggaatcctcggcatctcatgggctttcggtggcatgatattcatccttgtctactgcaccgccggtatctcaggtggtcacataaaccctgcggtgacgttcggcttgttcttggcaaggaaggtatcgttggttagagcggtgctatacatggtggcgcagtgtttgggtgctatttgtggagttggtttcgtcaaagctttccaaagctcttactacgtacgttacggtggaggagcaaactctctagctgacggatacagcacatggactggacttgctgcagagatcattggaacctttgtccttgtctacactgttttctccgctacagatcccaaaagaaacgcacgagactcccacgttcccgtgttggcgccacttccaattggatttgccgtgttcatggttcacttggccactattccaatcaccggaaccgggattaacccggccaggagttttggagccgcggttatctacaatgagtccaagccgtgggatgaccactggattttctgggtgggaccattcatcggagctgccatagctgcattttatcaccaattcgtcctaagggcctctggttccaagtccctcggctccttccgaagtgcagcttgaatttagccacacaaaacaaaatagcaattacaaaatgattgttattatgtatgtacaaaattggcaactttggttttaaaatctatgctctgttttattccttgtctttcctaatttctggtttcattgtgggatatgtgaatgtttgtgtacttggggaaaacagtcaatgaaatcaaattgtttttgcct

SEQ ID NO: 15817 - DNA, 1157 bp, Raphanus sativus
ggattcactaagaactcactctatataacaaaccttccttcacccctccacaatcacaaaacaggaacaataaccaaaacacacatattcttgatatattaaaaatattaaatggcgaaagaagtggaaggagcagagggattcgcgacaagggactacgaagacccgccgccaactccgtttttcgatgcggaggagttgacaaagtggtctttatacagagccgtcatcgccgagttcgtagccaccctcctcttcttgtacgtcactgttttgactgtcatcggctacaagatttcctccgacactaaggccggaggcgacgagtgcggaggtgtcggaatcctcggcatctcatgggctttcggtggcatgatattcatccttgtctactgcaccgccggtatctcaggtggtcacataaaccctgccgtgacgttcggcttgttcttggcaaggaaggtatcgttggttagagcagtgctatacatggtggctcagtgtttgggtgctatttgtggagttggtttcgtcaaagccttccaaagctcttactacgtacgttacggtggaggagcaaactctctagctgacggatacagcacagggactggacttgctgcagagatcatcggaacattcgtcctggtctacactgttttctccgctacagatcccaaaagaaacgcacgagactcccacgtccccgtgttggcgccacttccaattggatttgccgtgttcatggttcacttggccactattccaatcaccggaaccgggattaacccggccaggagttttggagccgcggttatctacaacgagtccaagccgtgggatgaccactggattttctgggtgggaccattcatcggagctgcgatagctgcattttatcaccaattcgtcctaagggcctctggttccaagtccctcggctccttccgaagtgcagcttgaatttagccacacaaaacaaaatagcaatgacaaaatgattgttattatgtatgtacaaaattggcaactttggttttaaaatatatgctctgttttattccttttgtctttcctaatttctggcttcattgtgggatatgtgaatgtttgtgtactcggggaaaacaatcaatgaaatcaaattgtttttgcct

SEQ ID NO: 15818 - DNA, 884 bp, Carthamus tinctorius
gcatccatttcctccttctacctctctacctccatagccagccatgacaaaggacgttgaagtggcggagcaccacggcggcagcgactacgccgccaaagactaccatgacccacctccggccccgttgatcgacggcgaagagctgaccaaatggtccttctacagggccgtgatcgccgaattcgttgccaccctcctcttcctttatatcacggtgttgaccgtgatcgggtacaagagccagacggaccccaccttgaacaccgatcagtgcggcggcgttggcatcctcggcatcgcctgggccttcggtggcatgatcttcgttctcgtttactgcaccgccggtatctctggaggacacattaaccctgctgtgacattcgggttgttcttggcacgaaaggtgtcgctaattcgagcagtggcgtacatggtagcccagtgtgcgggtgcaatttgcggcgttggttttgtcaaagctttccaaagctcctactacaacaggtacggaggtggtgccaacgaattggcagatggttacaacaagggtacaggcctaggtgccgagatcatcggcacctttgttcttgtttacactgtcttctcggccactgatcccaagagaagcgcacgagactctcatgttcccgtattggcaccactgcccataggatttgcagtgttcatggtacacttggccaccatccccatcaccggtaccggaatcaacccggccagaagcttcggcgccgccgtcatctacaacaacgagaaggcctgggacgatcaatggatcttttgggtgggaccttttatcggggcagcagcagcggcattctaccaccagtttgtattgagagcaggggccattaaagcac

SEQ ID NO: 15819 - DNA, 1228 bp, Nicotiana tabacum
cggggactctaaaataaatcattaaaagtcctctcttttctcccataaatacctatccattttacactcacttctcatcatccatatcccttgtttcaaattttctttctttttcgtcagccatgactaaagaagtagaggtagcaacagagcaaccaacagagttttcagcaaaagactatactgaccctccaccagctcctttagtagactttgaggagctgacacaatggtcactttacagagctgttattgctgagttcattgccactttgcttttcctttatgttactgttttgactgtgattgggtataaggtccagtcagatgtcaaagccgacggtgatatctgtggcggcgttggtattcttggtattgcttgggcttttggtggcatgattttcattcttgtttactgcaccgccggtatctccggaggacacataaacccagcagtgacatttgggctgtttttggcaaggaaagtatcattgatcagagcagtattgtacatggtggcacagtgtttgggtgcaatctgtggtgtgggttttgtgaaggcattccagagtgcttattatgttaggtatggtggaggtgctaatgtcatggctcctggccataccaaaggtgttggattagctgctgaaattattggtacttttgttttggtttacactgtcttctctgccactgaccctaagagaaatgctagagactcccatgtccctgtgttggcaccacttccaattggatttgctgtgttcatggttcacttagccaccataccaattactggaactggcatcaatcctgctagaagttttggtgcagcagttatttacaatcatgacaaagcttgggatgaacactggattttctgggtgggtcccttcatcggagccttcgccgccgccgtctaccaccagttcatcctccgtgctggtgccatcaaagctcttggttccttcaggagcaatgcctaaaaaatttcaatccaattgaataaaaccagccatgaaaaattgtagatatttcccaatgggaaaagaaaaaaaaatgtactgtttgtttttcctatgaatttccctcttttgtgtatttttctacttgtaatcttcatttcccttttttatttttacttccttgctctcttttttcaatcttgtctcttgtatctttgaattattgttgcttcctagtaatttaaattaatgtttcggcttct

SEQ ID NO: 15820 - DNA, 900 bp, Carthamus tinctorius
caacccaccttctcccatccctttccctcctctgcaacaaccaccaccaccaccaccaccatgactaaagacgtcgaagtggccgagcagcaccacggcggcaaggactaccacgatccacctccttcgcctctcttcgacgccgacgagctcaccaagtggtccttctaccgagctctcatcgccgagttcgtcgccaccctcctcttcctttacgtcaccgtgctaaccgtcatcggctacaaaagccagaccgatcctctcctcaacaccgaccagtgcggcggcgttggcatcctcggcatcgcttgggccttcggcggcatgatcttcatcctcgtctactgcaccgccggtatctcaggaggacacattaatccggcggtgacgttcggattgtttttggcgcgaaaggtgtcgttgattagggcggtcggttatatggtagcacagtgtttgggagcgatttgtggtgtaggtttggtgaaagctttccagagctcgtactacaaccggtacggcggcggtgccaacacgctggccgacggttacaacaaggggaccggactcggtgctgagatcatcggcaccttcgtgctggtttacaccgtcttctcggctaccgatcccaagaggagtgcacgagactcccatgttcccgtattggcaccactacccataggatttgcagtgttcatggtgcacttggccaccattccgatcaccggcaccggaattaacccggcgagaagctttggcgccgccgtgattttcaacgacgacaaggcatgggacgaccactggatattctgggttggaccattcatcggagcgttcgccgccgcggtctaccaccagttcgtactgagagccgccgcgatcaaagcactggggtctttc

SEQ ID NO: 15821 - DNA, 807 bp, Carthamus tinctorius
ggacaggctccttctccgccaggactaccacgacccgccgccggcgccgttcatcgaccccggcgaactcaccaagtggtccttttaccgagcaattatcgctgagttcgtcgccaccctcctcttcctttacatcaccgtcttaaccgtcatcggctacaaggcccagaccgaccccgccaagaacctcgaccagtgcggcggagtcggcatccttggcatcgcttgggccttcggcggcatgatcttcgttctcgtttactgcaccgccggcatctccgggggtcacattaacccggcggtgacttttggcctgtttctggctcggaaagtgtcgctgatccgagccatcacgtacatggtggctcagtgcctaggagccatctgtggtgtgggtttggttaaggccttccacaagacctactacaacaactacggcggcggagctaacgagctagccgacggctacaacaaaggcaccggactgggcgccgagatcatcggaactttcgtcctcgtctacaccgtcttctccgccaccgatcccaagagaagcgcccgagactcccatgttcccgttttggcaccatttccaattgggttcgccgtgttcatggtccacctcgccaccatcccgatcaccggtaccggaatcaacccggcaaggagtctcggagctgccgtgatttacaacaaggaaaaggcttgggatgatcagtggatattctgggtcggacccttcatcggagcagccattgcggctttctaccaccagttcatattgagagcaggtgcagtcaaggctct

SEQ ID NO: 15822 - DNA, 1443 bp, Cryptomeria japonica
tctgatcatttgctcaggtattatttttctgtgcaggagaattttagggaatttttgtcaagggttgattgattttgagccatggctaaggaagaaggcaaggaggtggtagagcagcaggggcttgcagccaaggattacacagacccaccccctgcacctctggtggattttgaagaattcaagctctggtctttttacagagctctgattgctgagttcattgctacattgttgtttctttacatcacagttgctactgtgattggtcacaagagaactgctgcaaactgtggaagtgttgggattctgggtattgcttgggcctttgggggcatgatctttgtgctggtttactgcactgctggtatttcaggtgggcatatcaatcctgctgtcacttttggcctgtttttggctagaaaggtgtccttaccaagggctgttctgtacatggtggctcagtgtctgggtgccatctgtggggttggacttgtaaaggcattccagaagagtttctatgacatgtatggaggtggggctaactcagtagcccctggttactccaagggtactggtttgggtgctgaaataattggaacttttgtgttggtgtacactgttttctctgcaactgatcctaaacgcagtgcccgagactctcatgttcctgtcttggctccattgcctattgggtttgctgttttcatggtacacttggccaccatccctatcacaggaactggcatcaaccctgcaaggagctttggagctgctgtaatttatggtcatgataaaatctgggacgaccagtggattttctgggttggtcccttccttggagcttttgcagctgctttctatcaccagtacattctaagggcagcagccataaaggctttgggctcattccgtagcaaccccaatgtgtaaagcagtagcactgatgcagttgcagttgtttgtgttaagtctttaagtctgtaggcctaaagtaagtaattttcatggaaggggtatgtaaagaactggatgagaccggggggcatcatgttgaagagagtagtgggtacaaacaagcttgttaaagttctctctcattcataactctgagtggtagtgttgtagtagtacttgctattctctgtagcagcagggcagcaaggtggtggaagttttttctgtattttggagtgaatatggttgcatcagcagcagtactgtaagcatgagtgtatttagaaccagcaatccccctctctaacagaggtgggagaattgttcatatgtttcttgaatcttcctaccctgtattgttcatatcaggggaatccagtgcaggagtttaatcactgtaattatggtgttttgtatgcattcttcttctaaaagcagcaatatgtggacagttgtccaagtcattcattggaattagaaatcttt

SEQ ID NO: 15823 - DNA, 1259 bp, Zamia vazquezii
gagtaattcattcattgttttgagggaggggatcagggccatggcaaaggaagaaggcaaggaatcggagtacggcaccaaggactacacggaccctccgccggccgctctgatcgacgccgcggaattcaagctgtggtcgttctaccgcgcactgatcgcagagttcatcgccacattgctgtttctgtacatcaccatcgccacggtgatcggccatgtccggaatcaggccaactgtggaagtgtggggctgctggggatcgcctgggccttcggcggaatgatcttcgttctcgtctactgcactgcgggcatctcaggggggcacatcaatcctgcggtgacgttcgggctgttcttggccaggaaggtgtcgctgccgagggccgttctgtacatggtggctcagtgcctgggggccatctgcggcacggggctggtaaaggccttccaaaagagcttctacgttcaagccggaggcggagctaacagcgtcgcccacggctacaccaagggcgtcggattggccgctgaaatcatcggcacattcgtgctggtttacaccgttttctctgccaccgaccccaagcgcaatgcgcgggactcccacgttcctgtgcttgcgccgttgcccatcgggtttgcagttttcatggtgcacttggcaaccattcccataactggaacgggcatcaaccctgccaggagcttcggggccgctgtgatttatgggcacaagaaggcctgggatgaccagtggatcttctgggtgggtcctttcatcggagctgcgcttgcggccgcgtatcaccagtacattctgagagcggccgccatcaaggccttgggatccttccgcagcaaccccaatgtgtagctgcgggaataaacaaaaaatgaacgccaacggccccggctgctgtggaaggagttatctgtgtagtcggtctgtttacgaagaaaataggtctactgtaatttttcttgagttccaagtagacgtgtgtttagctatccccccccccgccaccaagtcctgattctgagaaattgatgttcaatgtgggatctcaggccagagggtttgagggcacatttgttgttcatacgatttgtctgtgtgtatggaagaacggggctgattgtggggaggaattgttcatattttcttcttcccctgctgtgtggagttatgatgggaattcaccaaactgattgcctgtttgtaagaataattttcgtgtcacttcttctta

SEQ ID NO: 15824 - protein, 527 aa, Gossypium hirsutum
MALLHSYFLSAGEYVSGSTVLAVAMSIASYFLIPMVFGGRHKNWKNAPPGPVGWPILGSLPHLSNRLHEDFFDMAKIYGPLFSLNLGIKPAIVVSSPEMAAQVLKEKEGMFSSRTITETIRVISYDAHSIIFSPYGPRWKVLRRILITELLSPKAFEQFEPLRTSQVHGLLKYLYLVSKSNTQVNIAEYAFTALANLVSNFVCSKDLFDNSMPEGRQMKERFWELIKVIGTPNFSDLIPFVKPFDPQGLKRKINKIFGQLDAFYEKLIEERFAEKGKAQLDGTIPYKRKMDMLDVLLSYESNDKQNGLDSLPKSIVKGMLSEMFIAGTETTSSTVEWGMAEILRKPSVVKKLLLELDQVVGKDRFVVESDIPKLTYLQAVVKEVFRLHPGVPLIIPRRTNEACEVAGYHIPKHCIVYVNVWGMARDPNVWEDPLEFKPERFIGSSVDVKGQDFNLLPFGTGRRSCVGWPLAHRMVHYYLAALLHAFQWESPPDVLNDLGERVGLTIQKGKSLLSTPKPRLPASVYER

SEQ ID NO: 15825 - protein, 703 aa, Hordeum vulgare
MPAPAIHPLPLLLLAATIATASAAVPPAASHSQPTLPTKGAAAGASHSQPTKPAAPPAAALASAPPAEGALLAAFLAKADPTAHLRFPLAATPCAHPGVTCSGAAGITHLVLEQAGLNGTFPPDTISGLAGLRVLSLKSNALHGPVPDLSALGNLKALFLAGNRFSGPFPASLASLRRLRSIDLSGNRFSGALPPGIEAAFPHLTALRLDSNHFNGSVPAWNQSSLKQLNVSYNDFSGPVPVTASMALMGADAFAGNPGLCGEVVRRECRGSPLVFFPDDGTSGSATPPAQSAGVTGDGPQRQGLPSSSSAARAHKVKKKTALTVAVALAAVLAVLLVCAIIAARRGKKRRRPSTAAYPSPKKSAAASQLSRELDNADIGYVECVPDEEAAAMMMPEEKARRLGRSGCLTFCAGEATSYSLEQLMRASAEVLGRGSVGTTYKAVLDGRLVVIVKRLDAAKIGPAASEAETFEQNMDVIGRLRHPNLVPLRSFFQAKEERLLVYDYQPNGSLHSLIHGSRSSRGKPLHWTSCLKIAEDVAQGLAYIHQASRLVHGNIKSSNVLLGSDFEACLTDNCLSFLLESAEVKDDAAYRAPENMKSNRRLTPKSDVYAFGILLLELLSGKAPLEHSVLAATNLQTYALSGREDEGIDSERLSMIVDIASACVRSSPESRPTAWQVLKMIQEVKEADTTGDNEDGDLTSDS

SEQ ID NO: 15826 - protein, 843 aa, Hordeum vulgare
MGGGPRTFAGGLSKWQHKRMHEKLARGKERGLLRHEKQLYLARLRSEIRASHLPGAPASPADHAGPTSSRAHIRALADRFLRPGAEDLWNDDDGPLRRARLPSQQKNAARTLPSGARMVDWKRVESGERPKPPRGGGDWKDWEELDSGEPRAGRGAGNEQPRLPAAFSQRRGYGTVAPWWWQWSPGSGTPSQRKEASFGFFGLKRCYSAMPPLSPRQESGAALMPLGVRQLSEAGGGTKGTPPALFYAQERLYSGAAPRRFGQKWRPDSSDEDEEVMPPAKRDLRLAKFVASREDESEDDEVGETSAIRRKWSSAALRNCDMKRDRRPLKSYEEESDDITGRIQELREEIRNREVLGAERRRYESRGESVFTNKRFDECGISPLTVKALTDAGYIHTTVVQEAALPICLEGKDVLVKAKTGTGKSVAFLLPAIESVLNAMKSHTNHRVSPIFALVLCPTRELAVQVTAEANVLVKYHHGVGVQSLIGGTRFKLDQRRLESDPCQILVATPGRLLDHIENRSSFSVRLMGLKLLVLDEADHLLDLGFRKDIEKIADSLPRQRQTLLFSATIPKEVRRVSQMVLNKDHVFVDTVGLGAVETPTKVQQQYLVVPHELHFHMVHRLLREHIDQEVDYKVIVFCTTAMVTEFMYIMLRDLKLNVREIHSRKPQLYRTRISEEFRDSNRLILVTSDVSTRGVNYPDVTLVIQAGVPPGREHYIHRLGRTGREGKSGKGILLIAPWEEYFLNEIHDLPIEKAPVPQIDQEMKQKVDDSIKIVDMSIKEAAYHAWLGYYNSIADVSRDKVMLADLASRFGVSIGMEKPPTLYRKTALKMGLKGVPGIRIRK

SEQ ID NO: 15827 - protein, 375 aa, Hordeum vulgare
MGREKSRRLSGSRDFRQRLVLATLTSTPIVIKDIRAGEGGLRPHEMSLLHLLDKVSDQHAIDVNDTGTKVGYKPGVIVGGKDLEHDCGVHRGIGYFIEPLVLLGLFARSPLSIRLKGITNDAKDPSVDTFRMVTLHMLKHFGVPLEGLELKIECRGTPPCGGGEVLLRVPNINSTLKAVNWVDEGMVKRIRGVTFATKVSPQIGTRIVYAARGLFNKFIPDVHIFTDHRVGLSGGLSTGYGLSVVAETTTGCLISADSSVSYPNVDKMSEQSKKPELMSPEDLGEQVASMLLEEVAQGGVVDSTHQGLLFMLCALCPPDVSKVRVGQLTPHAIESLRNIKEFLDVKFIIKPDPNSNTVILKCVGAGVKNLARKIS

SEQ ID NO: 15828 - protein, 161 aa, Hordeum vulgare
MAEQTEKAFLKQPKVFLCSKKATKGNNKPGKEGNRFWKSVGLGFKTPKEAIEGTYIDKKCPFTGTVSIRGRIIAGTCHSAKMNRTIIVRRNYLHYVKKYQRYEKRHSNIPAHISPCFRVREGDHVIIGQCRPLSKTVRFNVLKVVPAGSKSGAVKKAFTGV

SEQ ID NO: 15829 - protein, 197 aa, Hordeum vulgare
MAAEDVEFVDYERGEDEDDEGMEDEEDGEVSARALPVPRIAVAPSVPRTGRGRFVGRSRSVMASTRDRFDSIPFAGSSAHGGPQRSIEGWILLVSGVKEDAEESDLYDAFAEFGEVKDLHFNLERRTGYGKGYALIEYGCFEEAQTAIRRMNGTELLTKTIHVDWAFNRGPIQKATSTGPAQRRSRTPPRRLAAMTY

SEQ ID NO: 15830 - protein, 651 aa, Setaria italica
MPLGQRAGDKSDSRYCGVEVLDFPAGEGLPAVLNHSLASAFDFILAPLVDPNYRPTPGAVLPVSASDLVLGPAQWSNHVVGKISEWIDLDAEDERLRLDSELTLKQEIAWASHLSLQACVLPAPRRPSCANYARAVNQILQGLTNMHLWLRLPLEKSEPMDDDLDKVKNNSQMSEKVDSWELWNSFRLLCDHSSQLCVALDILSTLPSINSLGRWFGEPVRAAILQTNAFLTNAKGYPCLSKRHQRLLTAFFNHSVQVIISGRSNHNVSPVSEGVLSGDENYIEEAPVRHALSPYLDYVAYLYRRMDPLPEQERFEINYRDFLQSPLQPLMDNLEAQTYETFEKDVVKYSQYQRAVAKALVDRVPDDAVSTTRTVLMVVGAGRGPLVRASLQAAEETGRKLKVYAVEKNPNAVITLHSLIKLEGWESLVTVISSDMRCWNAPEKADILVSELLGSFGDNELSPECLDGAQRFLKPDGISIPSSYTSFIQPITASKLHNDIKAHKDIAHFETAYVVKLHRIANLAPPQQVFTFTHPNFSPDANNRRYTKLQFEMLPDTGSCLVHGFAGYFDSVLYKDVHLGIEPNTATPNMFSWFPIFFPLRKPIYVPDGSPIEVHFWRCCAPTKVWYEWAVTTPSPSPIHNSNGRSYWVGL

SEQ ID NO: 15831 - protein, 1139 aa, Zea mays
MAPSAAAPGISEAEGAPRMAKFLCSFGGSILPRPLDGCLRYVGGETRIVILPRDISYADLAARMRDLYKDADTIKYQQPDEDLDALVSVVNHDDVVNMMEEYDKVTATGEAFTRLRIFLFSQQLDDNAASVAVHYNVDERETERRYVDALNSLGDVRSPSSPVSVEQLFGIGGNDSGIPDFAGLRHLNVPRPSHGQRYGEMDSPWSPAYVSPSQYRVHDPRDFPISPSSARFQVGAEDFDDRIPDDFVRQSPKYHYYEAQSPSHMDNLVWLPPGAVIQQNAGFPGDLSKHNKFLDGNSGCDHCGSLFHKGQGSVTDPIYMNPRWTRPVQQHFDQPSMINDYPGHHANSCPDYCRPGEHYAGGQDVRLENGVYVKEQNGGHTPMLYNESRPHDRVWYAHTNQSHQRYEDPRLHYPTNDRVIEPYIVDASSVNSAFAPNKVYEMHSASLGHSSSSHESPHYFHGSSELINDAYHNQQVGGSGSYVQPAGSEESPGQHYNHFSAYGADSFYQMQQNLPPIQSLRRRANSPVHTASPYDSPHLPIPNGSINMNSVRNTGDASPRIAGLIGYDRMPNPFTPPNGSILYRVGGHDVPAAMENTSAFGPRSNPTAAQYVQPFIAPESIQHQPGVPLREVYPERAYPEPMPSSYADGKVAVSALPLTDQLFRLDINTMKKLEGQDDGNSTRNVNETTLLHAVDEPSTLPHHVGSVHEVDPKQEKLTEKESRQKQHEAGATALQECEDISEDMLNFLPELIASVKKVTLEDAAETQIAQSDANAAVSPVPDDDDNGKKLDEATAGVSNASSSSMVTTKLPNGLHSNPFVLQNTNANQDLDLQGSLDRQKSFKIESTTAEAEALSKGLQTIKNDDLEEIRELGSGTYGAVYHGKWRGCDVAIKRIKASCFAGRPSERERLITDFWKEALILSSLHHPNVVAFYGVVRDGPDGSLATVTEFMVNGSLKQFLRKKDRTIDRRKRVILAMDAAFGMEYLHGKNIVHFDLKCENLLVNMRDPQRPICKIGDLGLSKVKQHTLVSGGVRGTLPWMAPELLSGKNNMVSEKIDVYSFGIVMWELLTGEEPYSDMRAAEIIGAIVNDSLRPQIPSWCDPEWKGLMESCWSSDPAERPSFTDISQRLRKMAAAMNVK

SEQ ID NO: 15832 - protein, 86 aa, Oryza sativa
  Sequence also found in Organisms: Echinochloa colona
MATVPVNPKPFLNNLTGKPVIVKLKWGMEYKGYLVSVDSYMNLQLANTEEYIDGQFSGNLGEILIRCNNVLYLRGVPEDTEIEDAE

SEQ ID NO: 15833 - protein, 507 aa, Oryza sativa
MASTVLEATRAKHEDMERLERLAVRELQREPANARDRLYQSHRVRHMLDLVISTSGKLVEIYEDKDNARKDEISNHLSSTVQAEIFPKFYDRLKEIRDYHRRNPSARFVSATDDFEELLKEEPAIEFTGEEAFGRYLDLHELYNEFINSKFGTPMEYSAYVGTFSHVEKMAQNLKTSRQYREYLEHILEYLTSFLYHTEPLQDIEKIFAKLESEFEEQWINGEVPGWESKDPEKESAQESVIDLDYYTTVEELVELGPEKLKEALAARGLKSGGTVQQRAERLFLLKHTPLEQLDRKHFAKGSHSSVSNATSNGNNFKDNLKKEIALMEVKMRRLCELLDEIIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIQEAKELWEKIQQRQGLNKWRPDLEEEYEDQEGNIYNKKTYTDLQRQGLI

SEQ ID NO: 15834 - protein, 640 aa, Oryza sativa
MTDGHHFNNISLGGRGGNNPGQFKLYSGGLAWKRQGGGKTIEVEKSDITSVTWMAIPRSYQLGVSTKEGLFYRFFGFREQDISSLTNFMEKNMRITPEEKQLSVGGHNWGGIEINGNMLSFNVGSKEAFEVSLADVAQTQMQGKTDVVLEFHVDDTTGGNEKDSLMDLSFHVPTSNTQFPGDENRPSAQVLWQAILNKADVGSSEEAVVTFDGIAILTPRGRYSVELHLSFLRLQGQANDFKIQYSSILRLFVLPKSNNPHTFVVITLDPPIRKGQTLYPHIVIQFETEAVVQRDLTLSDEVLAEKYKDRLENSYQGLIHEVFSKVLRGLSGAKVTRPSTFRSCQDGYAVKSSLKAEDGLLYPLEKGFFFLPKPPTLILHEEIEYVEFERHGAGGASISSHYFDLLVKLKNDQEHLFRNIQRNEYHNLFNFISGKHLKILNLGEAQGRAGGVTAVLQSTDDDAVDPHLERIRNQTGDDESDEEDEDFVADKDDSGSPTDDSGEEGSDASLSGGEKEKSSKKEASSSKAPLKKRKPKGGDAAEGSEKRKPKKKKDPNAPKRAIAPFMYFSKAERANLKNSNPELATTEIAKKLGERWQKMTAEEKQPYVEQSQVDKKRYAEESAAYRGAAAMDVDSGPASD

SEQ ID NO: 15835 - protein, 796 aa, Oryza sativa
MATGEAAAAAASPPELASFLAIGLDQRTAENALANRKVTANLTAVIAEAGVSGCDKSVGNLLYTVATKYPANALVHRPVVIQYIVSSKIKTPAQLDAALSFLSTLGPDPLDTAKFEETCGVGVVVSTEEIQSMVTDILKENMEAIVEQRYHINVGSLCGQVRKWHPWGDAKFIKEEIDKRLTEILGPKTEADNVKPVKKKKEKPAKVEEKKTAVAAPAPPSEEELNPYSIFPQPEENLKVHTEIFFSDGNIWRAHNRKDILEKHLKATGGKVMTRFPPEPNGYLHIGHAKAMFIDFGLAKERNGHCYLRFDDTNPEAEKKEYIDHIQEIVRWMGWEPYKVTYTSDYFQELYELAVCLIKKGLAYVDHQTPEEIKEYREKQMNSPWRDRPIEESLKLFEDMRHGLVAEGKATLRMKQDMQNDNKNMADLIAYRIKFTPHPHAGDKWFIYPSYDYAHCLVDSLENITHSLCTLEFDIRRPSYYWLLVSLDQYQPYVWEYSRLNISNNVMSKRKLNKLVTEKWVDGWDDPRLLTLAGLRRRGVSSTAINSFIRGMGITRSDNSLIRLERLEYHIREELNKVAPRAMVVLHPLKVVINNLDYGTIIDLDAKKWPDAPGDDASAYYKVPFSRTVYIEQSDFRVKDSKDYYGLAPGKTVLLRYAFPIKCTEVIYGDNSDNIIEIRAEYDPSKATKPKGVLHWVAEPSPGVNPLKVEIRLFEKLFLSENPVELEDWLGDLNPRSKEVIKGAYAVPSLATAALGDKFQFERLGYFAVDSDSTAEELVFNRTVTLRDSYGKAGPK

SEQ ID NO: 15836 - protein, 330 aa, Oryza sativa
MAEAAAAPPAAAATNYEVDLGNLMAYDPSHHLPAASSSREELREECLRKGTELAQAVADALFALPATEDRDGPMVRLPPPTTRFPREKHLPRPKPPTKWEQFAKMKGITKHKKNKREWDEQTQTWKRTYGYDRVNDDKDIPIIEAKATDEPGVDPFAQRREDKKKCVEKQEKNRLENLKKAAKVGALPSHIQLAATALPITGTKADIPKKSRKKDLEDVAGMASSATASGGKFDEKLPGEKPPKNPGKHRKFLPVVEGKGMGNQEKQQNDKILNALLAKSSEDQMDVGRAITMYKVKKEKQRRKDKEKSSSSNKLKPQKKTLKKSSKKKA

SEQ ID NO: 15837 - protein, 136 aa, Oryza sativa
MVKFLKPGKAVILLQGRFAGRKAVIVRVFEEGTRDRPYGHCLVAGLAKYPKKVIRKDSAKKTAKKSRVKCFLKLVNFTHLMPTRYTLDVDLKEVAAGPDALATRDKKVAACKSAKARLEDRFKTGKNRWFFTKLRF

SEQ ID NO: 15838 - protein, 329 aa, Oryza sativa
MDMAHERDASSEEEVMGGDLRRGPWTVEEDLLLVNYIAAHGEGRWNSLARSAGLKRTGKSCRLRWLNYLRPDLRRGNITPQEQLLILELHSRWGNRWSKIAQHLPGRTDNEIKNYWRTRVQKHAKQLKCDVNSQQFKDVMRYLWMPRLVERIQAAAAGQQQQQEGGTDTPPLSWQHGGSDGLYESPELPAPDASCWPAEYCAAAGGAQSGGTPAPELSSTTAGSSSLSTDSGAGAQPSWPTQADGAEWFTTACDASSATGGVAMRDTELELAQPPCQGGQTWTTSESSLPGLTFPDLAVADFEIGGFDVDSFWTSMEDDQLWCPTQAAV

SEQ ID NO: 15839 - protein, 163 aa, Oryza sativa
MRLEKCWFCSSTVYPGHGIQFVRNDAKIFRFCRSKCHKNFKMKRNPRKVKWTKAYRCLHGKDMTQDSTFEFERKRNRPERYDRNVTEQTLKAISLITKIRHERQKKHITERQKQGKTKQRERDAKELEQDIQMLPKKVTLSTQKTKVVVKVSQQQTEENLMEE

SEQ ID NO: 15840 - protein, 742 aa, Oryza sativa
MRAREMHPLCCLVSDCALGGGGGGGGGEGGGGDCSPTKAAVGGEEEVVAVAGVLYKWTNIGKGWRPRWFAIRGGVLAYSKIRRRVAAEPPPEAAAAAAANGVRLIGVPRGGVGDQPIGFVPLKISSFSESKSDDKRFYIITPTKTLQLRTGSAKDRVAWIEALVSARSEYSLNGGVPCDQNEGSFSTEKLRNRLHAEGVGEATIKDCEQIIHSEFSQYHTQMKQRCEDYLNFIGSLPRELEVVNSGDASAIEKPQSELFKHDCSSSGKCSEYSNTESSDDAGKQEVGQLSDEDEFHFYDTRQSFSDTAASPDLKMRCSNSGSGAHKFGELLAIDKTNEYLLSSSKRRSELPVPIEKEKGVSLWSMIKDNVGKDLTRVCLPVYFNEPLSSLQKCFEDLEYSNLLDRAYEYGSRGNGLMRILYVAAFAVSGYASTDSRPCKPFNPLLGETYEADYPEKGIRFFSEKVSHHPMVMACHCEGKGWKFWGDSNLKSKFWGQSIQLDPSGVLTLQFDDGETFQWSKVTTTINNLIIGRVYCHHHGTMNISGNRQYSCKLTFKEQSFLDRNPRQVQGLVTDANGTKVAFLMGKWDESMSCIIGDDASKVNSRNANQSTGATLLWEKNVPPANPTRYNLSSFAITLNELTPGLKEKLPPTDSRLRPDQRHLENGEYEKANSEKLRLETRQRMARKMQESGWKPRWFQRDTEDGTFRYVGGYWEAREQRKWVGCNDIFGNNVSTLCTSASI

SEQ ID NO: 15841 - protein, 1232 aa, Sorghum bicolor
MYLYSLTLQRATGAVCAVIGSFSGRDSKKSAASGSGSGSTQEIAVARGSTLDLLRPDPETGRLRTLLSVDVFGAIRSLAQFRLTGANKDYLVVGSDSGRLVILEYSPDRNRLDKVHQETFGKSGCRRIVPGQLLAVDPKGRALCIAALEKQKLVYVLNRDAAARLTISSPLEAHKSNTLTFALAALDCGFDNPVFAAIELEYAESDRDPTGQAANQAQKLLTFYELDLGLNHVSRKVSEPIDNGANLLVTVPGGGDGPSGVLVCCDNFVLYRNQGHPEIRAVIPRRADLPAERGVLIVAAATHKQKSMFFFLLQTEYGDIFKVDLDHNGDTVSELRIKYFDTIPVTSAVCVLRSGFLFAASEFGNHALYQFRDIGRDADVESSSATLMETEEGFQPVFFQPRALKNLMRIDEIESLMPVMDMRVANLFDEETPQLFTACGRGPRSTLRILRPGLAISEMARSMLPAEPIAVWTVKKNINDMFDAYIVVSFTNVTLVLSIGETIEEVSDSQFLDTTHSLAVTLLGEDSLMQVHPNGIRHIREDGRVNEWRTPGKKTITKVGSNRLQVVIALSGGELIYFEMDMTGQLMEVEKQDMSGDVACLAIAPVPEGRQRSRFLAVGSYDNTIRILSLDPDDCLQPLSVQSVSSAPESLLFLEVQASIGGEDGADYPANLFLNAGLQNGVLFRTNVDMVTGQLSDTRSRFLGLRPPKLFPCVVSHRQAMLCLSSRPWLGYIHQGHFLLTPLSCDTLESASSFSSDQCSEGVVAVAGDALRIFTIERLGETFNETAIPLRYTPRKFVILPKKKYIAVIESDKGAFSAEEREAAKKECLEASGAAENGNANNGDPMENGDGQEDGAEEGNTFPDEQYGYPKAESERWVSCIRILDPRSRDTTCLLELQENEAAVSICTVNFHDKEHGTLLAVGTAKGLQFWPRRTLAGGFIHIYKFVDEGRSLELLHKTQVEEVPLALCQFQGRLLAGVGSVLRLYDLGKRKLLRKCENKLFPRTIVSIHTYRDRIYVGDMQESFHYCKYRRDENQLYIFADDSVPRWLTAAQHIDFDTMAGADKFGNIYFARLPQDISDEIEEDPTGGKIKWEQGKLNGAPNKVEEIVQFHVGDVVTCLQKASLIPGGGECLIYGTVMGSVGALLAFTSREDVDFFSHLEMHLRQEHPPLCGRDHMAYRSAYFPVKDVIDGDLCEQYPSLPADMQRKIADELDRTPGEILKKLEDIRNKII

SEQ ID NO: 15842 - protein, 325 aa, Sorghum bicolor
MEETLAVESAAGETAAAQAPERKEETLEEVLSRHRKEKSKLQDKETSLKKAAAKGSKAEQKAKKKQVEEEITRLSRELEANHAAELASFGYKPSGSSEKGNLDNLVKAIAGVSVSSNSDSAKPSKGTRRREKKAKEEAAREQRIQEEQSNLVSDRMLENEKLERKLEPLGLTIQEIKPDGHCLYRAVENQLLLHSNGAAQYSYQDLRQMAAKYMREHAADFLPFYLAEGKADIGPDPMESFERYCEEMESTAAWGGQLELGALTHCLKKHIVVYSGSFPDVEMGKEYKSGSGGSDAGDASIRLSFHRHAYGLGEHYNSVIPAESS

SEQ ID NO: 15843 - protein, 501 aa, Sorghum bicolor
MWKQFLSKLPRKSSASGDSGQCSNGTGIQRTSSCSSIPSGRPASAIRRMSSAVFPSSVVAGIEPLVSFKDVPNSEKQNLFVSKLSLCCVVFDFSDPNKSSVEKDIKRQALLDLIEFVESTNTRFSEAAIAACSRMCAINLFRAFPPNCRSGSSGGGEGDEDEPMFDPAWCHLQLVYELLLKFIGSSSLDAKIGKKHFDHSFIVKLLNLLDSEDPRERDCLKTILHRVYGKFMVHRPFIRKAVSNIFYQFVFETDRHNGIAELLEVFGSVISGFALPLKEEHKIFLWRVLVPLHKPKSVGVYLQQLTYCVTQFIEKDPKLASSVIIGLLRYWPITNCQKEVMFLSEIEEILESTSQAEFQKCMVPLFRRITHCITSSHFQVAERALFVWNNDHIISLIAQNRQVIMPLVVPALEQNIQNHWNQAVLNLTVNVKKMFSEMDDDLFSSCLAKYKEEEEKRVSLEAKRKLTWEKLEAAAAFQPVTGHTAVLVGHQPSANMIATLI

SEQ ID NO: 15844 - protein, 292 aa, Sorghum bicolor
MGDAAETTSKTLHNWMAEPRPRPSGQGDDEETLQLSLGLPGGGGGNGAGAGLPPAAAWRMLPARDKEMHSAAAAVDTSSMLSLGYSAPAFSPARSPGKAKGSPAAATENARLASTNNASQARQRSPNTPVIGWPPVRAFRRNLATSSKASLEHHNGKKAARPEETTKRAPFVKINMDGIPIGRKIDLNALGSYDELSLSVDKLFRGLLAAQQDPLDASTKECSQEEVAISGLLDGTGEYTLVYEDYEGDRVLVGDVPWGMFVSSVKRLRVLKTSDLSSSLTASGRKRTVTEC

SEQ ID NO: 15845 - protein, 636 aa, Hordeum vulgare
MGGRWSPSAGWGPWRPRLLLLLVALTAATVEGRFVVEKNSLRVTSPASLRGVYECAIGNFGMPQYGGTMHGVVVYPKANARACNPFADFGLSFNPKAGGLPVFLLVDRGDCYFTTKGWNAQTAGAAAVLVADDRAEPLITMDTPESSGKEHLENITVPSALVSKRFGDDLKSALENGDMVNVLLDWRESLPHPDERVEYEFWTNSNDECGAKCDMQMNFVRDFRGVAQVLEQRGYTQFAPHYITWYCPEAFVLSAQCRSQCIDHGRYCAPDPEQDFTTGYDGKDVVVQNLIQICLFKVANESRKPWLWWDYVHDFAIRCPMKEKKYATECARGVIKSLGMDIEKITKCVGDPDADEDNPVLKAEQDAQIGHGARGDVTILPTFVVNNRQYRGKLDKRAVLRAICSGFEGTTEPDICLTQDVQTNQCLENNGGCWLDKNTNFTACKDTFRGRVCECPVVNGVKFVGDGYTHCEASGVGRCQINNGGCWKETRNGKSVSACSNEQTKGCKCPQGFKGDGVHGCEDVDECKERLFCECKDCSCENTWGSYECGCGGSNMLYMREHDTCISKVATSSVGWGFLWVIFFGLGFAGVGAYAVYKYRLRSYMDSEIRAIMAQYMPLENQETSSHQRHVEHADI

SEQ ID NO: 15846 - protein, 382 aa, Hordeum vulgare
MKPSVAALLVSFVALLLVAAVRGDDDGCGSPESAGQDRARANHLKIAAFFSILVCGALGCSLPVLGRRVPALRPEGDVFFLVKAFAAGVILATGFIHILPDAFEKLTSPCLLPSDGPWHDFPFAGLGAMVGAIGTLVVDTVATGYFTRAQLNKDGAHGHGAITSSAAVVDEEKQAAAAASEEARRHEGGEQEVHVHTHATHGHAHGSAALVAAVGGAEDEKDTIRHRVISQVLELGIVVHSVIIGISLGASQDPDNIKPLVVALSFHQMFEGMGLGGCIVQAKFRARSIVTMILFFCLTTPVGIAVGFGISRVYNEYSPTALVVEGSLNSVAAGILIYMALVDLLAEDFMNPKVQSRGKLQLGINISMLVGAGLMSMLAKWA

SEQ ID NO: 15847 - protein, 321 aa, Hordeum vulgare
MAARAIVVLSLILALVAISSGGASAQLSSGFYSHTCPGMLKAVRSALHPAIGRERRVGASIVRLYFHDCFVQGCDASLLLDDAPGLRGEKNATPNKNSARGFEVIDAVKAAVEECCPGVVSCADILAIAAEESVVFLGGPSWEVKMGRRDSTTASFNGAENNIPPPTSGLANLTSLFAAQGLSQKDMVALSGAHTIGLARCTNFRDHVYNDTNIDADFARSHQSGCPRATGSGDNNLAPLDLQTPTVFENNYYKNLVQKRGLLHSDQELFNGGAADALVREYVSSQSVFFKDFVEGMVKMGDIMPLTGSSGQIRMNCRRIN

SEQ ID NO: 15848 - protein, 512 aa, Phaseolus vulgaris
MDPLSLLQVLQSHSFATVLAVGASSLLFLILKLRLTGRHARLPSVPAVPGLPVVGNLLQLKEKKPYKTFARMAEEHGPIYSIRAGSSTIIVVNSAAIAKEAMVTRFNSISTRKLSKALTILTSDKCMVATSDYNDFHKTVKKHILANVLGANAQKRHRLHREDMLQNILSSFSEHVKRFSDQAVDFRNVFVSQLFILALKQGLGRNIESIYVEELERTLSRDDIYKILVLDMMEGAIEVDWRDFFPYLKWIPNRSVEKRIQNLNFRRGVVMRALMNEQKKRMASGKVENCFYDYLVTEAKELNEHQISMLLWETIVETSDTTLVTSEWAMYELAKDKTRQARLYKELQNVCGQEKVTEEHLSKLPYLGAVFHETLRKHNPAPIVPIRYAHENTELGGYHIPAGSQIAINIYGCNMDKNKWENPLEWKPERFLDEKYDPSDLYKTMAFGAGKRVCAGSLQAMLIACTAIGRFVQQYEWDLGQGQEENVDTMCLTTHRLQPLQVKLRPRKEYTK

SEQ ID NO: 15849 - protein, 516 aa, Setaria italica
MAIGGGGFAEGPGGAGYSGRVTSFVVLSCIVAGSGGILFGYDLGISGGVTSMESFLSKFFPDVYHQMRGDKKVSNYCRFDSELLTVFTSSLYVAGLVATLFASSVTRRFGRRASILIGGSVFIAGSVFGGAAVNVYMLLLNRILLGIGLGFTNQSIPLYLSEMAPPQYRGAISNGFELCISIGILIANLINYGVEKIADGWGWRISLSLAAVPAAFLTIGAIFLPETPSFIIQRDGNIDEAKILLQRLRGTTRIQKELDDLVSASNISRTIRHPLRNIFKRKYRPQLVIALLIPFFNQVTGINVINFYAPVMFRTIGLKESASLMSAVVTRICATVANIVAMVVVDRFGRRKLFLVGGVQMILSQIMVGAVLAAKFKDHGGMEKEYAYLVLIIMCVFVAGFAWSWGPLTYLVPTEICPLEIRSAGQSIVIAVIFLVTFVIGQTFLAMLCHLKFGTFFLFGGWVCVMTVFVYFFLPETKQLPMEQMEQVWRRHWFWKRIVGEEEEEREAGSIALSTT

SEQ ID NO: 15850 - protein, 296 aa, Setaria italica
MAGLSLQHPLAFAFGLLGNIISFMTYLAPLPTFYRIYKNKSTQGFQSVPYVVALFSAMLWIYYALLKSNECLLITINAAGCVIETLYIAMYLTYAPKKAKLFTAKILLLLNVGVFGLILLLTLLLSAGQNRLVILGWVCVGFSVSVFVAPLSIIRQVVRTRSVEFMPFSLSLSLTVSAVVWFLYGLLIKDKYVALPNVLGFSFGVIQMGLYALYRNATPRVPAKEVADDKEDIIKVPEHVVTIAKLGAPAVELKTHEVRPVESPPMEEEVKPESGMAAAEKEQDKVMNKGGNADQA

SEQ ID NO: 15851 - protein, 273 aa, Zea mays
MRGSSRRPVAVVMAWVRRQPPKVKAFLAVVAGMAALVFIRFIVHDHDNLFVAAEAAHALGIAVLIYKLTKEKTCAGLSLKSQDLTALFLAVRLYCSFVMEYDIHTILDTATLAATLFVIYMIRFKLRSTYMLDKDNFALYYVVLPCAVLALLVHPSTSHNIVNRICWAFCVYLEAVSVLPQLRLMQNTKIVEPFTAHYVFALGVARFLSCAHWVLQVLDTRGGLLTALGYGLWPSMVLLSEIVQTFILADFCYYYVKSVFGGQLVLRLPSGVV

SEQ ID NO: 15852 - protein, 464 aa, Oryza sativa
MSGRGLMKQDLSKLDVTKLHPLSPEVISRQATINIGTIGHVAHGKSTVVKAISGVQTVRFKNELERNITIKLGYANAKIYKCEDEKCPRPMCYKAYGSGKEDSPHCDVPGFENTRMKLLRHVSFVDCPGHDILMATMLNGAAIMDGALLLIAANESCPQPQTSEHLAAVEIMRLQHIIILQNKIDLIQEGAAMNQHEAIQKFIQGTIAEGAPVVPISAQLKYNIDVICEYIVKKIPIPERNFTSPPNMIVIRSFDVNKPGSEVDEIRGGVAGGSILRGVLRVNQNIEVRPGIVMKDESGNIKCTPIYSRIVSLYAEQNELQFAVPGGLIGVGTTMDPTLTRADRLVGQVLGEVGSLPDVYVELEINFFLLRRLLGVRTKGTEKAGKVSKLTKGEILMLNIGSMSTGARVVAVKNDLAKLQLTAPVCTSKGEKVALSRRVEKHWRLIGWGQIQAGTTLEVPPCPL

SEQ ID NO: 15853 - protein, 207 aa, Oryza sativa
MCGGAIIYDYIPARRRVCASDFWPDADDSDPHTPAPEKPPRAKRERKNQYRGIRQRPWGKWAAEIRDPVKGVRVWLGTYPTAEAAARAYDRAARRIRGAKAKVNFPNDFGAAPAPAAAAAKAVPRVAPTPAVLPPPKMEAVSEGAGACSSDEVKELSEELLAYENYMSFLGIPYMEGGAASAAGAEEAAAPAGLWTFEDYELPSLAL

SEQ ID NO: 15854 - protein, 307 aa, Oryza sativa
MEARAGLAMQSRAAVGVGAGPGVGRRGRAVIRVGKRPTAASLRVGGPAGPAAAKPLAPLYCLKASRGHDSLHNSVDEALLLKRKSEEVLFYLNGRCIYLVGMMGSGKSTVAKILAEVLGYSFFDSDKLVEQAVGMPSVAQIFKEHSEAFFRDNESSVLRDLSSMRRLVVATGGGAVIRPVNWKYMKKGLSVWLDVPLDALARRIAQVGTASRPLLDQPSSDPYTAAFSKLSMLAEQRGDAYANADARVSLEEIAAKQGHDDVSKLTPTDIAIEALLKIENFVTEHSTSSGPVGDLIVDSQNRRTKAL

SEQ ID NO: 15855 - protein, 432 aa, Oryza sativa
MAMSSSRSAAAIRGRRVGALARARRHATRAMASLFGHVEPASKDPILGVTEAFLADPSPDKVNVGVGAYRDDNGKPVVLECVREAERRIAGNLNMEYLPMGGSIKMIEESLKLAYGEDSDFIKDKRIAAVQALSGTGACRLFADFQRRFLPNSQIYIPTPTWSNHHNIWRDAQVPQRTFTYYHPESRGLDFAGLMDDIKNAPNGSFFLLHACAHNPTGVDPTEEQWREISYQFKIKNHFPFFDMAYQGFASGDPERDAKAIRIFLEDGHQIGCAQSYAKNMGLYGQRAGCLSILCEDEMQAVSVKSQLQQIARPMYSNPPVHGALVVSIILNDPELKSLWLKEVKGMADRIIGMRKALRENLEGLGSPLSWDHITNQIGMFCYSGMTPEQVDRLTNEYHIYMTRNGRISMAGVTTGNVAYLANAIHEVTKTK

SEQ ID NO: 15856 - protein, 611 aa, Oryza sativa
MSESNVDGIEISASNDERRDRGDAEISEDEPRQTRIRSLKKKALHASTRLTHSLKKRGKRKVGCRVPKITIEDVRDAEEEQAVSSFREVLFARDMLPERHDDYHTMLRFLKARKFDVEKAAHMWADMLHWRKDFGTDTILEDFEFHELEEVLQYYPHGYHGVDKEGRPVYIELLGKVEPSKLVQITTVERYIKYHVQEFERAFREKFPACSIAAKKHIDTTTTILDVHGVGWKNFSKIARDLVRCMQKIDGDYYPETLHQMFIVNAGPGFKLIWSTVKGLLDPKTSSKIHVLGTKYQHRLLEAIDSSQLPEFLGGSCTCSSQGGCLRSNKGPWSDPLIMKLVHCMESSALKDIGQVSDIEEAITGSVRLRALKLPERISYTSNAESGSDVDDLGSPIGQEDFEYHSLAPVHEEARESGSTCSGSDDKVVETNTIYNPPGNGSGQYSARQNPSINRVSPEPGHVPNDGEGNADHGILKYISKKVLGVILEVLSFLRIFIRHRQQLENVPQHTTTVHSNQADLQIIKEDRVNPCLERLERLETMFNQLSRKPPEIPQDKDRAIQDSFDRIKCIEFDLEKTKKVLHATVIRQMQMAETLEAVKESDLRRRKFCT

SEQ ID NO: 15857 - protein, 66 aa, Oryza sativa
MLQLLMALAFSAAPLTLYLPPVRSLSLFVEAIEAVFRDCAPYSQGAIFRFRLGLSRILSGLARALR

SEQ ID NO: 15858 - protein, 65 aa, Oryza sativa
MILVAVVAELLEEYTVLVARVLEQLFNDAPFPRRMRFLMLRSLPFVPPPLPPPPPSHALRVTTRG

SEQ ID NO: 15859 - protein, 641 aa, Sorghum bicolor
MAVGATATKLHLSSAAAAARRPSLLHLAAVAVLCSVSYLLGIWHHGGFSAGPAAAGGGVSSSVSIATAVSCATPALTTASSSPPAGPLDFAAHHTAEGTEAEAALRHRSYEACPAKYSEYTPCEDVERSLRFPRDRLVYRERHCPADGERLRCLVPAPKGYRNPFPWPASRDVAWFANVPHKELSVEKAVQNWIRVDGDRFRFPGGGTMFPRGAGAYIDDIGKLIPLHDGSIRTALDTGCGVASWGAYLLSRNILAMSFAPRDSHEAQVQFALERGVPAMIGVLASNRLTYPARSFDMAHCSRCLIPWQLYDGLYLIEVDRILRPGGYWILSGPPINWKKHWKGWDRTKEDLDAEQKAIESVAKSLCWKKIKEEGDIAIWQKPTNHIHCKAIHKVIKSPPFCSNQNPDAAWYDKMEACITPLPEVSDLKEVAGGALKKWPERLTAVPPRIASGSIEGVTEEMFVEDTELWKKRVGHYKSVIAQLGQKGRYRNLLDMNAKFGGFAAALVNDPLWVMNMVPTVGNSTTLGVIYERGLIGSYQDWCEGMSTYPRTYDLIHADSVFTLYNGRCEAENILLEMDRILRPEGTVIIRDDVDLLVKIKSITDGMRWNSQIVDHEDGPLVREKLLLVVKTYWTLDDNKQ

SEQ ID NO: 15860 - protein, 714 aa, Sorghum bicolor
MAATSGHAVVVDIHDEPAAAESTATAPQLQPVMLPPVPYVLRFTDLSYSVKKRGGGLGLGCLPTRRPSNRLASLDAPTTTTTTTNTKTLLDGISGEAREGELFAVMGASGSGKSTLVDALAGRIARDSLRGGGATLNGEPLHGRRLRAISAYVMQDDLLYPMLTVRETLLFAAEFRLPRALPADRKRARVDALVDQLGLARAADTIIGDEGHRGVSGGERRRVSIGTDIVHDPIVLFLDEPTSGLDSASAFMVVQVLRRIAQSGSVVIMTIHQPSARILGILDRLLLLSRGRTVYAGTPAGLKPFFSEFGTPIPDNENPAEFALDTIREYERSPDGAAPLADFNVKWQHGSSASSGAGVDKDNNNNKLMPLELAIAESVSRGKLVAGSGGTGGGSAVTVPTFANPPWTEVWVLIKRSFTNTGRMPELFVMRLGTIMVTGFILATIFWRLDDTPKGVQERLGFFAMGMSTMFYVCADALPVFVQERHIYLRETAHNAYRRISYVLANAVVAFPPLVFLSLAFAVTTFWAVGLAGGAPSFLFFVLIILASFWAGSGFVTFLSAVVPHVMLGYTVVVAILAYFLLFSGFFINRDRIPDYWIWFHYLSLVKYPYQAVLQNEFSDASRCFSRGVQMFDGTPIGHMAEGVKLKVLEAISRTLGTNMTATTCVTTGADVLASQAVTDIGKWKCLLVTVAWGFFFRALFYVVLLVGSKNKRK

SEQ ID NO: 15861 - protein, 232 aa, Sorghum bicolor
MAANVGESTSGSSSGADAGGSFECNICFELPQEPIVTLCGHLFCWPCLYKWLRIHSHSPECPVCKAIVEEDKLVPLYGRGKDRVDPRSKNVPGAADIPNRPAGQRPATAPQVDPNTHFPNANPNPWFMGGGIPLANARWGNYTFSAAFGGLFPLLSFQVHGFPDATAYGQPAGFPYGYGHGHGHAFHGGHAGGHAHAAAAPRHGQQQQQADVYLKALLILVGFLVIASLITF

SEQ ID NO: 15862 - protein, 568 aa, Sorghum bicolor
MRRGGGHRFPKPSLAPSTAAEATPALDASVIRNLDSAFSRRDSDAASLCSSRPASAAGAGVGAAPNFSDRPTQAAALRVVNRFLAPDVALRGPLPAARDIQAALRLLVDRLHLPRNDATFEDDLIQDLRILGCPYKVNRSALKAPGTPHSWPVVLSVLHWLTTLCYAQGDDLDAPFNDLLLYTTQSYSHFMSGNDDAVAALDEEYTSKARMTGEASVETVRALEKEAEELETEVNKLISGPSRRGALETEKEAFTADVCKFDAVVNTWKRKINEKEQALGNLEKELEAKVLDTQRSAAEVQDLLKQVDAQPVDVRGMDRMRREMQAIENDIANAEKGKAALEDKVWEVEAKLVTKLDELETLAEQCNQALKKLKPTVPFQYMINSKGSSPAEMLGSGYKTVLKPALVARAEENKRICLSNLESLNDLKKQLQGNVKVLEEERNNISSFQAKNDEMVARLNSLDLEIINDDSRFTSEARQMRDELEKKKNSLISLEKEADDFFKISEKRLQDAKLKAEEDTEVAAKDLLELLDSMAEYKESMETTIAQRRKDLYETADYIAGLFAGTSQ

SEQ ID NO: 15863 - protein, 255 aa, Helianthus annuus
MIGPQRPQIVLFGSSIVQLSFSNDGWGAILADVYARKADIVLRGYYGWNSRRAVKVLDQVFPKDAASQPSLIIVYFGGNDSMGPHSSGLGPHVPLPEYIENMRKIATHLQGLSDTTRLIFLTCPPVDEVKLNENTSSIFSELVRTNELCRAYSDACVELCNEMGIKVIDLWTAFQKRDNWLTFFTDGVHLSGEGSKVVVEEILKVLKEAEWKPSLHWKSMPTEFSEDSPYDLVYSDGKTTLNPSDWTFHREIQWD

SEQ ID NO: 15864 - protein, 659 aa, Helianthus annuus
MSLYTVKVEDSRAATGDVPSAGPVYRCIYAKDGLMELPPGYDSPWDFFSESAKRNPKNPALGRRQIIDGKAGGYSWLSYQDAYNSAIRIASAIRSRSVNPGDRCGIYGPNCPEWIISMEACNSNGITYVPLYDTLGANAVEFIINHAEISLVFVQDNKIPAILSCLPNCSSNLKTIVSFGNISESQKKEAMEHGVDCFSWEEFASMGNLEDELPAKHKNDICTIMYTSGTTGEPKGVILSNAAFMSEVLSMHQLLVETDKPGTEEDTYFSFLPLAHIFDQIIETYCIYSGASIGFWQADIRYLIEDLLVLKPTIFCGVPRVYDRIYTGIMAKILAGGTVKKALFDFAYNYKLRNLEKGIQQDKSAPLLDKLVFDKIKQGFGGRVRLMLSGAAPLPKHVEEFLRVTCCTVLSQGYGLTESCGGCFTSIANVYSMIGTVGVPMTTIEARLESVPEMGYDALSSVPRGEICLRGNTLFSGYHKREDLTKDVLVNGWFHTGDIGEWQADGAMKIIDRKKNIFKLSQGEYVAVENIESAYSRCPLVTAIWVYGNSFESFLVAVVVPDRMAIEEWATKNNESGDYISLCKNPNVRKYVLDELNSEAKNNKLRGFEMLKAVHLEPVPFDFERDLITPTFKLKRQQLLKYYKDCIDKLYAEAKASKK

SEQ ID NO: 15865 - protein, 284 aa, Solanum lycopersicum
MKRGSGFSFHVTVVIAAIAFIYFSTVFVFIDQWFGLWSSPGMLNAVFFTVVAVMCISNYALAIYTDPGQVPSSFVPDVEDPDNIVHEIKRKGGDLRYCQKCSLYKPPRAHHCRICNKCVLRMDHHCVWMNNCVGHANYKIFFIFVMYAVVSCIYSLVLLAGSITINSPKDDQQSEGSFRVVYIISGLILVPLSLALGFFLCWHFYLILQNKTTIEYQEGVRAMCVAEKGGYVYSHPYDLGAYENLIAVLGPNVLCWLLPSTKHIDSGLRFRTSFDNVPRTPVSK

SEQ ID NO: 15866 - protein, 210 aa, Triticum aestivum
MAAPRALVLGVLLLIAVSNTEAASVVVGMAKCADCTRKNMKAEEAFKGLQVAIKCKSVHGDYESKAVGALDRTGAFSVPLAADLHGADCVAQLHSAASNTPCLGQEPSKIAPVSEGTTFGVVAGAKTNVLASPECASATLLGPIKKHIIEHFHHKKPVPPKPEPKPQPHPDYGPVPKPEPKPQPHPDYHPIPPTPTYGGGGGGGGYHGHH

SEQ ID NO: 15867 - protein, 468 aa, Triticum aestivum
MVISVPSHRRSMRDAMLGGGRQLHKPLRCAFYDGIPGEGLAAALAEATGSVSLSRTPATDGSVGGKAARNVLILMSDTGGGHRASAEALRDAFRLDFGDAYQVFVRDLGKEYGGWPLNDMERSYKFMIRHVRLWKVAFHGTSPRWVHGMYLTALAYLYANEVVAGMMKYKPDVIISVHPLMQHIPLWVLKWQSLQPKVPFFTVITDLNTCHPTWFHHGVTRCYCPSAEVAKRALTRGLDPSQIRVYGLPIRPSFCRAVLDKDELRKELGLHPELPAVLLMGGGEGMGPVEETAKALGHELYDHRRRRPVGQVVVICGRNQALRSTLLSLPWKVPVKIRGFEKQMEKWMGACDCIITKAGPGTIAEALIRGLPIILNDFIPGQEVGNVPYVVDNGAGVFCKDPGEAARQVARWFTTETDELRRYSRNALKLAQPEAVFDIVRDIHKLQPQPAALTRIPYSLTSPFSYHI

SEQ ID NO: 15868 - protein, 576 aa, Hordeum vulgare
MATPPSPPPPTRASCGSFLQELQELWGEIGPDELERDRMILQLEEDCLNVYRKKVEQTRKQKTDLLQVMSLGEAEIGKILSALGERESFSRAEKLGGTLMEQLAKLEPVLDDLRRRRDERINEFLAVQLHIVRLQAEISGTINHGDPAAPLVDETDLSTGRLAELKTQLNELQTEKNLRLQKIDGQIKCINEMCNMMSLDLKKTLYEVHPSFVELERIKAMSISDSTLDRLAGKVHALNQEKKQRLRKLQDLGSTLIELWSLMDTPLHEQKCFDHVTSLISVSPNTVMPQGCLAHDLIEKVEVEVKRLKHLKASKMKELVLKKMTELEEIYRSVHMDIDSDHEWRILTELIDSGRADLSELLTDMDDRITEARDLALSRKDILEKVEKWTLATEEEGWLGEYEGDQNRYNAGRGAHINLKRAEKARVLVSKIPSLLENLTAKVRAWEKEKGAPFLYNKMRLLDSLDKYTSERQQKEEEKRRSRELKKLQEQFAAEQGATYGAKPSPMRPLSARKPLGQSTNVNIVGGTPNNRRVSTPISRKGGLSCGKMKDTGKTAASIPANYVSLPKDCSDNSCM

SEQ ID NO: 15869 - protein, 429 aa, Setaria italica
MARPQRVYEAWKGNNKFLFGGRLIFGPDAKSLILSVSLIVVPVLVFCAFVARHLRHHFSAYNAGYAIPAVALVFMIYVLVLLLITSAQDPGIVPRAAHPPEEEFSYGNALSGGTPGRLQFPRVKEVMVNGMLVKVKYCDTCMIYRPPRCSHCSICNNCVERFDHHCPWVGQCIGQRNYRYFFMFVSSSTLLCIYVFAMSALYIKFLMDEGYPTVWKAFKHSPASLGLLIYCFIALWFVGGLTGFHLYLISTNQTTYENFRYRSDSRPNIYNQGCLNNFLEVFCSKTKPSKHKFRAYAQEEVRPPTVSFGREVEEEPVGGPRSKVEDDLEIGSDLLKISQRRNYEDVDVEMGGRRSNEMEGMASGKLVIGSESHIPAVGSDVRVRHSSWDRRSGNWDMSSDVLTRSASDVIERSVFATEAAHPSQAETHK

SEQ ID NO: 15870 - protein, 521 aa, Setaria italica
MDAAAGTAAALPEAWSQVRAPVIVPLLRLAVAVCLTMSVLLFLERMYMAVVIAVVRLLRLRPERRYRCEPLPEDDPELGSSAFPSVLVQIPMFNEREVYQLSIGAVCGLSWPSDRLVVQVLDDSTDEVIKEMVRMECERWARKGINITYQIRDDRRGYKAGALKAGMKHAYVRECEYVAIFDADFQPDPDFLKRTIPYLVHNPEIALVQARWRFVNADECLMTRMQEMSLDYHFTVEQEVSSSVCAFFGFNGTAGVWRIAAVNEAGGWKDRTTVEDMDLAIRASLKGWKFVYLGDVQVKSELPSTFKAFRFQQHRWSCGPANLFRKMLMEIVTNKKVTIWKKIHVIYNFFLIRKIIAHIITFSFYCLIIPATIFVPEVRIPKWGCVYIPSAITLLNSVGTPRSFHLLFFWVAFENVMSLHRTKATLIGLLEAGRANEWVVTAKLGSAMKMKSANKGGLKKQFMRIWERLHITELGVGTFLFSCGWYDLAYGRDHFYIYLFFQSIAFFIIGFGYVGTIVPQS

SEQ ID NO: 15871 - protein, 568 aa, Setaria italica
MTEESAKKSKLSWSKSLVRKWFNIRPKAQDFHADSDAGQGRDGGGGSWRPRCSASEASASTAKKSRTDRSSSKRSAERARRGKNNFDVARLTEVQDYRIFAATWNVGGKSPPRGLNLDEWLHTSPPADIYVLGFQEIVPLNAGNVLGTEDNLPAKKWVSLIRRTLNKNPGASGCGGYHTPSPVLDPVVELDADFEGSARRQENFPFFHRRSFHNLSRSLRMDGDYMFPQPRLDRRFSVCDPVNLGGRPSDFDGNLRCPGSPDEEIIDMEVSDAAQFSPFPHSYTASAPSEQNDEQSNSSRYCLVASKQMVGIFLTVWVRNEIRDDVRNLKVSCVGRGLMGYLGNKGSISISMSLHQTSFCFICCHLTSGEKEGDELRRNSDVLEILRKTRFPRVRGSGDVKSPETILEHDRIIWLGDLNYRIALSYCSAKALVEMHNWKQLLEKDQLRMQQRYGRVFQGWKEGRIYFPPTYKYSFNSDRYAGEGMHPKEKRRTPAWCDRILWYGNGLNQLSYVRGESRFSDHRPVYSIFLAEVDIVHQRRRNMGYFSSRIEVEELLPHSQSYREIKFY

SEQ ID NO: 15872 - protein, 786 aa, Setaria italica
MGCTASKVEQEDTVRRCKERRRHMKDAVAARQLLASAHADYLRSLRVTAAALSRFAQGHPSLAVSHHTAPVLLSAAAPPPAPGAAHALPTPAPSTAASSSLPPPTPLAQHPHPPPPPPQQQPQPAAAMAAPQPAPVRAPRPRRLRVPHILSDSSVASPAQSSFRKQPPVGTPSSSSAWEWENFYPPSPPDSEFFDRRKAELEEANRLREFEEEEKARTYLHHHHPYNLKEEDEVDDDDDGEVDHEPEGMHCGGWEDDDEHYASTTTSETRSEEGEMGNRSECGFAARSECGYVARSEYGGTAPSEYAAVPLSLRRDERSEAGDSSSTVTAATEMRMVVRHRTLAEIVAAIEEYFVRAADAGNDVSELLEASRAQLDRNFRQLKKTVYHSNSVLSALSSTWTSKPPLAVRYKLDTNALEMESTEGKSHGSTLERLLAWEKKLYEEVKARESVKIEHEKKLSTLQSLEYRGRDSSKLDKTKASINKLQSLIVVTSQAATTTSSAIVRVRDNELAPQLVQLCFALLGMWRSMNHFHEIQNEIVQQVCGLVDNSMAESTSDLHRLATRDLEAAVAAWHSNFNRLIKYQRDYIRALYGWLKLTLCQVDNSAPQEAHASMISRELTSFCDEWKQALDRLPDAVASEAIKSFVNVVHVIYTKQAEEMKIKKRAETYSKELEKKTNSLRSIEKKYYQSYSMVGLGLPGSGRDGIETHAYDARDPLAEKKTEIAQCRRKVEDEMTRHAKAVEVTRSMTLNNIQTGLPGIFQAIAGFSATVVEALDVVCRRAGSVR

SEQ ID NO: 15873 - protein, 488 aa, Setaria italica
MATAAAGSKRGGGRGRKALVAVLDNDANISAGKAAKAGDLSASSAPKAKRAPARSGKAAKAAAAAASVVDDVAELQGMLERLRLEKEKAEEMVRERDEVIRKKEEEIETKEKEQERLQAELRKVQRAKEFKPTVSFPLVKSLLEKEQDAGDKGKRKKGKGKAVPERKKPCTAYVLWLKDQWTEIKKENPEADFKEVTNTLGAKWKALGAEEKQPYEERYRQEKEAYLQVVGQEKREAEAMKLLEEQQMQWTAKELLEQYLKFRQEAEEGDGKKGKRKNSKKVKDPAKPKQPMSAYFVYTQERRAALVAEKKNVPEIGKITGEEWKNMTEAQKAPYEEVAKKQKEEYHKQMGVYKKKKIEEAASLEKEEEEQKKIMKQEALQLLKKKEKADNIIKKTKEKRQKKKQENVDPSRPKKPASSFLLFSKEARKQLLEERPGINNSTLNALISVKWKELSGEERQAWNDKAAPAMAAYKKEMEEYTKAHSSSA

SEQ ID NO: 15874 - protein, 774 aa, Setaria italica
MDTPDRAAAQPAASRAEDSPVFSFINNLSPIEPLKSAYNANSLQGYQSINITSISSIFTSPHDNAHKEPRLPKSSLGEISESEVCADGKNTNKPTKSTNAVRLFACTSTVTQETHTVTCSDVVDPPTVPCNLAQPAQFDNGSPDHNTTPCHGVRSDLKQDKCRKLDVVQTVKSTVEKRKCLFSTEIQLLDGGQPVNDNNEVLGCEWSDLIATTSGELLAFDSTMDDHHRGMHLAAKNAESCGYLLSKLAGDGEISERAYPNASGQVYYQELVMGEDQTENAQIFQDGQQTISTEEIQDNIYEANGCIPLDYKVESQQQRGVRRRCLVFEAAGFSNSVVQKESVEDLSVSTCKGKGHVQTQPRGLRGIGLHLNALALTPKGKMACQDPMASALLPSSASEKDAHGKLLCAGENFTHSGGELLEFPMDDCSSGGFPLNDHVSSQSVSPQKKRRKTDNGDDGEACKRCSCKKSKCLKLYCECFAAGVYCSEPCSCQGCLNKPIHEEIVLSTRKQIEFRNPLAFAPKVIRMSDASLETGEDPNNTPASARHKRGCNCKKSSCLKKYCECYQGGVGCSSNCRCESCKNTFGRRDAETELTEEMKQEGEQTENSGKEKENDQQKANVQSEDHPLVELVPITPPFDLSSSLLKLPNFSSAKPPRPSKARSGSSRSSASKATTTLQSCKSSKAAGSGIDEEMPDILKEADSPSRVKTTSPNRKRVSPPHNALSISPNRKGGRKLILKSIPSFPSLTGDSNSGSAMNNTDNTFSASPLALGPS

SEQ ID NO: 15875 - protein, 846 aa, Setaria italica
MAPNHRLPLRLAVVLLLLLLLPAASRARDTISPGQPLRGNDTLVSSGTGTFALGFFSPPGSNNTYVGVWYAKLPVRTVVWVANRADPVPGAVSHNADATLSVSAGCALAVADANGTAVWSSPAPPPDTAGRPCTARIRDDGNLVVSDGRGRVAWQGFDHPTDTLLPGMRLGVDFAAGKNMTLTAWVSPSDPSPGPVVAAMDTSGDPEVFVWNGPDKVWRSGPWDGVQFTGVPDTITYKPLGFSFRFVNTPQEVTYSFQVRDASIVTRLALNGTGGAAGLMQRWTWLETAGAWSLYWYAPKDQCDAVSPCGPNGVCDTSSVPPCRCLQGFAPRSPVTWALRDGRDGCARATPLDCGNRTDGFAVLPHAKVPDTTEAVVDYGSSLEQCRQRCLRNCSCTAYASANLTGGPGRRGCVMWTGGLDDLRVYPGYGQDLYFRLAAADLAPTSKSKKKVNIVIAVVVSITALAILLAVAGFFIWKAKKTKARKPGSSTWRAGPRSKEGSEGKDHGDDLELPVYDYETIAKATEDFSTENKLGEGGFGPVYKGKLEDGQEIAVKTLSRTSTQGLEEFKNEILLIAKLQHRNLVRLIGCSISGPEKILIYEYMENKSLDCFLFDTTKSKLLDWQTRYHIIEGIARGLLYLHQDSRYRIIHRDLKTSNILLDEEMTPKISDFGMARMFGNDDTEINTLRVVGTYGYMAPEYAMDGVFSVKSDVFSFGVIVLEIITGIRNRGVYSYSGHLNLLAHAWSLLNEGKGLDLVDENLDGSFDSDEVLKCLKVGLLCVQENPDDRPLMSQVLMMLASTDTASLPTPKQPGFAARTAAAEDRSWSKPDCSIVDSMTITMVEGR

SEQ ID NO: 15876 - protein, 497 aa, Setaria italica
MGERRRRGSATAAAAPGAAAAAARAEEEKAASAAAAGKAPPPTVWFALKRSLHCRSEPSDVHVPRAKAGPAAVGGGGGNLSSIVTKRAAPRSGCSRSIANLRDVIHGSKRHPGQPPSCSPRSIGSSEFLNPIAHEVVLSTNSRCELKITGFGGCGGLGAVGTAAAHDADGGGGSDGGVVSSFVGTLRPGTPGPAWAGHGLPYSGSMRGGVRCTPPRSPNVLLERNGSLAVGHRASCEDTAKAGAGKGSGGLSCHRCGEHFGKWEALEAHHLSKHAVTELVEGDSSRKIVEIICRTSLLKSESSCVRIERVFKVHNTQRTLSRFEEYREAVKLKASKLPKKHPRCLADGNELLRFHGATLSCALGAGSGASSSLCASDRCAVCRIIRHGFSARKEGKAGVGVFTTSTSGRAFESIEAPPPASCGDDGADPAAAPRKALLVCRVIAGRVHKPLENLREFAGQTGFDSLAGKVGPYSNIEELYLLNPRALLPCFVVICKP

SEQ ID NO: 15877 - protein, 1091 aa, Setaria italica
MQHDMAEVDGDAPIPAFAVSKGGVVLKHIFLNAPPSSPDRGGAVGGGEEQEEEEDPPVTVGRHPDCHVLVDHPSVSRFHLQLRARRRQRRITVTDLRSVHGTWVSGRRIPPHTPVDLVNGDTLRLGASKREYRLLWLSLREALEMEDAPYMPPLPEDKEEPHAYQEASSQLVAPEQRESADMEAHQETSQQIILEDIDFPAKVIPSAPPLPDFAHSFSVEKSHENIEGVTEDMLVDKNPISESFGSLIIQEMPAALTNAGRPALSDKRDTSNQVSKRSKLKSVKSLRIDTGRSKDRSSALNYSSQKGDQNEILVCSQSCGVECAACIALFGISEFERAEEKEEMIAEDKGHMHPPASITMEGDKKEPNTENYGPQDSVDSKLQKRIGLFDSALPLFGLFDSAFPLHFKDDAFTDKEIPQWSSATVNTESDPVSENLATPELKHDDFVHLNLEESFSNKENMAPNKIVEGPENYQLDSTVCGNLFDNLDTEEIEGNEEICPLDKENITPNLSGSIIMERSHIGLKPIISQELMDSISPLNLAHDNFSENEKSILNTGNQMKSNEPISENLSPLTPADKKLQKSQIECMPISHLEFKDDILLDRENSVLAPGKYDAISPERQENLSSDKENVTPASKVKPTVRRVLGSRMDNSVSAKKTSNKEKCIVLSAKSERIHTIDYDVFYSDKENLTPVSSGGMKARKCLPKNLIVDADQDQEAFCSDKENMTPQSSAARKTRDMSENRARVESAITKKRVADRLPFQTLLSNSPLGPASSLDCNCVVPRTADIAAGDLAIKLEDKLNNLALHKQESGRAGQWMKSWTMVANTDSLLDDESRKSIMLLKGIKGTHLFVPRIVIRELDSMKQREGLFRRSTKATSVLQWIEECMATESWWIHVQSSSEMLPVAPTPPATPSAQRIDEEIKVGSAGSFNPMAALFSPRGFELADIVSPKPEDRVLDCALLLNKLRSDHNVVVLTNSVALKIKAMAEGMVCEGAREFRESLMNPCSSRFMWAASAPRGPAWSRLDAAALAEDYYNSHHHQHGARKQQQQQRKPAEAAAKGLKLILRHNSLYAQATTDAARMTPLPLVSLASV

SEQ ID NO: 15878 - protein, 718 aa, Setaria italica
MGSSPSKATGEDALVLCKDRMRHIRRAIDSRDALSAAHLSYTQSLRAVGTALRRYAESEISPESSLSISEVDKSPSHSSMASPSPSHAVENVASPVHRASPLTTPPSTRIHCMKASGTTPLTFMIDPSAAEFVGQESPVSAFVPPPPPLPPELCTSWDFFDPIDAAGSSSSNNENGLTLNFSRLKGLRESREAEVVPLKEEEEEAVVSERRHTELPDGNAVPKQEREPKQSGISKQRQPVDASSQATSSQQIAAKVEESEMEKELCAETEDPSEFITHRAKDFVASMKDIETRFIRAAEAGNEVSRMLETKKIRLDICPKIPGSPGKLPTAPFLSALRVCCNRDIILNQETAQHVSKVVTWKRSVSSLSSSSKSALMTSIIKDDVDDSNSDFVEEFAMVSGSHSSTLDRLHAWERKLYDEIKASENVRKTYDEKCNLLRRQFARDLNAQLIDKTRAVVKDLHSRVSVAIQAVDAISKRIEKIRDEELEPQLVELIQGLIRMWKSMLECHHKQFITITLAYHVKSSTSAQQGEHHRQAAMNLWNEMDSFSSSFRNWVTAHQSYVEALNAWLQKCVLQPPQDRRRRKRKVSFPPRQAVSPPIFVLCRDWLTLTESLPAEELCKSIKDVMQLLRDSFDHQDDQSKPKSESQECGMLENNEQEEAKSGSVPAAEGLQSRLTMVLDRLTKFSEASLKCYEELKQNYEIAHDDYKRVGPNAQLA

SEQ ID NO: 15879 - protein, 215 aa, Setaria italica
MAGKFGATCSRAAASLFSPRHRRLLFPSTPTPPRFLPFSHRLLPRTLSTIAMTAPNGAADTDAVHEPPQKISKIAPLLKVKKLSDKAVLPSRGSALAAGYDLSSAAEMVVPARGKALVPTDLSIAIPEGTYARVAPRSGLALKHSIDVGAGVIDADYRGPVGVILFNHSDVDFAVKPGDRIAQMIIEVIATPEVAEVEDLDATVRGEGGFGSTGV

SEQ ID NO: 15880 - protein, 219 aa, Zea mays
MLEVRTARRPALADISGGGFFMRTVESPGAVLVNGAVKRPARQFLSPSSNKENVPPVGAFRATPKRRTPLPDWYPRTPLRDITSIVKAIERRRSRLQNAAAQQQIQWTEDPSRSVDPITPVQAEQGGVPTTVDGQGVGSPATCLEDGKLKTSSYPSSDCSLQATPSKPNDPALADLVEKKLSSSIEQIEKMVRRNLKRTSKAAQPSKRTIQRRVLMSMR

SEQ ID NO: 15881 - protein, 336 aa, Zea mays
MSFFFRAASRQRPLPQEIARSLKDSLVALDTKTGAKALEDAEKNILTLRHTLAGDGEVEPNQEQVLQIALEICKEGVLSLFVQNLPSLGWEARKDLVHCWCILLRQKVDESYCCVQYIENHFDLLDFLVVCYKNLEVALNCGNMLRECIKYPTLAKYILESSSFELFFQYVELSNFDIASDALNTFKDLLTKHEDAVSEFLSSHYEQFFGLYTKLLSSTNYVTRRQSVKFLSEFLLEAPNAQIMKRYILEVHYLNIMMGLLKDSSKNIRICAFHIFKVFVANPNKPREIIQVLVENHREVLKLLHNLPTSKGEDEQLDEERDLIIKEIEKLVRLSV

SEQ ID NO: 15882 - protein, 619 aa, Oryza sativa
MATRPGPLTEWPWHRLGNFKYVVMAPVVAHGARRVMRNGWGDLDIAFSLILPSLLLRMIHNQIWISLSRYQTARSKHRIVDRGIEFDQVDRERGWDDQILFNGLVFYAGYLAMPSVRRMPVWRTDGAVVTALVHTGPVEFLYYWFHRALHHHFLYSRYHSHHHASIVTEPITSVIHPFAEHVVYFILFAIPILSTIYLGNVSAMGIVGYIAYIDFMNNMGHCNFELVPEWIFQIFPPLKYLIYTPSFHSLHHTQFRTNYSLFMPFYDYIYNTMDKSSDELYESSLKGTEETPDLVHLTHMTNLQSAYHLRIGIASIASKPYSDSAWYMWTLWPLAWLSMVLAWIYGSSAFVVERIKLNKMKMQTWAIPRYNFQYGLTWEREPINDLIEKAILDADMKGVKVISLGLLNQAKQLNGNGELFRQKYPKLGVRIVDGSGLATAVVLKSIPSDAKKVFLRTGTSKIARAIAIALCDRGVQVIMNEKEVYHMLKSQIPENRASYLKLSSDNVPQLWIVHNIDDNEQKMAPKGTIFIPISQFPLKKLRKDCTYMSTPAMRIPEEMKNIHSCENWLPRRVMSAWHIAGILHALEGWNMHECGDEMMDIEKSWSAAIRHGFLPLTKA

SEQ ID NO: 15883 - protein, 908 aa, Oryza sativa
MHLSLWKPLSHCAAVLLAKNHRRRGGGGGSNGHRGDDPASFLRQLRDALDAASEDGSLCPPPDAAGAGADADADAAVSRSRSLARLRAQRDFLRATALAAAGGPFRSPSDIPLLPAAIAGFLAMYPDYATTSDVDRLRVEHYSHLDAAAPGGGAGGRVCLDYCGFGLFDSGWDSSSSSFTLSELNANLSNHALYGGAEAGTVENDIKERILEYLNVPASEYALVFTVSRGSAFRLLAECYPFETNRRLLTMFDHESQSVSWMAQSARAKGAKTRTAWFRWPTLKLCSTELRKEIVGKRRGRRRDSAVGLFVFPAQSRVTGAKYSYQWMALAQQNGWHVMLDAGALGPKDMDSLGLSLFRPDFIITSFYRVFGADPTGFGCLLIKKSVIGSLQGRNGCNASGMVRIVPVFPQYLSDSVDGFDAMDGLEDDSGVHKDEKPASDARNGSQLPAFSGVYTSAQVREAFESDPGRDSSSDRDGASTIFEETESISVGEVMRSPAFSEDCSSENSFWVDVGQSPLGSEKGGHFKKGKLGSPLPSSWFAGRKSNKRMSPNLTSRISRSPLYDGQVISFDAAVLSVSHDADCLKEDPEEEIYENGRRNHFRQVSEIQEEPEVEEVVCQHAMNGGGDHKESAIRRETEGEFRLLGGRDGNSRFAGGRLFGVEEIDAGLSMGRRVSFSTEANIIADRLHRASDAAEASGYAFRDDDGCVSDGYDNAQDWGRREPEIICRHIDHVDMMGLNRTTLRLRYLINWLVTSLLQLRLPGSKGGDGDPLVHIYGPKIKYERGAAVAFNVKQSDGTFVNAEVVQKIAEKNGISLGIGFLSHIKVDLNHKQLNGAFDIPEASFYKNGRKDSKKVTIRVEVVTASLGFLTNFEDVYNMWAFVAKFLDPSFLESERLTIAADHSEGQT

SEQ ID NO: 15884 - protein, 363 aa, Sorghum bicolor
MMPVEAAAAAAADDWSECAFSLTCEEDCADLGDGVVDDGEFFPLYNAGDEEEEEYLEQLVFKETSFCSSSSDSGADCDGDGDGDGEGDEEYPSLASEEWFRQARLAAVKWILETRGCFGFGHRTAYLAIAYFDSFLLRRRVDREAMPWAAQLLSVACVSVAAKMEECQVPALSEFHAGGYDFDSASIRRMELLVLSTLGWRMRAVTPFDFLPCFSSRVHPHGGAGAGAGGHVALKAIGFIFATAEAGSVLDHRPSTVAAAAILAATYGPLLTKEALGSKMSYLSPSCLIEKEHVHACYSMMVGDMNRRGSKRSLPCSGTNEIATSTYDSVLVDDDVTDTAAAAIATVVAARNKRIRLELTGIR

SEQ ID NO: 15885 - protein, 652 aa, Sorghum bicolor
MAGGGDRQGAKKRKREHAEGKAKPRPQVKGGGDGGKRKKHSAADGGAGEAVARKKTPVTHKEKRIAAKEMSEARKMKRKRHYSLEKELTKLWEKMRCHDVSKEERSKVVSEAIKKMDGKYLDIATSHITARVLQTCVKWCSQSERDAIFDVLHPHLLDLSRKKYAVFLVKKLIELASKKQFASFISSLHGRVAKLLHHTIGAAVVDYAFQRGTKRQKKQLLLELYSTELQLFQDLTLQSSCCLIDTISKLGLQLSSVLQYMTIVIHKILEKGTVEYSIVHTAILEYFTIADKTSASDVICQLIPLLTQGALIIDGDEPSNAPELPKKTKAKKKRSKEPLIVRIMQTREGLKLGIGCLKHGSAKDRKKIIKSLKGHILKLALSDFGCLFLICILSIVDDTKLVSKIVIQELAKHLKQLIFDKNGRRPLLQLLNPLCSRYLSPDDLACLNYNVPSLSPKEGDTSENVVNGMTDEDPNGLVVMQIVSESKKDPLQRRHELLVKTELAEALIQSCLENVGELLRTNFGKEILYEIVVGGKDNILEGLTDRIHMLHDAIVSDAAQPKTEDIEHAFENFFSSRVIRRMIIDCPAFAVTLWRKVLEGKCKIWAEGYSSKVVAGFLESPSKEVKDLAKPELQPLVDAGILKVPDPKVVQK

SEQ ID NO: 15886 - protein, 697 aa, Sorghum bicolor
MAPSWWGRDARANGVVSGGGGTPVVVKMENPNWSISEVAASEVSPGSPAGAGGGKAGRGKNARQITWVLLLRAHRAAGRLTGAASAALAVAAAARRRVAAGRTDSDAAPGESTALRTRFYGCIRVFLVLSLLLLAVEVAAYFQGWHLSVSLEEEVDAGLQAVDGLFAAAYAAWMRARLDYLAPPLQFLTNACVVLFLIQSVDRIVLCLGCFWIRLKGIKPVPLAAADKEDVEAGPEDFPMVLVQMPMCNEREVYQQSIGAVCSLDWPRSNFLVQVLDDSDDATTSALIKEEVEKWQREGVRIVYRHRVIRDGYKAGNLKSAMNCSYVKDYEFVVIFDADFQPQADFLKRTVPHFKGKDDVGLVQARWSFVNKDENLLTRLQNINLCFHFEVEQQVNGAFLNFFGFNGTAGVWRIKALEESGGWMERTTVEDMDIAVRAHLKGWKFLFLNDVECQCELPESYEAYRKQQHRWHSGPMQLFRLCFVDIIKSKIGFWKKFNLIFLFFLLRKLILPFYSFTLFCVILPMTMFVPEAELPAWVVCYIPATMSILNILPAPKSFPFIVPYLLFENTMSVTKFNAMISGLFQLGSAYEWVVTKKSGRSSEGDLLALVEKHSKQQRVGSAPNLDALTKEESNPKKDTKKKKHNRIYRKELALSFLLLTAAARSLLSAQGIHFYFLLFQGVSFLVVGLDLIGEQVD

SEQ ID NO: 15887 - protein, 920 aa, Sorghum bicolor
MPSGKAKAPKGGEDPGIPPVPCEGEISHEPQRQRSLNGRTTGPTRRSTKGNWTPEEDAILSRAVQTYQGKNWKKIAECFPDRTDVQCLHRWQKVLNPELVKGPWSKEEDEIIVQMVNKYGPKKWSAIAQALPGRIGKQCRERWHNHLNPAINKEAWTQEEEITLIHAHRMYGNKWAELTKFLPGRTDNAIKNHWNSSVKKKVDSYISSGLLSQVPCLPLIEYPAQCDSLSSMDQENNGDSVCNAQNTSMALSSDLQVNVDANKREAQDSHSSLCQGACYPSTEAVGSVLPDENHHVPSSFSQRMDLQMDMDEGSGNSMFADDQTLCSTSNQEKSMVPFVVAQEMPVSVLSGVSSAEQKLHLISDAESLKSELWKDVSLQTLISGVTVDADASRLNHPDSSKMDTNFLTQAYPLHTSNPSGVMETVYEPMPSETISPSFICSDGLSVAPENRSEPREMPDCEAQMATSSNIFCDGDQSAIPGSSDDRPEAFTMTESITNCGGQQSTDAEEPMATTAKEQLSKDIETVPDEKKGEGALFYEPPRFPGLDVPFISCDLVTSADLQEFSPLGIRQWMRSTMNVPTPLRLWGSPTHDESPDLLKSAAESFPCTPSIMKKRQRGLLSPTPDKRIEKKSGIAKGVTDISYMITTTCSMNATNDGDIVTESVVCAEQPSFKHLDKKLEFSNINMENSDGASKQAKDPQNAGNKRLVEESSPNVANPNTDLQDNIQPVRILVEHSSNNLIAADHGAKPSCKEVISSKSKPTELLVEKSSPCINADYEYVNLLADTPGVKRGLESPSAWKSPWYIDMHMHFQGFVSPADRTYDALGLVKHLSKHSAAAAVEACEVLASGNRTSDKENKDNTDGKEPVARKSQVKIMAEARVLDFDESSTPARTADKKFGSCLGRSVSSPILPSPNLRSFR

SEQ ID NO: 15888 - protein, 426 aa, Sorghum bicolor
MATAVSTPVDLSPAPAPAPAPRRRGRPPKNPAPAEAPGSSPVSPLAAAASEADAGGEYERQRAARIRENMERMQKLGILDLAHTLSQSAAASGSGGRRRRKPVEQGSVDAARVKPSPPPPSRRSLRLKDVEPVSYCEIEPKKEEHSEDGKTVVIEVGAKEEIYTEEHDKLLGTCNTPWTLFVDGYGKDGKRIYDQVRGQTCHQCRQKTLGHHTSCCKCQIVQGQFCGDCLYMRYGENVLEVKKNPNWICPVCRGICNCSICRTKKGWFPTGAAYRKVVGLGYKSVAHFLIATHRASSVNPEDSSSADKKKLLSAKSETSCISDHDGLDANENPEDGETSSKAKLNKSTHCQVKSSDGDKDDSRSVVTSDCQDDEANKDAGCVTPSSKPMSRKRKYVERSPDCIASRLRSRLNMHMTSDQVHGSLLR

SEQ ID NO: 15889 - protein, 592 aa, Solanum lycopersicum
MEGRHSHPSTPIPEDFVQKRGKKRGSYNCGRCGLPKKGHVCDLTKEFSEVPTPTSSDAKSFVLPSQLSVIRSNPTPPLPPPRQPVVQLRRALSFDDIGVTDESPGSDDEGEGEFLDFESELDLGGSGKLPANCLWEVLKRLPPSSLLSSAKVCKGWRDVSRRIWKSAEELRLEVPMKAQIGLVGSVLQKCPGLVKLSLRMKSDVDATMLACIAFSCPNLDSLEILTSDTSVNRITGDDLGRFVADKRCLTNLKMEGCSNLGGFTLSSTSLSTLCLLELFCHSKMVFNCPNLKEISLIFSCQENENTDLTAMVNGLGRSCPRLQNIHVASVRLTHAVVLALTAANLRGLRMLSLVLGSEITDASVAAIVSSYSRLELLDLSGSSISDSGIGMICNVFPETLLKLLLALCPNITSSGIQFAAAQLPNLELMDCGMSICDPDLDSPAAQENDNVDIQRTPSSKLHLIYQKLIIKHSHLKKLSLWGCSGLDALYLNCPELNDLNLNSCMNLNPGRLLLQCPNLESVHASGCQDTLVEALQNQVCGDFMVEDDHFPCKRLPDGSKRIRVPHSYSPQPFDDGKRKRRLSKQRCAVLVY

SEQ ID NO: 15890 - protein, 203 aa, Arabidopsis thaliana
MGRMDYLAMKTDDVDTVALVNSDMEELKVAAKKLFSDVSKLGGLGFGVSFLKFLASFAAIYLLILDRTNWKTKMLTSLLIPYIFLSLPSVIFNFLSGDVGKWIAFVAVVLRLFFPKHFPDWLEMPGSLILLLVVSPHFLAHHIRGTWIGTVISLFIGCYLLQEHIRASGGFRNSFTQPRGVSNTLGIILLLVYPVWALIVRVM

SEQ ID NO: 15891 - protein, 374 aa, Hordeum vulgare
MAIPLVLVLLPLGLLFLLSGLVVNTVQAVLFLTIRPFSKRLYRQINVFLAELLWLQLIWLVDWWAGVKVQVYADPETWKVMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAVSQGLTAPRNVLIPRTKGFVSAVSIMRDFVPAIYDTTVIIPEDSPKPTMLRILQGQSSVVHVRIKRHSMSDMPNSDEDVSKWCKDIFVAKDALLDRHITTGTFDEEIIPIGRPVKSLMVVLSWSCLLLYGAHRFLQWTQLLSTWKGVILFATGLAMVTAVMHVFIMFSQAERSSSAKAARDRVKRD

SEQ ID NO: 15892 - protein, 511 aa, Setaria italica
MHRLSLTVIDAAAAMPAALRLGGSPALRLAAARRPGPRPPPWLRFGVGGGAVARRGLLCSAEAARRGGEGEDTEVEDARRGSGSRAGAERRTRGGSAAAAVGTSVELLAIPGVGPRNLRKLVDNGFEGVAQLKQLYRDKFFGKSSEQMVEFLQSSVGIVHKNHAESITSFIKESVDEELKDTDSSKPTQKKRLTFCVEGNISVGKTTFLQRIANETIELRDLVEIVPEPIDKWQDVGPDHFNILDAFYAEPHRYAYTFQNYVFVTRVMQERESQAGIKPLRLMERSVFSDRMVFVRAVHEANWMNEMEISIYDSWFDPVVSSLPGLIPDGFIYLRASPDTCHKRMMHRRRSEEGGVTLDYLQGLHEKHESWLLPSKGSGPGVLSVSQLPMHMEGSLPPEIRDRVFYLEGNHMHSSIQKVPALVLDCEPDIDFNKDIEAKRQYARQVAEFFEFVKKKKEEAPSDQTSADKDRMNPHVMLPNRGRLWVPDGNPFTGSPMNLDFRRAMSSYLST

SEQ ID NO: 15893 - protein, 511 aa, Setaria italica
MHKLLPRAASVLYAAAAAPLLLSSPRMPALCLAGSPFATSRPVANPSRIRSPPWLRCGGGRRGLCSAEAARRGGDAEEEKEKGGGGRAVPERRQRGRSDALGESGELLAIPGVGPRNLRKLVDKGFDGVAQLKQLYRDKFFGKSNEKMVEFLQNSVGIIHKNHAESITLFIKESVDEELKGTDTSKLPKNRRLTFCVEGNISVGKTTFLQRIANETIELRDLVEIVPEPIAKWQDVGPEHFNILDAFYAEPERYAYTFQNYVFVTRVMQEKESACGMKPLRLMERSVFSDRMVFVRAVHEANWMNEMEISIYDSWFDPVVSSLPGLIPDGFIYLRASPDTCHKRMMVRKRSEEGGVTLDYLRGLHEKHESWLLPSKGGASGVLSVSQLPVHLEGSLPADIRDRVFYLEGDHMHSSIQKVPALVLDCEHDIDFNKDIEAKRQYARQVAEFFEFVKKKKESSTAETIDGDKSINKQIMLPQSGGLWVPGSSRLPESALKSFDFRRTMSSFLST

SEQ ID NO: 15894 - protein, 449 aa, Setaria italica
MAGGCALSGGCPTDFAAFAIASAVLALLIFRALFPFIYRKGKRTGVWLVIVQIIGSTDLLLSLVMSMNFLKLKLGHPWKSCYLWAVWAEGPFGFGLLISCRIVQGFQLYHVFVKHRLPPIRPSIILVVILLPWICGAAVFHWNKPLNHRCHMQAQWVIPVMCIHGFYIAGLIVITLSIRHIEFRFSEFKDLLQAIIVSTIAVGFWIVAYVLNEIHEDIAWIQVFSRFSLLVMASILVLLFFSMSISQPLHSQISLGKQESTAFMTMGEALGITDRGSVKKINATHFDSNQPLDKLLEDKRFRMSFMSFADSCLAGESVHFYEEVYDLKKIHLDDSIRRIYMARHIIEKYIDAGAEMEINISHRTRQEILGTPDLTHPNLFDSAVSEILQLIKMNLAKDYWSSLHFAKLKEDIERGPNGPELMPLDYSPRVTFVRCTDDPFYEEHAATCN

SEQ ID NO: 15895 - protein, 498 aa, Setaria italica
MMQQMQQEPWNAAAVGLLRPTKSAPCSPIKPAAAAGMVRTHSDSFHVAHKVPVGDTPYVRAKRVQLVDKDPEKAIALFWSAINAGDRVDSALKDMAIVMKQQNRAEEAIEAIKSLRSRCSDQAQESLDNILLDLYKRCGRLDDQISLLKHKLQLIHQGHAFNGKRTKTARSQGRKFQVTLEQEATRLLGNLGWALMQKENYTEAEGAYRRALLIGPDNNKMCNLGICLMKQGRVLEAKDVLKQVRPAAVDGLRGADSHLKAYERAQEMLRDLEAKLVGRPRADQLDTSWLFDALLLGSSSSIWQPQPCIDHLLPPSAPAPVPAPAPARRDHFADENACVSKKLAALQANMLNVDAQPFYSLRMPPLATKPQNTVQQQPQQKPTPVHDPLGNLKRTRSGNCMDKAGAVVDKEQSTDENSGRRKSLSAEDRWPELPDHSAFDEALVAAVLAPVLDDEPAATEGNGHGKLPASCGTSPVVKEKIGKRLRIFQDITQTVNNF

SEQ ID NO: 15896 - protein, 272 aa, Setaria italica
MRYGEVAHFSHPQHRLRLEHHDTPFRCDGCREVGIGARFRCPYPGCDHDLHRQCALPLSPPPPPLRHPFYPRCAFAFLPRAPGAPGSRYCNACGRDVAGYVYHCRACGFDLHPCCAALPHALDAGGGVRLRLHPDSRATGVAACHRCGHRGRSWSYRSQCGSFSLHVACVMDMLVESWHGIGRHKGVAGGGGNVYDGGMLVPGCGGYRVPAIRGAAKSAHASRGGYSTWGRKKGKVKRCCEIAGFAAQVVISAVLGDPTALIAGVIGSLIAR

SEQ ID NO: 15897 - protein, 1264 aa, Setaria italica
MAESALADGKAEKAASGGGGDAAGEGKKRADQAVAFHELFSFADKWDLMLMAAGSLGALAHGAAMPLFFLLFGDLINGFGKNQTDLRTMTDEVAKYALYFVYLGLVVCVSSYAEIACWMYTGERQVIALRKAYLDAVLRQDVGFFDTDARTGDIVFGVSTDTLLVQDAIGEKVGNFIHYIATFLAGLVVGFVSAWRLALLSVAVIPAIAFAGGLYAYTLTGLTSKSRESYANAGVVAEQAIAQVRTVYSFVGESKALNSYSEAIQNTLKLGYKAGMAKGLGIGCTYGIACMSWALVFWYAGVFIRNGQSDGGKAFTAIFSAIVGGMSLGQAFSNLGAFSKGKIAGYKLLEIIRQKPSIVNDHKDGKWLAEVHGNIEFKEVTFSYPSRPDVMIFRDFSLFFPAGKTVAVVGGSGSGKSTVVALIERFYDPNEGQVLLDNVDIKTLQLRWLRDQIGLVNQEPALFATTILENILYGKPDATVAEVEAAATASNAHSFISLLPNGYNTMVGERGTQLSGGQKQRIAIARAMLKNPKILLLDEATSALDADSESIVQEALDRLMVGRTTVVVAHRLSTIRNVNMIAVIQQGQVVETGTHDELLAKGSTGAYASLVRFQESARNRDLGGASTRRSRSMHLTSSLSTKSLSLRSGSLRNLSYQYSTGADGRIEMISNADNDRKYPAPRGYFLKLLKLNAPEWPYAVLGAIGSVLSGFIGPTFAIVMGEMLDVFYYRDPNEMEKKTKLYVFIYIGTGIYAVVAYLVQHYFFSIMGENLTTRVRRMMLSAILRNEVGWFDEEENNSSLVAARLAVDAADVKSAIAERISVILQNMTSLMTSFVVGFIIEWRVALLILATFPLLVLANFAQQISMKGFAGDTAKAHAKSSMVAGEGVSNIRTVAAFNAQSKILSLFSHELRIPEQQILRRSQTSGLLFGLSQLCLYSSEALILWYGSHLVRSHGSTFSKVIKVFVVLVVTANSVAETVSLAPEIVRGGESIRSIFGILNRATRIEPDDPESERVTTIRGDIELRHVDFAYPARPDIQIFKDFNLKIHAGRSQALVGASGSGKSTVIALIERFYDPTGGKVSIDGKDIRRLNLKSLRLKIGLVQQEPVLFAASILENIAYGKDGATEEEVIEAAKTANVHGFVSQLPDGYKTAVGERGVQLSGGQKQRIAIARAVLKDPAILLLDEATSALDAESECVLQEALERLMKGRTTVLVAHRLSTIRGVDRIAVVQDGRIVEHGSHNELLTRPEGAYSRLLQLQHHRV

SEQ ID NO: 15898 - protein, 453 aa, Zea mays
MKERGGSRAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLVWDVEAQPNRHAVLGASESRPDLILTGHQENAEFALAMCPAEPYVLSGGKDKFVVLWSIQDHISALGDSSSSPGASGSKQSGKIANEKESPKVDPRGIFHGHDSTVEDVQFCPSSAQEFCSVGDDACLILWDARTGTDPAVKVEKAHSGDVHCVDWNPLDVNYILTGSADNSVRMWDRRNLGSGGAGSPIHKFEGHKAAVLCVQWSPDRASVFGSSAEDGFLNVWDHEKVGKKKNSNVPAGLFFQHAGHRDKIVDFHWNSSDPWTIVSVSDDGESTGGGGTLQIWRMSDLIYRPEDEVLTELENFKAHLASCAPRN

SEQ ID NO: 15899 - protein, 694 aa, Zea mays
MPALAVDAATPVAHAFASCDAARFPAPPVVGPAAAAEAAPWSADLSAALYNVDGWGAPYFFVNDDGDVAVRPHGAATLPGQEIDLAKVVAKAAGPRAGGGLGLPLPLLVRFPDVLRHRVETLNAAFGYAVRSTGYGSRYQGVYPVKCNQDRYVVEDIVEFGAPFGFGLEAGSKPELLLAMSCLAARGGLDALLICNGYKDDGYVSLALMARSMGLNTVIVLEQEEELDIVVEASRRLGVRPVVGMRAKLRTKHAGHFGSTSGEKGKFGLSAAQILSVVTKLKAIGMLDCLQLLHFHIGSQIPTTALLSDGVGEAAQIYCELARLGADMRVIDVGGGLGIDYDGTHSAQTDMSVAYSLEEYAGAVVAAVGRVCDRKGVQHPIICSESGRALVSHHSVLVFEAFSATAPGRLDAATAYLLDELTDDCRADYRNVMAAAVRGDYDTCGLYADQLKRRSAEQFKEGVLGLEHLAAVDAFCELVARGMGAPEPPRTYHINLSVFTSLPDMWAIGQQFPIIPIQRLQERPAVDGVLSDLTCDSDGKVSEFIGGRHSLPLHELPTHATRGYYLGMFLGGAYQEALGGLHNLFGGPSVVRVSQCDGPHCFAVTRAAAGPSCADVLRAMQHEPEVMYEVLKQRTDGATAAALARAFGAMPYLVFDPEAAVMSGGESSDSERSAAGAAEEEDDEEWEFMRGLTV

SEQ ID NO: 15900 - protein, 529 aa, Zea mays
MMKSLLPQSQLRRSAAAAARSSAGGAAGADGAMSDGGGAGPRAPASSTFWFLLHALCCLISLFLGFRFSRLLFFLLFSTTALYRSSTSSSSAAVLRATTTTTTTTTTTTTTTNTFTLSFAAANTPPSTPANRTALDVADKGAASGNPQSHVVVGRHGIRIRPWPHPDPVEVMRAHRIMERVQEEQRRWYGVKEPRQVLAVTPTYSRAFQALHLTGLLHSLRNVPYPLTWIVVEAGGTTNATASMLARSGLTFVHIPFPDRMPHDWADRHATENRMRLHALRVIRERKMDGVVVFTDDSNVHSMELFDEVQKVQWMGAVSVGILAHTGTADQLRLSEEDKQNMPLPVQGPACNSSGHLIGWHTFNSLPFSGKTATVVGEAAPVLPRGLEWAGFVLNSRMLWKEADGKPDWVKDLDAVGENGEEIENPLTLLNDPSSVEPLGNCGKKVLLWWLRVEARADSKFPEGWVIEPPLEVVVPAKRTPWPETTTELPAELLDDKQEQEDRRLSRANKSSRPRGTTKRKGDPQGQDN

SEQ ID NO: 15901 - protein, 1192 aa, Zea mays
MVAMEGKGDASVTPVRTSDRLRQRPKYYARGYMYYNPAMRKKVKSKKRTAASQIAKKLLRKPAARPPPADCVAANLRRSTRKRRISVNLEGYDTDSSSMEDDDLMRPRYRSSKSKGGNNAAHNEVSARPKRQKLSNSIPRREGLRPRRSLRGQRLHPYHESEDDQESSDEQGAEDQRENGNEIEEDVGDEEEVDGGDEAEGDGDDEDGEEEQEGRRRYDLRERSEVRRPSPRKEGKHRPQSPRRVLVHGIGPKNSKYLKKGGSRMHKRPRFSLPDDSDDSLLVDEPDEGPSMPWMRSGRGSMPWLMGGLDMHSPAAWGLSVGASGWGHQGDTSTSLMPGVQTAGPSSKGGADIQPLQVDENVSFKDIGGLSEYIDALKEMVFFPLLYPDFFANYHITPPRGVLLCGPPGTGKTLIARALACAASKAGQKVSFYMRKGADVLSKWVGEAERQLKLLFEEAQKNQPSIIFFDEIDGLAPVRSSKQEQIHNSIVSTLLALMDGLDSRGQVVLIGATNRIDAIDGALRRPGRFDREFYFPLPGYEARAEILDIHTRKWKDPPPKELKMELAASCVGYCGADLKALCTEAAIRAFREKYPQVYTSDDKFVIDVDSVSVEKYHFLEAMSTITPAAHRGSIVHSRPLSTVIAPCLKSHLEKIMEHISDIFPFLSSIDFSKFSALSYGSSIPLVYRPRLLICGGESVGLDHVGPAVLHELEKFSVHSLGLPSLLSDPSAKTPEEALVHIFGEAKRTTPSILYIPQFHLWWDTAHEQLRAVLLTLLNELPSNLPVLLLGTSSVVFTDLEEECASIFSSRNVYQVDQPSFDDRLRYFSILFESLLSFQMEESRNKSKKQKSAIDLPKAPKEVEGPKVSELKARAEAEQHAVRRMRMCLRDICNRILYNKRFNVFHFPVLEDEVPDYRSIIHKPMDMATVLQRVDSGQYLTRAAFIKDIDLIVSNAKTYNGDDYNGSRIVSRACELRDVVQGMLSQMDPSLVSFCDKIASQGGPLQAVDDEDRAILQAAPVAQLVSGTRISARLRNVQPEVNLSQSYEVLRRQKKSAENEQSMTRDEKSPEDVDLSKPTDAEEAAKEPESNGTTKEANDSPAKEPEVSTSPEPMESDNGKIAAATGDDLLEQLEALKQRFMELTASYGVPQLERLYSKIMKGAIELTSKESNEDHRRLVVRYLWTFVENSNNF

SEQ ID NO: 15902 - protein, 1089 aa, Zea mays
MSVWNYVVTAHKPTSVSHSCVGNFTSPNQLNLIIAKCTRIEIHLLTPQGLQPMLDVPIYGRIATIELFRPHNETQDFLFIATERYKFCVLQWDAEKSELITRAMGDVSDRIGRPTDNGQIGIIDPDCRLIGLHLYDGLFKVIPFDNKGQLKEAFNIRLEELQVLDIKFLHGCAKPTIVVLYQDNKDVRHVKTYEVALKDKDFVEGPWSQNNVDNGAGLLIPVPAPLGGVIIIGEEQIVYCNANSTFKAIPIKQSIIRAYGRVDPDGSRYLLGDNTGILHLLVLTHERERVTGLKIEYLGETSIASSISYLDNGVVYVGSRFGDSQLVKLNLQADASGSFVEILERYVNLGPIVDFCVVDLDRQGQGQVVTCSGAFKDGSLRVVRNGIGINEQASVELQGIKGLWSLKSSINDPFDMYLVVSFISETRFLAMNMEDELEETEIEGFDAQTQTLFCQNAINDLLIQVTANSVRLVSCTSRELVNQWNAPAGFSVNVASANASQVLLATGGGHLVYLEIRDAKLVEVKHAQLEHEISCLDLNPIGENPQYSSLAAVGMWTDISVRIFSLPDLELIRKENLGGEIVPRSVLLCTLEGVSYLLCALGDGNLFSFLLNASTGELTDRKKVTLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSRTLAFCSFKYNQSVEESETHLIRLLDHQTFESLCVYPLDQYECGCSIISCSFADDSNVYYCVGTAYVIPEENEPTKGRILVFAVEDGSLQLIVEKETKGAVYSLNAFNGKLLAAINQKIQLYKWMSREDGSHELQSECGHHGHILALYTQTRGDFIVVGDLMKSISLLVYKHEESAIEERARDYNANWMTAVEMLDDEVYVGAENSYNLFTVRKNSDAATDDERARLEVVGEYHLGEFVNRFRHGSLVMRLPDSDIGQIPTVIFGTINGVIGIIASLPHDQYIFLEKLQSTLVKYIKGVGNLSHEQWRSFHNDKKTAEARNFLDGDLIESFLDLSRSKMEEVSKAMGVPVEELSKRVEELTRLH

SEQ ID NO: 15903 - protein, 631 aa, Zea mays
MAMVPSDSSHHGAVDNSPNGFTQGRREEARKLGPSWYFSRKEIEEHSPSRRDDIDLKKECSLRKSYCSFLQDLGMKLKVPQVTIATATVFCHRFFLRQSHAKNDRRIIATVCMFLAGKVEETPRPLKDVILVSYELIHKKDSTAGQRIKQQKEIYDKQKELILLGERIVLVTLGFDLNIDHAYKPLVEAIRRFNVGSKSSLPQVAWNFVNDGLRTSLCLQFEPHHIAAGAIFLAAKFLKVKLPSDGDKVWWQDFDVTPRQLEEVSSQMMELYVQNRTPQAQQSQGSEAEGSSAGVRNQHSSVKSEGNSKEPSAHGYHPAFKPSNLHHSSLAGAPGDHDSGHSNSDKHVSGHKMLQNDNGNHVGSKEKNKSGGKSDAGMDRFCHEKSPPGHHYSKVSHESHNPVEEQKPHQSHDNPNERIDGILGGNEVPGVSTSRIDAMNKIDKGKVKAALEKRRKTKGDITTKVDVMDDDDLLERELEHGVELAIEDEKIKQDKMQNLSHIKDKKITQDNMQNLSHIKDEQDNMQNLSDIKDEKIKQDERQNMSHAPVDLQTTDQVMENGHHVEPSVPTTVEDTGFPLDNKEHPPFDKQNDVPEHESQQLEHTLKHDLPQLVGGPEQDDGTDCKRPKLEE

SEQ ID NO: 15904 - protein, 1449 aa, Zea mays
MPEMVRFKGWCPPPHMRRGPFSPYRETPSRKLTVSRSRFRNTRHSSPPEALRLPLRRSPGEMSPPFVFPSTLRDLERDTDGDRDEEPSLRPQNPVAVATLRAADLEEFVKGASFDLSDKELFCIEEQEVFDAIYSIVRDFNCLPPALKFNIVETLRSNLSVLLPSIDSLSRASMSSPSDATEITDRIASHRNALKIYSFFLISIVLTAEAGAESCTAAKATAHGRKKNHIYSWNWEAQRGRIMSLVANSLEANLSLLFGPGGTDERYLSFVSKCTFVLCENQNVLKDEDTRNGLCRIIGAIATKHQRISQISASVSHLIHKFDFTVPHLAEAVASAEKKFGDGSLAISLIREIGRADPKEYTRDSVGADNVGRFLVELADRLPKLMSTNIGVLIPHFGGESYKIRNALVGVLGKLAAKAFKDVEGDSNARLRSKQAMLEILIERCRDVSAYTRSRVLQVWSELCEENSISIGLWNEVASVASGRLEDKSAIVRKSALQLLITMLQHNPFGPQLRTATFEATLEKYKEKLQGMEPSNSDKDEAANDSSPGEVIMGQDESVSDSCLASSQDQNDRDATIVDITNLEQIRALVASLEAGLRFSKCITSLMPILVQLLASSSATDVENTILLLMRCRQFQIEGSEAALRKMLPLVFSQDKSIYEAVESAFITLYTRKSPIETAKSLLDLAIDCSIGDLAALESLISSLVSKAEISSSMVSALWDYFCFNINGVRPVQSRGALSILCMAAKSSPSILGNHLQDIIDIGFGRWAKEEPLLARTACLALQRLSEEDKDKLISNNSRVFAALQGLVTSFSIPEKIWYGAADKAISTIYTLHPAPELFATETAKKSLSSVFSVLGTNDVSNGDEAQNGASLSSVSPSKLGRFLFVISHIALNHLVYIENSVRKIQKQKRKNEKSQPTTEDLQPDVSKSLEAQGINAELGLSATIDIAIESLAERAEKEIVCCSSEKNLIGHCGPFLSKLCRNLALLQKFPDLQASAMLALCRLMIIDAEFCEANLQILFTVAESAPSETVRSNCTIALGDLAVRFPNLLDPWTEYIYARLRDPSVSVRKNAVLVISHLILNDMMKVKGYINEMAVRIEDKDERISSLAKLFFHELSKKGSNPIYNLLPDILGRLCNQHLKEETFCNIMQFLINSIKKDKQMEALVDKLCNRFAGVNDVRQWEYISYCLSQLTFTEKGLKKLIDNFKMFEHALSEDSVMNHFRSVISKCKKFAKPELKICIEEFEEKLSKVHQEKKEQEETTKNAEAHRQRIDSLDEFLVTKEVSENSGNSAEDETSEVVDPSVDSSTEHMENTPECSVNTSAENSQTTAPLTESEGGGEEIQSAQPVSKGMSRLRAKKTRDPVVDPSVDRSTEYKGNTPEHSADTSTENSQTSAPLTGTEGGSEEIQSTQPVGKGVSRSRARKTRDPVVEDSAAPVRRATRSTRRQGS

SEQ ID NO: 15905 - protein, 396 aa, Oryza sativa
MDAMRQSTPRAMLLLCAVLMLAVAPPGAATAAAVAGCECGNAAAAAVAGEDARGALRLKLVAIASILAAGAAGVLVPVLGRSFAALRPDGDVFFAVKAFAAGVILATGMVHILPAAFDALASPCGGGRGGGGGFPFAGLVAMAAAMATMMIDSVAAGYYRRSHFKKPRPVDDPADAARAAGVEEGGAEHAGHVHVHTHATHGHAHGHVHSHGHGHGHSHGSAPAAATSPEDASVAETIRHRVVSQVLELGILVHSVIIGVSLGASLRPSSIRPLVGALSFHQFFEGIGLGGCIVQANFKAKATVIMATFFSLTAPVGIALGIAISSSYSKHSSTALVVEGVFNSAAAGILIYMSLVDLLAADFNNPKLQTNTKLQLAVYLALFLGAGMMSLLAIWA

SEQ ID NO: 15906 - protein, 528 aa, Oryza sativa
MGSKTKGCCGWLIVALVASLVATAAVVAIMKKKVGGGSGRKLKPLPVPGPPGAIDSKYGDALGVALQFFQVQKAGKLENNQIPWRGDSALDDGKPAGLDLSKGMYDAGDHIKFSFPMAFTATVLSWSILEYGDQMSAAKQLDPALDALRWITDFLVNAHPSDNVFYIQVGDPDLDHNCWERPETMSEKRPLTQINTKSPGSDVAAEAAAAMASASIVFKSRDTTYSDSLLQHAQKLFTFADTYKGLASDTYPKLQNYYNSTGYQDELLWAASWLYHATGDQTYLSYVTVENGKAFADWGRPTWFSWDDKLAGTQVLLSRLNFFGSKQTSNAENMGLKMYRDTAEAVICGLLPDSPSATASRTGGGLVWISGWNSLQHATNAAFLAVVYSDYMLTSQTAAVQCSGKYYSPTDIRNFAISQANYILGDNPMKLSYLVGYGSSYPQQVHHRGASIPADAKTGCKGFQYLHSTSPNPNVAMGALVGGPFQNDTFVDSRDNAVQTESSTYNSGTLVGLLSGLVTTSSVAQSFT

SEQ ID NO: 15907 - protein, 619 aa, Oryza sativa
MSMYGRDPWGGPLEICHDSATDDDRSRNLDLDRGALSRTLDETQQSWLLAGPGDQGRKKKKYVDLGCLVVSRKLFVWTVGVLLAAAVFAGLVAGIAKAIPRHHRPPPPPDDFTVALRKALMFFNAQKSGKLPKNNNVHWRGNSCMKDGLSDPAVGRSLVGGYYDAGDAVKFNFPAAFSMTLLSWSVIEYSAKYEAVGELGHIRDTIKWGADYFLKTFNSTADTIDRVVMQVGSGATSPGSTQPNDHYCWMRPEDIDYPRPVVECHACSDLAAEMAASLAAASIVFKDNKAYSQKLVHGATTLFKFARQNRGRYSAGGSDAAKFYNSTSYWDEFVWGGSWMYLATGNSSYLQLATHPKLAKHAGAYWGGPDYGVFSWDNKLTGAQVLLSRLRLFLSPGYPYEEILRTFHNQTSIIMCSYLPIFKSFNRTKGGLIQLNHGRPQPLQYVVNAAFLASLYGDYLEAADTPGWYCGPHFYPIETLRNFARTQIEYILGKNPLKMSYVVGYGNRYPKRVHHRGASIPKNGVHYGCKGGWKWRETKKPNPNIIVGAMVAGPDRHDGFKDVRKNYNYTEATLAGNAGLVAALVALSGEGHGVDKNTMFSAVPPMFPSPPPPPAPWKP

SEQ ID NO: 15908 - protein, 444 aa, Oryza sativa
MLETKPPSPGTAGAAGVAGGGYHRRWAAPLLASVLLSSLLIAASLFFSSSRALLLSFSPLPSAASAEPLFVEAKLRQQQQMRGAAASGGRGRGAVPRIAYLVSGSAGDGAALRRTLRALYHPSNMYVVHLDLEAPATERAELAAAVRADPVYSRFRNVKVVTRANLVTYRGPTMVANTLHAAAILLREGGEWDWFINLSASDYPLVTQDDLLYVLSDLPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLNDFDGMVNSNAPFARKFGREDPVLDKIDQELLGRQPDGFVSGGWMDLLNTTTVKGSFTVERVQDLRPGPGADRLKKLVTGLLTQEGFDDKHCL

SEQ ID NO: 15909 - protein, 454 aa, Oryza sativa
MVRKEMGGGGGRLAAEYQGLEVKVPTFFRCPISLDVMRSPVSLCTGVTYDRASIQRWIDSGNTTCPATMLPLPSTDLVPNLTLRRLIALWASTAAPSSPAAPSAVGPTPAAAAAELLRRVGAPGVDPCPALRKLAAFLSDDDVDEFDKNALARAGGAAETVASVLRRRGKGDDDDGGVEAVEAAVRVLAVLATSDCIEEENRRRVAAVLAAGGAAPSVAASLARVMRSGSGLEARVDAARLVESLLRDGARGATAPGVRAAVAESEELVAELIRLVGPTDEKGSLDAQAVDAGLSCLAAIVAATRRARAEMVRLGAVPAAVRVLATDHHGGSHAQALRVLEAAVGCAEGRAAVCEVAEAAIPAVVSRMMRCGGMGGAEAAVSVLWAVCHRYRDRRAVEAAAASKGGLTKLLLLMQSGCSPAARQMASELLKMFKVNAKSCLAGYDSKTTHIMPF

SEQ ID NO: 15910 - protein, 513 aa, Sorghum bicolor
METASFLSVALALAALVPVSLLLLNRLLYGKLPPGPRRRPVVGNLFDVRPVRCRCYQEWARRYGPIMTVWLGTTPTVVVSTSELAKEVLKTHDQHLADRCRDRSSERFSRGGQDLIWADYGPHYIKVRKLCNLELFTQRRLEALRPIREDEVTAMVESVYKAATAPGNEGKPLVVKNHLSMVAFNNITRLAFGKRFVNAAGELDEQGREFKAIVHNGIKVGASLSIAQHIPWLRWLAPVDEQAFKAHGDRRDRLTVKIMEEQAKALKQHGAQQHFVDALFTLRDKYDLSDDTVIGLLWDMITAGTDTTVISVEWAMAELLRNPRVQEKLQEELDDVVGRDRVLSETDFPNLPYLQAVVKESLRLHPPTPLMLPHRASASVKIAGYDIPKGANVVVNVWAVARDPAVWDDPLEFRPERFLRENIDIKGADFRVLPFGAGRRVCPGAQLGINLVASMIGHMVHHFRWTLPEGTRPEDVRMVESPGLVTFMDTPLQAVATPRLDKEELYRRVPSEI

SEQ ID NO: 15911 - protein, 605 aa, Sorghum bicolor
MITATDFYHVMTAVVPLYVAMILAYGSVRWWRIFSPDQCSGINRFVALFAVPLLSFHFISTNNPYTMNLRFIAADTLQKLMVLAMLTAWSHLSRRGSLEWTITLFSLSTLPNTLVMGIPLLKGMYGDFSGSLMVQIVVLQCIIWYTLMLFMFEYRGARLLITEQFPDNAGAIASIVVDPDVVSLDGRRDAIETEAEVKEDGKIHVTVRRSNASRSDIYSRRSMGFSSTTPRPSNLTNAEIYSLQSSRNPTPRGSSFNHNDFYSMVGRSSNFGAADAFGIRTGATPRPSNYEDDAAKPAKYPLPVVNAAAPVPGAAAGHYPAPNPAVAAAPKKKAAGTNGQAKGEDLHMFVWSSSASPVSDVFGGGAPDYNDAAAAVKSPRKMDGGGAKDRDDYVERDEFSFGNRGAMDRDAEAGDEKAAAATAVAGGDPNAVAAPTAMPPTSVMTRLILIMVWRKLIRNPNTYSSLIGVIWSLVCFRWNFQMPAIVLQSISILSDAGLGMAMFSLGLFMALQPRIIACGNKVATFAMAVRFLTGPAVMAAASFAVGLRGTLLHVAIVQAALPQGIVPFVFAKEYNVHPDILSTAVIFGMLIALPITLVYYILLGL

SEQ ID NO: 15912 - protein, 376 aa, Sorghum bicolor
MGTGALAVAAAAPADRANKQRRAGGGAHLWKKALLHFSLCFVMGFFTGFAPSSSSSWKAATTTPHPPHRPGDRLAASRVAVDVNARATLPPPASAGDALGVGGATVDVGDEYEEGDANGQRRRLLIVVTTTRSGPGERRRRRGELLRLAHTLRLVRPPVVWVVVEPAADAPATAVVLRGTGVMYRHLAFKPEENFTTAEAEAHAQRNAALAHVEKHRLAGVLHFADAAGVYDVGFFDQIRQIEAFGTWPVATMLAGEKKVVVEGPLCSASKVVGWFSRDFNDGTTRSVTYNTEVDLNPAGAAGTRAHTIDVSGFAFNSSILWDPERWGRPTSLPDTSQDSIKFVQEVVLEDRAKLKGIPSDCSQIMVWQYSVPSSQ

SEQ ID NO: 15913 - protein, 1179 aa, Sorghum bicolor
MASNGGGLRHSNSNRLSRMSYSGTGDDARAQAAVPGDRPMVTFARRTHSGRYVSYSRDDLDSDLGNAGIGDMSPDRDDQPQQYASYHVHIPATPDNQPMDPAISARVEEQYVSNSLFTGGFNSVTRAHLMDKVIDSEASHPQMAGAKGSSCAVNGCDAKVMSDERGDDILPCECDFKICAECFADAVKNAGAVCPGCKEPYKSTELEDIVGAANAGAGARPTLSLPPPPGAAASRMERRLSIMRSQKAMTRSQTGDWDHNRWLFETKGTYGYGNAIWPKENEVDAGGVGGGGGGADGQPAEFTTKPWRPLTRKLSIPAAILSPYRLLILIRMVVLALFLMWRIKNKNEDAMWLWGMSVVCELWFGFSWLLDQLPKLCPVNRATDLAVLKDKFETPTPSNPTGRSDLPGLDIFVSTADPEKEPPLVTANTILSILAADYPVEKLSCYVSDDGGALLTFEAMAEAASFANMWVPFCRKHNIEPRNPDSYFNLKKDPYKNKVRQDFVKDRRRVKREYDEFKVRINALPDSIRRRSDAYHAREEIKAMKRQRETALDDAVEPVKIAKATWMADGTHWPGTWIQPSAEHTRGDHAGIIQVMLKPPSDDPLYGSTGDEGRPLDFTEVDIRLPMLVYVSREKRPGYDHNKKAGAMNALVRSSAVMSNGPFILNLDCDHYVYNSQAFREGMCFMMDRGGDRIGYVQFPQRFEGIDPSDRYANHNTVFFDVNMRALDGIMGPVYVGTGCLFRRVALYGFDPPRSKEHGGCCSCCFPQRRKIKASAAAPEETRALRMADFDEDEMNMSSFPKKFGNSNFLINSIPIAEFQGRPLADHPGVKNGRPPGALTVPRDLLDASTVAEAISVISCWYEDKTEWGHRVGWIYGSVTEDVVTGYRMHNRGWKSVYCVTKRDAFRGTAPINLTDRLHQVLRWATGSVEIFFSRNNALLASRRMKFLQRIAYLNVGIYPFTSIFLIVYCFLPALSLFSGQFIVKTLNVAFLTYLLVITLTLCLLAVLEIKWSGISLEEWWRNEQFWLIGGTSAHLAAVLQGLLKVVAGIEISFTLTSKSGGDDVDDEFADLYIVKWTSLMIPPIVIMMVNLIGIAVGFSRTIYSEIPQWSKLLGGVFFSFWVLAHLYPFAKGLMGRRGRTPTIVFVWAGLLSITISLLWVAINPPSGNQQIGGSFTFP

SEQ ID NO: 15914 - protein, 313 aa, Sorghum bicolor
  Sequence also found in Organisms: Saccharum officinarum
MEPMNVDNGGCGGLDAQIEQLMQCRPLAEQEVKALCEKAKEILMEESNVQPVKSPVTICGDIHGQFHDLVELFRIGGKCPDTNYLFMGDYVDRGYYSVETVTLLVALKVRYPHRITILRGNHESRQITQVYGFYDECLRKYGNANVWKTFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 15915 - protein, 461 aa, Sorghum bicolor
MVGSYANGGGAAALVAEEKLDALRRLLGKSDGDPLRVVGVGAGAWGSVFCALLQDAYGRHRDRVQVRVWRRAGRAVDRADAERLFEVINSREDVLRRLIRRCAYLKYVEARLGDRTLHADEILRDGFCLNMLDTPLCPLKVVTNLQEAVWDADIVVNGLPSTETREVFGEIGRYWKERITQPLIISLAKGIEASLDPVPRIITPTQMISNATGVPLENILYLGGPNIASEIYNKEYANARICGADKWRKPLANFLRQPHFIVWDNSDLITHEVMGGLKNVYAIGAGMVAALTNESATSKSVYFSLCTSEMIYITHLLAREPEKLAGPLLADTYVTLLKGRNAWYGQKLAKGELTLEMGDSIKGKGTIQGVSAVNAFYELLSQGSLSVMHPETKKAVAPVELCPILKTLYKILIKRELTTNSILQAIRDESMYDPRERIEMAQRQSLFRPSLLGLAKGDAKA

SEQ ID NO: 15916 - protein, 346 aa, Sorghum bicolor
MPTAETTTPVPPALSGQGRTVCVTGAGGFIASWLVKRLLEKGYTVRGTVRNPVDPKNDHLRALDGAADRLVLLRADLLDPESLVEAFSGCDGVFHAASPVTDDPEMMIEPAIRGTQYVMTAAADTGVKRVVFTSSIGTVYMNPYREPNKPVDDTCWSDLEYCKNTQNWYCYAKTVAEQGAWEVARKRGLDLIVVNPVLVLGPLLQPTVNASTDHVMKYLTGSAKTYVNAAQAYVHVQDVAEAHVRVYEAPYAHGRYICAESTLHRGELCRILAKLFPEYPIPTKCKDDVNPPVTGYKFTNQRLKDLGMDFVPVLQCLYETVKSLQEKGMLPVLPPKDDQDQQLHKS

SEQ ID NO: 15917 - protein, 790 aa, Sorghum bicolor
MGSSGCSSEIVESTEEFDSTPFGGSSLLHIKLKDEEKRGKCHDYPVEDDLDQLLKAIDSRTFRRALSPGSTGGNALGNSVLKKPARSGLSQSAGIGISSKTVNMKQALRRLCISQASEMAAMKRLSMSPGSSSSSEAGTIHRLYASLMVQSSSEGLLHDDEKMNLIEISLTPEKIGSSRGTSEFSEDCEFETADGSAVTSTSICSASSTSAEIRKIRIQDVISGDPMDNESSLVENGKLGSKFSVATDDGSPRVPILSKPITTSRLVKPVFRCKPSGKKKVKEEPSSLGDSSNSTKFCSSKESISLASTSCSSTSSVTNPTSCAEEEKSTPGPEKSDGTSSEWLAEEKGECSQNSKSSISEYGCSTSISGESQFGLCGYSNRPHMAKDLRWLTIRQLALQQGSLGLDNFKLLKRLGCGDIGTVYLAELVDSDCLFALKVMDIEYLINRKKMLRAQAEREILEMLDHPFLPTLYAHFTTDNLSCLVMEYCPGGDLHVLRQRQPGKSFPEPAARFYVAEVLLALEYLHMLGVIYRDLKPENILVREDGHIMLSDFDLSLRCSVNPVLLRSSSITANHQPRKLTGPCAENYCINSSCLQQPSCAQTSCFTPRLPSIPKPRKPKSSQKRLPQLVVEPTDARSNSFVGTHEYLAPEIIKGDGHGSAVDWWTFGVFLYELLYGKTPFRGPGNDETLANVVSQNLRFPDNPSVSSNAKDLIRGLLVKEPENRFGSLRGAAEIKQHPFFEGLNWALIRSAAPPETQPCNVVTLAKERKKEGKCLEFRSNSEDLEFEVF

SEQ ID NO: 15918 - protein, 580 aa, Sorghum bicolor
MDMDIKERIRRSPPPTPKAVGEAASAPGHPRGRKGRVALLPLSIAALVACGVTLLLLAGGSAARRGGQFSGADRTTLSGAGNNDRGGLDQAGPRDGEHETMVSSKVQRDRLIGGLLAPGFDEQSCLSRYQSALYRKESPHLISSYLLERLREHEVLQKKCGPYTESYKKAIEQLKSGQDVMVGDCNFLVWVSYSGLGNRILTIASAFLYAILTNRVLLVDGDKGTADLFCEPFPETSWLLPPDFPIIQFKNFSIGSPESHGNMVKTEAIHSDGSFKGPKPAFLYLHLAHDYDDYDKLFFCEHSQQHLQKIPWLILRSDNYFVPSLFLIPSYQEELTRLFPQKDVVFHHLGRYLFHPTNVVWGLITRYYDSYLARADEKLGIQIRVFDTETGPFQHVLDQVLDCTLKEKLLPEINAQQPIISTGNIRSKVVLITSLNSGYYERIRNMYWEHPTESGEIISFHQPSHEEHQDSDKKMHNMKALAEIYLLSLSDVMVTSAWSTFGYVAQGLSGSKTWLMFKPENRTAPNPPCRQVMSIEPCFHAPPFYDCKTRKGTDTGKLVPHVRHCEDMSWGLKLVDTGEL

SEQ ID NO: 15919 - protein, 504 aa, Sorghum bicolor
MAVGGDDDSMERDFAARLRLAHSPSPASPAAAASSSPTAAGGIAFRAPQEQFTADDFVLGKIYGVGSYSKVVRATKKDTGRVYALKIMDKKFITKENKISYVKMERIVLDQLDHPGVIRLFFTFQDTYSLYMALESCEGGELFDQIVRKGRLSEDDARFYAAEIVDILEYLHGVGLIHRDVKPENLLLTSDGHIKIADFGSVKPTRDTPIKVLPNSTTERACTFVGTAAYVPPEVLNSAPATFGNDLWALGCTLYQMLSGSSPFKDASEWLIFQRIIARDLKFPEYFSAEARDLIDKLLDVDPSKRPGAGPDGYSSLKAHPFFRGIDWKNLRKTRPPKLAFDANANEDEDGQDSNWLAHMGTVAVNQQSNTVGNNGAPSSSEVRSHISKLSSIDSFDSKWQEFLDPGESVVLISKLKKINKLANKKVQLILTDKPQLICVDPSKMVAKGNIIWSDDPSELSVQVSDSSHFRICTPKKVSTFEDAKQRAWQWKKAIEDLQRGQRN

SEQ ID NO: 15920 - protein, 208 aa, Zea mays
  Sequence also found in Organisms: Pennisetum glaucum, Sorghum bicolor, Setaria italica, Saccharum officinarum, Panicum virgatum
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKAKDLGVMFIETSAKAGFNIKALFRKIAAALPGMETLSSAKQEDMVDVNLRSGNANSSQSQAQAGGCSC

SEQ ID NO: 15921 - protein, 585 aa, Sorghum bicolor
MASASLASSLLCSSSASTSRSAAMPRVIRIPIFSKNQYRPPLRPLRRVVRRSLQQEQEQRASPVSVASGEQQEEATASHHVGGVDEAKASGHVGEADKGGQGEGDGEEKRSTDEQQEVDWKSDEEFKKFMGNPSIEAAIKLEKKRADRKLRELDREPDANPVAGLFRGLAKDQLAREKQRLELAEQTFKALDLNKLKSCFGYDTFFTVDVRRFGDGGIFIGNLRKPVEEVRPKLEKKISEAAGTEVTLWFMEEKKDDITKQVCMVQPKAEIDLQLEITKLSTPWGYLSAVALAVTTFGTIALMSGFFLKPGATFDDYVSDVLPLFGGFLTILGVSEIATRLTAAKYGVKLSPSFLVPSNWTGCLGVMNNYESLLPNKKALFDIPVARAASAYITSVVLAVSAFIADGSFNGGENALFVRPEFFYNNPLLSFVQLVIGPYADELGNVLPNAVEGVGVPVDPLAFAGLLGIVVTSLNLLPIGRLEGGRIAQALFGRGTAALLSFGTSVLLGAGAISGSVLCLAWGLFATFIRGGEEIPAQDEITPLGNDRFAWGFVLALVCLLTLFPNGGGTYSASFLGDPFFRGGI

SEQ ID NO: 15922 - protein, 267 aa, Sorghum bicolor
MERPAQAPTQLPPGFRFHPTDVELVVLYLRRQALARPLPAAVIPVVHDVARLDPWDLPGASEGEGYFFSLLRRAPATGRGSRRRRAGSGYWKATGKEKPVFLQCGGGVGGKGQLLVGVKTALAFHRSEPPAPSSRTGWIMHEYRLAVSRGVAEQREKNASQGCVAAPGEWVVCRVFLKNGARSRPNRDANSKALGHRASAAPPQPPPQHREDVGGRRQQPLLLSSSQSSSSSCVTGATDLADQDDEVSGGGGGISRDTPADPQREAY

SEQ ID NO: 15923 - protein, 569 aa, Sorghum bicolor
MVATVRCDEIANEKFGCITTDTEWLDVESAVQSGPVPGFGKKLGNIVDVHLQEYDKEAIYFDEAVRKGKREHLESRILNLVQPAFQKMLTHLRMKALEKFKTGLNSSLESGKGFAVSARDNTECSLKDFEQGCADAIIKQANWDCSKMLEKVRRDIEDHALSIRESKLSELTTHAKEKLRKALAEPVESLFDAADQTTWQSIRNVYKRETEAILPEFLKTLCGFEMEYGPAEEMVSKLRDYARSVVESKAKDESSKVLIHMKERFTTVFSHDKDSIPRVWTGKEDVRAIAKEARSAALKLLSVMAAIRWDDEPDSIESILTSTLLEGSVVSKIAHAASADPLASTTWEEIPPKYTMITPSQCKSLWKQFKSETEFTITQAVSTQQAHRRGNSKLPPPWAIVAIAILGFNEIMVLLRNPIYLFLLFVGYLMFKALAVQLDVSREFQNGVVPGIISVSAKLLPTIQNLVNNVAAEQQAEHQHPHPHPHPQAADPPQPQMQPPPLLLSPRSPMSELRRLHMPSSPRKVASPVPSSSSSSSAVSSPRHTGEDQKPRPGVGGAENPSTVADSIV

SEQ ID NO: 15924 - protein, 353 aa, Triticum aestivum
MTTGGNGEEQQGRRLFGVSLTDRPVWQQFLICSSGFFFGYLVNGICEEYVYNRLQFSYGWYFTFVQGFVYLGLIRLQGFTMKHMVNPWRTYVRLSAVLMGSNGLTKGSLAFLNYPAQIMFKSTKVLPVMIMGAFIPGLRRKYPFHEYVSAVMLVIGLILFTLADAQTSPNFSMIGVAMVSSALIMDAFLGNLQEAIFKMNPDTTQMEMLFCSTVVGLPFLAVPMVLTGELTTAWSACSQHLYVYAVLVFEAMATFVGQVSVLSLIALFGAATTAMVTTARKAVTLLLSYLIFTKPMTEQHVTGLLLITMGIVLRLLPEDKEKKGTAERQQAKAQRGEEKRRGDGVEEETSPLV

SEQ ID NO: 15925 - protein, 379 aa, Triticum aestivum
MVKAMAGCPAKMGFRMPAEWEPHEQCWMGWPERPDNWREHAEPARKTFERTAMAISKFEPVTICASAKQYPRVHELMEHQPNIRVVEMSMNDSWFRDTGPTFITREGGSDIGLAEQTIAGIDWEFNAWGGLGGGCFDDWSLDRSIAKKIVEIERIPRFAHTMVLEGGSIHVDGEGTCITTEECLLNPNRNPHMTKLEIENELKDFLGVTKIIWIPLGLHGDEDTNGHVDNLCCFIKPGVILLSWTDDENDPQYEISVKALSALTQAVDAKGRQIEVVKIHVPGPLYITKEEGEGVLATGHAVPRVPGKRLAASYVNFYPANGGVIAPAFGDKKRDEEAREVLQKVFPDHEVVMVEGAREIVLGGGNIHCITQQQPVRPS

SEQ ID NO: 15926 - protein, 217 aa, Triticum aestivum
MSADELRLDLEELRRLEGLAKRPRVVSLLSNEIRSVDAKLASRAAPVQTQAPQAVAVAAAAPAGLSYVTLGSFSWDQDNEKIRVYVFLENVDQEKVETTFKPMSVDIKFHDVKGKNYRCAIPKLNKEIVPEKCKIVVKPTKIVITLWKASSGNWLDLHYKEDKFKPSMDKEKDPMSGIMDLMKGMYEEGDEDMKRTIAKAWSDARSGKTADPMRGLP

SEQ ID NO: 15927 - protein, 460 aa, Triticum aestivum
MAWRLALPLLLFYSPILLCSSQVQDNDPSKLFKSASEMMSLRKYDGALGLLNAILELDPNHSEAYRQRATVLRHRCRHKEAESDYNKFLELKPGTASVEKELAQLLQAQNALESAYTQSDAGEFSKVLEYVNKIVLVFSPGCLKAKLLKAKALLALKDYSNVISETGFILKEDEDNLDALLLRGRAYYYLADHDVANRHYQKGLRLDPEHSELKKAYFGLKKLLKKTKSAEENAAKSKFRVAVEDYKAALAMDPDHTLYNVQLHLGLCKTLVKLGRGKEAISTCTEALSIDEELVEALSQRGEAKLLTEDWEGAVEDLKEAAQKSPQDMAIREALMKAERQLKLSKRKDWYKILGISKTASAADIKRAYKRLALQWHPDKNVENREEAENMFREIASAYEVLSDEDKRVRYDRGEDLEEMGMGGGGGGGFDPFGGGGGQQYTFHHGGGFPGGASSSTSVN

SEQ ID NO: 15928 - protein, 596 aa, Arabidopsis thaliana
MVRIKKVESFYAKLRESATSLSSQNPLLIFPSTSDVDSLCALKVITHILESDSIQYSCFPVSSFLEIHKYAGPAGLCSTSLESPPVTILLINWGCHRDLKLVLKLGPSARVFVVDSHRPIHLHNLSDYNEQVVVLHTDDDERQGDLAYDFDVLKLANESFQLRVEDAGEESDEEEEDEEEDEEDDDDDDGDRPSKRRKMGDGVKVFKKLKRDYYKMGTFHGKPSGCLLFELSHMLRKNTNELLWLACVSLTDQFVHERLTDERYQAAVMELEQHINSSGNIDKITSVTLKDGTKVRAPDCSRISYEEEPRLMLLREWTLFDSMLCSSYIATKLKTWSDNGIKKLKLLLARMGFALIECQQKFPYMSLEVKRKMKQEFDRFLPEYGLNDFYYRSFLRLHGYSSRVSAADVVYGITALLESFLGSGGSSASKQFGEAYDALSLNNLDKLRSGMQQAIKVQRAILRQGSAAITKSGCIRSGRKFRWVKIEDSMDAKYLGYPQALTKFCYFLMDALREKGARMKPMLCACASQQPGKILVVGVCGKPRLGAVRGNAFGNAFRKAAQESRADYFHELFESSWIVLDASAVNSFMIRLTEKL

SEQ ID NO: 15929 - protein, 592 aa, Hordeum vulgare
MDAPKDASPAPKLHTRLRVWEFADRYVFEPVDGLADLYLSVSRTNGSMNLVQELPPRGPSANPKVRIVFGVIGVLKLAVGSCCLVITDRDCVGSYMGHAVFKVTGLKVLPCTTASSAEQKKMETEFSDLLDAAERSIGLYFSYEANLTLTLQRLYDLGDTFKALPLWRQAERRFMWNGYLLEPLIENRLDQYLLPVVQGSFQNIHAEVGSDKVLVTMIARRCTRRIGTRCWRRGADPEGYAANFVESEQIMQTKGYTASYVQVRGSMPFLWEQIVDLTYKPSFDVVRVEEAARVLERHFHDLQKKYGAVVAIDLVNTTGGEGRLYERYAKSIEPILSEDIRFIHFDFHKICGHIHFERLSQLYDQIEDYLKKHKYFLLDDQGKKIVGQTGTVRTNCVDCLDRTNVTQSMVGRKTLESQLQQLGVLGGNDTISNYPAFDADYKVLWANHGDAISTQYSGTPALKGDFVRYGKRTTQGIFNDLWNALARYYFNNFADGTKQDAMDLLQGHYVSSVSRDIAVPSKPGVMQSFRVAFALILCAAVFMILSLRQARNDLRHLVVALVWAGLCIGIALYVKKNGRKFCNRPRFYLSRN

SEQ ID NO: 15930 - protein, 433 aa, Brachypodium distachyon
MATRHQNAAAAPQPANRGAAVPAAKQKAAAAGRPEARNRRALGDIGNLVHPQALDCLKEGINRPITRSFGAQLLKNAQANGAVANKVAIAPARQAAAPKPAKKAPAKAKITTIPDQAKKPSEAVASSSAQKASRKKVVDTLTKVLTARSKVACGLTGRPKEPVEDIDELDKNNELAVVDYIEDIYKFYMTAQHESRPVEYMGNQPEINPKMRAILADWIVEVTHKFELMPETLYLTIYIVDMFLSVQQVPRRELQLVGVAAMLIACKYEEIWAPEVNDFISISDNAYSRPQILGMEKSILNKMAWNLTVPTPYVFLVRFVKAAGNDKELEHMVFFFAEMALKEYNMVSLCPSLVAASAVYAARCTLKKSPIWTGTLEHHTTFNETQLLEPAKVLVNAHAAAPESKLRAIYKKYATEQFGRVALHPPAVAAQGV

SEQ ID NO: 15931 - protein, 347 aa, Setaria italica
MAMASTYAPGGGAGALAPGRARVRGPVGLVSLGPTRLGGLPRPLALARRSPVAAGARLRCAASSSSAARPVTAPRFIQHKKEAFWFYRFLSIVYDHVINPGHWTEDMRDDALEPADLYSRYLKVVDVGGGTGFTTLGIVKHVNPENVTLLDQSPHQLEKARQKEALKGVTIMEGDAEDLPFPTDTFDRYISAGSIEYWPDPQRGIKEAYRVLRMGGTACVIGPVYPTFWLSRFFADMWMLFPKEEEYIEWFKKAGFKDVKLKRIGPKWYRGVRRHGLIMGCSVTGVKRERGDSPLELGPKAEDVSKPVNPITFLFRFLMGTICAAYYVLVPIYMWIKDQIVPKGMPI

SEQ ID NO: 15932 - protein, 305 aa, Zea mays
MKFGKSLSGQIVETLPEWRDKFLSYKDLKKRLKLIGAGNGAERQPKRARRDDSGEADAAAAAAAMTPEEAEFMQLLEAELDKFNSFFVEKEEEYIIRQKELQDRVARAAGRESKEELMRVRKEIVDFHGEMVLLENYSALNYTGLVKILKKYDKRTGALIRLPFIQKVLQQPFFTTDLLYKLVKQCEAMLEQLLPVSEASVSSEDGKGDSNDEEKLAKPSSSLVNGGGMPELDEIEYMESMYMKSTVAALRSLKEIRGKSSTVSMFSLPPLQGNNAQDSYQIRAEQLDEEPERWSKVTVIEQAAK

SEQ ID NO: 15933 - protein, 214 aa, Zea mays
MDTDLKKFIRGYRANHEKIPAQTVKILMYQLCKGVGFVHGRGVLHRDLKPHNLLMDRKTMALKIADLGLSRAITVPVKKYTHEILTLWYRAPEVLLGATHYSTPVDIWSVGCIFAELVTNQPLFPGDSELQQLLHIFKLLGTPNEEMWPGVGKLPNWHVYPQWKPTKLSTLVPGLDSDGYDLLEKMLAYEPGKRVSAKKALEHPYFNDVNKEVY

SEQ ID NO: 15934 - protein, 385 aa, Oryza sativa
MADKENSTPASAARLTRSSAAAGAQAKRSAAAGVADGGAPPAKRKRVALSDLPTLSNAVVVAPRQPHHPVVIKPSSKQPEPAAEAAAPSGGGGGSPVSSASTSTASPSSGWDPQYASDIYTYLRSMEVEARRQSAADYIESVQVDVTANMRAILVDWLVEVADEYKLVADTLYLAVSYLDRYLSAHPLRRNRLQLLGVGAMLIAAKYEEISPPHVEDFCYITDNTYTRQEVVKMESDILKLLEFEMGNPTIKTFLRRFTRSCQEDKKRSSLLLEFMGSYLAELSLLDYSCLRFLPSVVAASVVFVAKLNIDPYTNPWSKKMQKLTGYKVSELKDCILAIHDLQLRKKCSNLTAIRDKYKQHKFKCVSTLLPPVDIPASYLQDLTE

SEQ ID NO: 15935 - protein, 409 aa, Oryza sativa
MAAAAADFAASKRAMAYALCKHLSLDPNTISSTSIEESDIATLFSHIVKSSEDEVLKWVEFSSNFVGKCGEQHALLGNLNQDLSQKSVLLGNGFKPSVADIVVFATIQVFVSHLGENELQKYPHVLRWMDYIQNIVDFGTTVQKVNLTKSVFDPPSHPKKADKGDTDPSSKKVVSGQKNVGKSDANVDSKKAAPENKAPENKANPTPAKNNKPSGDKKKAQEKSAGKPNEGVADKAPQKTAEKDSECNVSILNIQVGLIRKAWKHPSADSLLVEEIDLGDGNVHQVVSGLAKFFSPEELVNRHVVLITNVKPGKLRDVMSAGLVLCASNQDHTVVEPLIPPEGAKPGERISFAGFDGKPEDVLNPKKKQLDKITPDLHTDGNGIATYRGVPFTTSAGPCRSSVPNASIK

SEQ ID NO: 15936 - protein, 617 aa, Oryza sativa
MQQEQRKKSSAEEFFTEYGDANRYRIQEVIGKGSYGVVCSAIDLHTRQKVAIKKVHNIFEHVSDAARILREIKLLRLLRHPDIVEIKHIMLPPSRRDFKDIYVVFELMESDLHQVIKANDDLTKEHYQFFLYQLLRALKYIHTASVYHRDLKPKNILANSNCKLKICDFGLARVAFNDTPTTVFWTDYVATRWYRAPELCGSFFSKYTPAIDIWSIGCIFAEVLTGKPLFPGKNVVHQLDLMTDLLGTPSMDTISRVRNEKARRYLSSMRKKDPVPFSQKFPNADPLALKLLQRLLAFDPKDRPTAEEALTDPYFKGLSKIDREPSCQPIRKLEFEFEQKKLSKEDIRELIFQEILEYHPQLQKNYRNGRERATFLYPSAVDQFKKQFSNLEESNGSGSAIPMERKHASLPRSTTVHSTPIPPKEQPLAASLKSSRPVSDEPCKNPWVMGGFSGNIPTSSQVSQVAKPVAPGRPVGSVFPYETGSTNDPYGPRGPVMSSGYPPQQQISQAYGYHQVPARMNCVEQSQAMDAYKMHSQSQTQAYAYPNSKVTADVALDMRGSTFHHSAGSKNGSLDRMVTQTDIYTRSLNGIVAAATSAGVGTNRKVGAVPISTSRMY

SEQ ID NO: 15937 - protein, 1007 aa, Oryza sativa
MATRPASRQRRASSAAAAVAVVRSSPQPQQQQQQQLPIPQSGSPTSTTTTTTSSSRLTPELSLDGPASPLFAGLDEDAAPKENVTVTVRFRPLSPREIRQGEEVAWYADGDTVVRSEQNPSVAYAYDRVFAPTTTTRQVYDVAAQHVVSGAMEGVNGTIFAYGVTSSGKTHTMHGDQRSPGIIPLAVKDAFSIIQETPNREFLLRVSYLEIYNEVVNDLLNPAGQNLRIREDPQGTFVEGIKEEVVLSPAHALSLIAAGEEHRHVGSTNFNLLSSRSHTIFTLTVESSPCGESNEGEAVTFSQLNLIDLAGSESSRAETTGVRRKEGSYINKSLLTLGTVISKLTDGKATHIPFRDSKLTRLLQSSLSGQGRVSLICTVTPASSNSEETHNTLKFAHRAKRIEVQASQNKIIDEKSLIKKYQNEIRRLKEELEQLKMGIITGTPVKDAGEDNIILWKQKLEDGNVKLQSRLEQEEEAKAALLARIQRLTKLILVSTKATQTSRFSPHPGPRRRHSFGEEELAYLPYKRRDIVLDNESNELLSPVEGLGMTLEDSKEEKKNRKGILNWFKLRKREGGASILTSSEGDKSSLTKSTAPSTPIGESVNFPSEPRISNSLVGESASVDLFSIGHGEFATDSLHGEETPLASRKTIDHVDLLREQLKILSGEVALHTSVLKRLTEEAGRSPNNEKIQMEMKKVNDEIKGKKHQIASLERQIPHSISNNQGMADKLELTPSYAELLEQLNEKSFDLEVKAADNRVIQDQLNEKTTECMELQEEVAHLKEQLYQALQAKDSLSNSIMMQKNAGINHETDNHADQELSVPREVPGETSPKEPQSVEIDELKQKVCELIEVKAQLETRNQKLLEESTYAKGLASAAGVELKALSEEVTKLMNQNEKLASELASVRSPTPRRANSGLRGTRRDSISRRHEPAPRRDNNAGYEREKALEAVLMEKEQKEAELQRRIEESKQKEAFLESELANMWVLVAKLKKSQGHDLEDFDTKYIGS

SEQ ID NO: 15938 - protein, 404 aa, Sorghum bicolor
MEAPPGPEPMELDAPPPAAAEAAAAVPPAGSDKKKEGEGGDAVTGHIISTTIGGKNGEPKRTISYMAERVVGTGSFGIVFQAKCLETGETFAIKKVLQDRRYKNRELQLMRAMEHPNVICLKHCFFSTTSRDELFLNLVMEFVPETLYRVLKHYSNANQRMPLIYVKLYMYQLFRGLAYIHNVPGVCHRDVKPQNVLVDPLTHQVKLCDFGSAKVLVPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRAPNARLPNGRPFPLLFNFKHELANASPDLINRLVPEHIRRQNGVNFGHVGS

SEQ ID NO: 15939 - protein, 604 aa, Sorghum bicolor
MAERLTRIAIVSEDKCKPKKCRQECKKSCPVVKTGKLCIEVTSASKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKAELCVDLELNQVIDRNVGDLSGGELQRFAIAVVAVQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLTVVEGEFTDSQIVVMLGENGTGKTTFIRMLAGLLKPDTVEGTDIEIPEFNVSYKPQKISPKFQNTVRHLLHQKIRDSYMHPQFVSDVMKPLQIEQLMDQEVVNLSGGELQRVAICLCLGKPADIYLIDEPSAYLDSEQRIVASKVIKRFILHAKKTAFIVEHDFIMATYLADKVIVYEGRPSIDCTANAPQSLVSGMNKFLSHLDITFRRDPTNYRPRINKLDSTKDREQKSAGSYYYLDD

SEQ ID NO: 15940 - protein, 182 aa, Sorghum bicolor
MMDEEHEQQQPVPVPVAAEAAVEKDNKKTAKRNNKVCVFCGSSPGVERGMDLVYGGGCAALMGLVSRAVHDGGGHVLGVVPKAVLPLELIGETPGELKPVAGMHQRKADALPGGYGIHTKPVGLLNVDGYYDPLLAFVDKAVQEEFVTPLERTIIVHANTNSSTSSSSSSTTNINADADADA

SEQ ID NO: 15941 - protein, 747 aa, Sorghum bicolor
MDDEAAKSVPTSDMNTDAAAEAEAAAAPLRPSSSEAAEREAKVEGADEEGQVVERLVELVSEIATISDFRNSYRRQFCNLSRRIRLLVPMLEEAKEAPAPLPAASEAALRRLRDALHAARELLRLGSSGSKIFLVLDREKIMKTFQDVTARLEQALAGISFDELDISDEVREQVELVHTQFKRAKERSDSSDDDLFNELMSLYNSSSSASVDPDILRRLSEKLQLVTIYDLNHESLTLHEMARGGDPGAVVEKMSMLLKRIKDFVQTEDPEMGARASTANIFPKDNSARPVIPDDFRCPISLDLMSDPVIVATGQTYERGYIEMWLEAGHDTCPKTQQKLANKSLTPNYVLRSLITQWCEANGIEPPKRPAQLKDAPLPCSAAEHSNVLELLQKLSSQNLEDQRGAAGMLRQLAKRSAENRACIGDAGAIPILVSMLSTTDVSTQEHVVTALLNLSIYEENKARIISSGAVPGIVHVLKRGSMEARENSAATLFSLSIVDENKVTIGCSGAIPALVQLLSDGSQRGKKDAATALFNLCIYQGNKRKAVRAGLVPILLELLMESESGMVDEALAILAILSGHPEGKAAIGAASAIPVLVGVIRTGSPRSKENAAAVMVHLCNGEGEQQQQHLAEAQEQGIVSLLEELAESGTDRGKRKAVHLLERMNRFLKRQSQAQAEAEAMAQAHAQAQAQAQAQAQAQAQAQAQAQAQAQAQAQAQPQILVQAEAHADMQAERSLLPTSPDISDR

SEQ ID NO: 15942 - protein, 668 aa, Sorghum bicolor
MPATAEDSPAIRKLGQLFRLTEVYLWDDSYGAGPHDGRKNWRSAEAALVDSHTDKTCNEASNGTDKGHLFVEDLELANLMGSLGLPVSFSTSKVNKNTGNKGKKKGRQALLKAAKTQINDAVRICANTEDRESAVESLDVMAHMHSCNLSGTPLGHNEPCHDDTDKMLREDSPCVEEQEESGCSTIYSADKAPSCDAKNLLTELGTFELSDNLGNPAKEDYSIQENQASDSVLLDSEEMPRHDCVDGESTHSCVDIYQEERVSTREDQTSEETLSVSHDHNDVGQEASLSLAEPSSIDEHAQSSANNFYYDYGEWRVVWDPFYSRYYFYNIQTQESTWCPPEGLEDFASYCSPDTTKELVELGSQCTSIAPQENNLATDDNHLEAQEQDHCIHDLSDIPVEKAIYQSMITTSDKAQHTENKYSDSTTIVLEMNQEVTTTKKKKRVRRSQSYHSCQDMAGNISNDIIKYWTQRYSLFSLFDRGIKMDEEGWFSVTPEPIAKHHASRVGAGVIIDCFTGVGGNAIQFATKCKHVIAVDIDPQKIDCAHHNASIYGVNNHIDFIVGDFIHIAPHLKGETAFMSPPWGGPDYAKVDVYDMKSMLLPCDGYSLFKLGTMIASRVVMFLPRNIDLNQLADMSLSVDPPWSVEVEKNFLNGKLKAITAYFEEQDC

SEQ ID NO: 15943 - protein, 465 aa, Sorghum bicolor
MEIVRSHRQVAAAAAAAGGDGGGAGALPTYKAAPQLEVRLEEFELFAIDRLRVLKGISDGLSRGKRPEEMEKLVSELWKTYMRHQDPAETLNKDIISHFVLRLVYCRTEELRKWFLSMETALFRYRFRLESPESQRMLMTEFQLPYKALPHSEFEAVKDKLSQVARSIGQSANVEHVFFKVPFEEVPDLVASRRVFLSKGYAYVAMSQVVSLVVTQFRCNISKALALTNRKWTATIKEQEKGRLTPIVEALSNAYFGPDYSQPKDTVDISLKDIDQLAKSSFPLCMRHMLDKLRENHHLKHGGRMQFGLFLKGAGLKLEDALAFWRAEFSQKVGSERFDKEYAYTIRHNYGKEGKRTDYTPYSCQKIISATPGVGDHHGCPFRHFGEENLRAALNKMGVGGHALEEIMDKVKNRHYQLACTLTFETTHGVSCDSGINHPNQYFSESQKILRAKNQTMESQSQSAT

SEQ ID NO: 15944 - protein, 1911 aa, Sorghum bicolor
MAPPRGDRKKGKGAGGKTDLRPDRKQFKGHRKEVAAAEQGDGDGERQQLAAPGSAALLAAASDEADFPRGGRSLLSKDEMAEARAEAEQDFEREGKKGKGKRKRRGGESSGFGPDDDLGTLFGGATTGKLPRYANRITVKNISPNMKLWGVVIEVNQKDIVLSLPGGIRGFVRSEDVCDIALQENRKDSENSLCAKVVHVGQLVPCIVLRVDDDKKEGKVNRRVWLSLRLSLLYRGLSLDGLQEGMVLAAQVKSIEDHGYILHFGVSSFSGFMQKDDKENVKIERRQLMHCVVKAIDKTRAIVHLSSDEDLLCKSIIKDLKGLSIDHLIPGMMVNARVHSVLENGVMLSFLTYFSGTVDIFNLLNSFPSGNWKDDYSKNKKVNARILFVDPSTRAVGLTLNKHLLHLEVPPINLKAGDIYDKSKVLRVDKKAGLFLEIPSPTPSPGFISIHDVSDKDAKNLEKFKEGSSLRVRILGVRNLEGVAIGTVKDSAFEGSVFTHDDVKPGMLVRAKVATVEPFGAIVQFSSGVKALCPLPHMSELEHVVKPPKKFKVGAELLFRVLGCKSKRVTVTYKKSLVKSKLDVLASYADAKIGLVTHGWITKIEKHGCFVKFYNGVQGFVSRSDLGLEAGTEAENVYHVGQVVKCRIINVIPASRKLNVSFVISHNRVIPIDTPKLGSIVSGVVERLTPAAVVVSVNGFSKGTILNEHLADHHGQAAQLKNLLKPGHEFNQLLVLDIEGHNLVLSAKHSLINCANDIPSEISQMHPGVVVHGYICNIIESGCFVRFLGHLTGFSPKDKAVDRRIERLSDAFYVGQSVRSHILSVTAETARVKLSLQQSMCSSTDSSFIQGYFLLDQKIAALKYSSNDWAHTFGIGSLVEGEVGAIEEYGIILNFKDHLDVVGLIEHHQLGGSSVEVGSSVKGLVLDLSDGVVNLSLKPELIGSVRNVGKKKKRQRAAVADLELHEEVNAVVEIIKGSYLVLSIPEYNYAIGFAPLMDYNSQLLPHHHYDNGQRITVVVGNIPSSDSSGRLILLPKASAQYSALSESKRAKKKSGYKIGSLVEAEIIDIKPLELLLQFGGNLHGRIHITEVPEKDSDEHPFSKLRIGQKLTARIVAEAEPSGKSGKNFKWELSIRPCIVNGEFDELTAQKEQKHTTNEIVRAYVVKVDKEWVWLTVSRNVMAHLFVLDSSSEPSELKEFQQRFSEGQAVKGRVINVNREKRLLRLKALDNQCTQLNIDEIQQSKSSVFEQTKQGDIIGGRVQKILPGVGGLVVQIGPHLRGRVHYTEIVDSWVTEPLSGFHEGQFVKCKVLSVSRSSEGSLRVDLSLRSSNLIRDSNNSGLVDDLATCTSRIEKIKDLLPGTEIKGYVKNVNSKGCFIMISRMVEARITLSNLSDEYVENPQKDFPVGMLVHGRVLSTDPSSGRVEASLRKTTGSKLEKLDDISYSDLHVGDIIDGQVKRVESFGLFVTIRRSELVGLCHVSELSDEPVVDINSCYKAGDMVKAKILKIDEKRHRVSLGMKKSYFDSDLTADTNDDEDDESALMDISVAPQMVEYHNRSLVNRKAEPMASVPPLQVSLDESECSDLEDNNNNKGPEIANGTEANAKKNDKQLKKEARKQRELEISAMEERALQGDVPQTPDDFEKLVRSSPNSSFVWIKYMATLLDLADVEKARAVAERALKTIIPREEEEKLNVWVAYFNLENEYGSPREDAVKKVFQRALQYCDPKKLHLALLAMYERTEQYELADELLDRMTKRFKTSCKIWLCRIQFALKQGKDVACIKSIVNRALLSLPHRKRIKFLSQTAILEFKCGVPEEGRSRFELILREYPKRTDLWSVYLDQEIRLGDIEVIRALFERVTCLTLPPKKMQFLFKKYLNFEKSLGEDNERIQFVQQKAIEYVQSSLPSQDNP

SEQ ID NO: 15945 - protein, 223 aa, Sorghum bicolor
MGEEASCNAVSAMEAATNAKPAAKENGCAAAVAQEAAAPVAAADPRLQGISDAIRVVPHFPKQGIMFNDITTLLLRPGVFKDAVDLFVERYRGMRIDAVAGIEARGFIFGPAIALAIGAKFIPLRKPRKLPGEVISEKYVLEYGTDCLEMHVGAIERPGERVLIIDDLVATGGTLCAAIRLLERAEADVVECACLIGLPKFKDFYKLNGKPVYVLVESRESDK

SEQ ID NO: 15946 - protein, 492 aa, Sorghum bicolor
MPTLRSATANASSVAVGTPSPAAASTPRSVKRRLTPGRAGELPAASRHTSPHRSPHAGTGTVCMPKLLSASPKSSRKRLYGDLVAAEKPKWNPRDAAQMRAVKEALHVATVPSSELVCRDNELRRVLEFCKASVEQEKAGSLYVCGCPGTGKTLSINKIKDSLVCWADEMGMETPDSLAINCTNLANTSEIFGKILGKFQNRKKGSSKLSPLQQLQSMFSSKDSAPRRMMLVIVDEMDYLITRDRAVLHDLFMLTTCAFSRCILIGIANAIDLADRFLPKLESLNCKPLVVTFRAYSKDQISDIVKHRLKGLEYDVFEPLALEFCARKVAAASGDMRKALGVCRSAVEVLEARLQDSPDQELGIVTFDHMDIALSKAFKSAVIDSILCLPQHQQMVLCALANTFQHCKKKATTLGELNKSYIEICRSTQVPAVGMLEFSNMCMVLSDQGFMKLGQSKEDKLRRVTLQIDSSDITFAFKGNRFFQKCLEQPRC

SEQ ID NO: 15947 - protein, 411 aa, Sorghum bicolor
MGIKGLTKVLAEHAPRAAVQRRVEDYRGRVIAVDASLSIYQFLIVVGRKGSELLTNEAGEVTSHLQGMLNRTVRMLEAGIKPVFVFDGEPPEMKKKELAKRSLKRDDATKDLNRAIEIGDEDAVEKFSKRTVKVTRKHNDDCKRLLRLMGVPVVEAPGEAEAQCAALCENHQVYAVASEDMDSLTFGARRFLRHLTDLGYKKSPVTEFDVSKVLEELGLTMDQFIDLCILSGCDYCENIKGIGGQRALKLIRQHGCIEEVLQNLNQTRFSVPEDWPYQEVRTLFKEPNVSAGISDFTWTSPDTEGLMGFLSTENSFSPDRVTKALEKIKAARDRYSPGRLKHLTPVASLPGTHTGKEPKCILGSPGQSLKVRSSPQVCKSSSSGFRYGSSKPFMLGRQSGYHGMPYGLSFI

SEQ ID NO: 15948 - protein, 1486 aa, Glycine max
MSWEDEIVMRDVTNAGLVVSDRIGREVSSQLDLEEALEASRYASHPYSTHPREWPPLVEVVNTWELPPVLIERYNAAGGEGTAFCGIFPEIRRAWASVDNSLFLWRFDKWDGQCPEFSGEEQAICAVGLAKSKPGVFVEAIQYLLVLATPVELILVGVCCSGGADGSDPFAEVTLQPLPEHTIPSDGVTMTCVACTDKGRIFLAGRDGHIYEILYSTGSGWQKRCRKICITAGLGSVISRWVIPNVFNFGAVDPIVEMVFDNERQILYARTEEMKLQVYVLGPNGDGPLKKVAEERNLVNQRDAHYGARQSTGSRVSSRSPKPSIVCISPLSTLESKWLHLVAVLSDGRRMYLSTSPSSGSLTGFNTNHHKPSCLKVVTTRPAPPWGVSGGLTFGAMALAGRPQNEDLSLKVEAAYYSAGTLILSDASPSTMPSLLVLNRDSSTQSSPSGNLGTSTRSSRALRESVSSLPVEGRMLSVADVLPLPDTAATVQSLYSEIEFGGYESSMESCERVSGKLWARGDLATQHILPRRRIVVFSTMGMMEIVFNRPLDIIRRLLESNSPRSVLEDFFNRFGAGEAAAMCLMLAARIVHSENLISNVIAEKAAEAFEDPRVVGMPQLEGSNALSNTRSAAGGFSMGQVVQEAEPVFSGAHEGLCLCSSRLLFPLWELPVMVVKGSLGPSGTLSENGVVVCRLSVGAMQVLEQKLRSLEKFLRSRRNQRRGLYGCVAGLGDLSGSILYGNGSALGVGDRNMVRNLFGAYSRNMESNGGITTNKRQRLPYSPAELAAMEVRAMECIRQLLLRSGEALFLLQLLSQHHVTRLIQGFDSNLQQALVQLTFHQLVCSEEGDHLATRLISALMEYYTGPDGRGTVDDISRRLRDGCPSYYKESDYKFFLAVEALERSAMTIDAEDKENLAREAFNSLSKVPESVDLRTVCKRFEDLRFYEAVVRLPLQKAQALDPAGDAYNDDIDATVREQALAQRELCYEIIISALRSLKGDNLQREFGTPIKSTASQSALDPASRKKYICQIVQLGVQSPDRIFHEYLYQAMIDLGLENELLEYGGPDLLPFLQSAGRNSIHEVRAVTATTSPVGQSGAPMSSNQVKYYELLARYYVLKRQHMLAAHALLRLAERRSTDGVPTLEQRCQYLSNAVLQAKNATNSDGLVGSGRISIDSGFLDLLEGKLAVLWFQIKIKEELESMASRSDVLPGTSESAENGVVPEGSSTADANFANATREKAKELASDVKSITQLYNEYAVPFGLWEICLEMLYFANYSGDTDSSIVRETWARLMDQAISRGGIAEACSVLKRVGPRIYPGDGAVLPLDIICLHLEKAGLERLNSGVEAVGDEDVARALVSACKGAAEPVLNAYDQLLSNGAILPSPSVRLRMLRSVLVVLREWAMSVYSQRMGSSSATGHSLILGGGFSTERTIASQGIRDKITSAANRYMTEVRRLALPQNQTEHVYRGFRELEESFISQHSFDRF

SEQ ID NO: 15949 - protein, 287 aa, Glycine max
MGSKDSCRTELRIAIRQLSDRCLYSASKWAAEQLVGIEEDPAKFTPSNTRFQRGSSRICRKSRTHETAAVITPVVGVLYDATPVNVMEKDELVDGDFYLWQSYFGCREYKTAAHAGEKQKEEETIELGGPLGKSDAINHELVSLERELSTIRKNGKVDPFCLYLYGLVLKQKGNENLACTVLVESVNYYPWNWNAWTKLQSLCKKVDILNSLNLNSHWMKDFFLASVYQELRMHNDSLSKYEYLLGTFGYSNYLQAQIAKVQRGERGGKGKLPERVMENEPTTVSNH

SEQ ID NO: 15950 - protein, 983 aa, Glycine max
MDDLERAILVIFDESGTLDDDLKKQAELYCNDVKEKPLICRLCIEKLCFSNLVQVQFWCLQTLHEVIRTRYLTMTPDERHMIRGSVFSIVCLEDKNLTRVLEGPAFIKNKLAQVLITLIYFEYPLVWSSVFVDFFPHLSKGNVVIDMFCRVLNALDDELINLDYPRTPEELTVAGRVKDAMRQQCVCQIVRVWYDIVSMYRNSDQELCTSVLDSMRRYISWIDIGLIVNDAFIPLLFDLILVGPLSVQLRGAAVRCLLAVVSKRMEPQSKLSLLRSLQISRVLRLVTEDGDAELVSDIAALLSGYAVEALDCFKHLNSEDAKGISMELLSEVFPSIFYVMKNFEVDVNIIQFLSGYVAILKSFAPLPEKQLLHLGQILEVILVLIRYDPAYRTNLDFMDKIGKEEEDRMVEFRKDLFVLLRTVGRVAPDVTQLFIRNSLASAVSRSSDSNVEEVEGALSLLYALGESISEETIRTGSGLLSELLLMLLSTKFPCHSNRLVALVYLETVTRYVKFIQDNTQYIPMVLAAFLDERGIHHSNINVSRRASYLFMRVVKLLKMKLVPFIETILQSLQDTVAQFTITNYTTEELSGSEDGSHIFEAIGLLIGTEDVLPEKQSDYLSSLLSPLCQQVEALLKNAKLLNAEETNAKIAVTQQIIMAINSLSKGFSERLVTASRPAIGLMFKQTLDVLLQVLVIFPKVEPLRNKVTSFIHRMVDTLGASVFPYLPKALEQLLEEIEPKQMVGFLLLLNQLICKFNTLVHDILEEIFPSVAERIFSVIPRNGLPSGPDAITEEIRELQELQRTLYTFLHVITTHDLSPVFLSPKCKAYLDPVMQLLLYSSCNHKDILVRKACVQIFIRLIKDWCAQPYEEKVPGFRSFVIEAFATNCCLYSVLDRSFELHDANTFVLFGEIVLAQKVMYEKFGDDFLVHFVSKGFSSAHCPPDLAEQYRQKLQGGDFKALKSFYQSLVENLRLQQNGSLIFR

SEQ ID NO: 15951 - protein, 839 aa, Helianthus annuus
MDSFGGAYFTDEKAAKVENIFLEFLKSFRLDQNSRELFYESEIEAMRPNESNTMFIDFSHVMRFNDVLQKAISDEYLRFEPYLKNACKRFVMGQKPTFITDDNPNKDINIAFHNLPIIKRLRELSTSEIGRLVSVTGVVTRTSEVRPELIQGTFKCLECGTIVNNVEQQYKYTEPMICMNATCSKKGRWTLLRQESMFADWQRVRMHETSKEIPAGSLPRSLDVILRHDIVEQARAGDTVIFTGTVVVIPDILALAAPGERAEVRRECGQSRRTGGGSVQEGVRGLRALGVRDLSYKLAFIANSVQICDGTRDADIRYRQRDAEDDDTLRFTSEEVDEVTQMRRTPDFFNKLVDSMAPTVYGHQDIKRAILLMLLGGVHKFTHEGINLRGDINVCIVGDPSCAKSQFLKYTTTLVPRSVYTSGKSSSAAGLTATVAKEPETGEFCIEAGALMLADNGVCCIDEFDKMDVRDQVAIHEAMEQQTISITKAGIQATLNARTSILAAANPTGGRYDKSKPLKYNVALPPAILSRFDLVYVMIDDPDDTTDYHIANHIVRVHQKREAAVDPTFTTAQLKRYIAYAKSKKPKLNAEARQLLVDSYVHLRKSDTAPGSRVAYRMTVRQLEALIRLSEAIARCHLDDEVLPRHVSLATKLLKTSVISVESQEIDLTEFQDENIEHGDNEENGDIGENGEAQPGGADADANNMNPENADGAGGKKLVITDEYFQRVTQALVMRLRQHEETVQREGSGLAGMRQRDLIQWYVKQRNESEAYENEEEAKAEVTKVKAIIESLVRREGHLIVVNEEEVPPQGEDDGNARRPSRNNRILAVAPNYVLDQLD

SEQ ID NO: 15952 - protein, 663 aa, Solanum lycopersicum
MSMNKFGLKVEEGKEGKNGEPSIGPVYRNPIAKNGFPSADPDLSTAWQLFRSAVEKYPGNKMLGWRDFKDGKWGHYNWKTYKEAYEETLQTGSALRAHGIEPGARIGIYGANCPQWIVAMEACSAHSLICVPLYDTLGSGAVDFIIEHAEIDIVFVQDKKVKELLNAECTHAKRLKLIVCFTSLQQEEKDKAVSMNIKPYSWIEFLNMGKENPSEPSPPQPLDICTIMYTSGTSGEPKGVILTHENMTASVTGVDHFMEEFEDKMTVDDVYISFLPLAHILDRMIEEFFFHRGASVGYFHGNINEIQEDMMELKPTFLAGVPRVYEKVHEGVLKALEELNPFRRHMFHVLYNFKLKWMNLGYKQKYASRLADLLAFRKVKNRLGGRIRLIVSGGAPLSTEVEEFLRVTSCGFVLQGYGLTETCGLATIGHPDEMCMLGTVGPPFVFTEVRLEEVPEMGYDPLADPPRGEICVRGRTTFTGYYKNPELTREAIKDGWFHTGDIGEMMPNGVVKVIDRKKNVIKLSQGEYVALEYLEKVYAIAPIVEDIWVYGDSFKSMLIAVVAPHEGNTKKWADKNGHKGSITELCSLQDLNQYVLLELKSAAERNKLRGFENIKGVILEPQPFEFDKELVTATMKKRRERLLKRYKLEIDDLYKRLNAAAKR

SEQ ID NO: 15953 - protein, 652 aa, Solanum lycopersicum
MADVVQYKLERMLPELDDLEKRCLFSRQEIAEIVKQRRKFEYRLKRPSPLKQDFVAYIDYEKSLDSLRLLRKKAQMKTTGDRKLKKSVSDYAGVSRIIEIYRLATTRFKGDIELWFQYLEFCRERRNGRMKKALAQVIRFHPKVPGVWIYAAAWEFDNNLNAAAARALMHSGLRACPTSEDLWVEYLRMELTYLNKLKARKVVLGEDEGTLARSGNSAKEEQWRDENKELFIVLDDKREEDKLSNLHDGDSKEKLDLFRKQGLSVLQTVYGGSIKALPSSFSLRTKFLDILEATDLGHSEDMRNEILADMKRDFSKEPKYWDWLARQEVIDLNNPETTEAMTVDQLSSAIQVYEEGLKIVPSASMFDCYAKFLTDVIHFKNKGSQSSELFSTASHAMDPISHLLVVYEKAETMGCITEDLACQHVSFLLQLGKVDEAKTLAEKLCSGKFSEAVQLWTLRFSIEMRFIQKNCTPNKAALSSIFEPMRNALLKLPISEAETIWLMALKYFSTHKKFFDKLVETSISLLAKDGGSDDGFSLSATIVNFVLQRDGLGSARELYKRFLALPHPGLSLYRNCIELELNLASSGDKISLGNVRKLFETSLTTYDQDVRLWQDYYNMEVKLGTSETAAAIHWRARKTLKKSISLLPSLNM

SEQ ID NO: 15954 - protein, 831 aa, Solanum lycopersicum
MASDSSPVNARGGPSTPDDSISSPIGNTYSSPGDSARRKRGRRSASSTPVAPSNRRFTTPEATPTPSSTNPRRGGRRASSNTPTGAATPSYASDVPPSSEGGEGDDADDTPPMYVWGTNISVQDVNAAILRFLRNFREDPSQTEGKYMRAVHNVIEMEGDSLDVDAHDVFDYDGDLYTKMVRFPLEVLAIFDIVLMDMVSRINPLFEKHIQARIFNLKTSTSMRNLNPSDIEKMVSLKGMIIRCSAIIPEIREAIFRCLVCGYYSDPIVVDRGRISEPTICGKQECLARNSMTLVHNRCRFADKQIVRVQETPDEIPEGGTPHTVSLLMHDKLVDAGKPGDRVEVTGIYRAMSVRIGPAHRTVKSLFKTYIDCLHLKKTDKSRMHAEDPMEIENGVVGNDEPLDHEEKVEKLIELSKQPDIYERLTRSLAPNIWELDDVKKGLLCQLFGGNALTLPSGASFRGDINILLVGDPGTSKSQLLQYIHKLSPRGIYTSGRGSSAVGLTAYVAKDPETGETVLESGALVLSDRGICCIDEFDKMSDSARSMLHEVMEQQTVSIAKAGIIASLNARTSVLACANPIGSRYNPRLSVIDNIHLPPTLLSRFDLIYLILDKADEQTDRRLAKHIVALHSENPENSEQEVIDLPTLASYLSYARKHIHPQLSDEAAEELTRGYVEMRRKGNFPGSSKKVITATPRQLESLIRLGEGLARMRFSEKVEKRDVVEAFRLLEVALQQSATDHATGTIDMDLITTGVSASERMRRENLVSSTRNIIMEKMQLGGPSTRLLELLEDVKKQSSGGEVHLADLRNALATLATEGLVVVHGDTVKRI

SEQ ID NO: 15955 - protein, 222 aa, Solanum lycopersicum
MKATMGEFLKKCEKINGGMKVTELGNGGLRIRDNDVEEEVTSNCSMSYSTKRRKFGSVTDVDFSENSASPATSVTSVHIPTNSQCSSCYESGEVMMKSILKSLDLKAEKFGTDNSASFNGGFSENFKPIDQPNPPSEHCGDSEDMESSSTTTKKSSSSASAPRKQLSASKVPPEAEIEEFFSAAEKREQKRFAEKYNYDIVKDAPLEGRYQWVSLKPRRINE

SEQ ID NO: 15956 - protein, 385 aa, Hordeum vulgare
MAMPFASLSPAADHHRSSPIFPFCRSSPLYSVGEEAAHQHPHPQQQQQQHAMSGARWAARPAPFTAAQYEELEQQALIYKYLVAGVPVPQDLLLPIRRGFETLASRFYHHHALGYGSYFGKKLDPEPGRCRRTDGKKWRCSKEAAQDSKYCERHMHRGRNRSRKPVETQLVASSHSQSQQHATAAFHNHSPYPAIATGGGSFALGSAQLHMDTAAPYATTAGAAGNKDFRYSAYGVRTSAIEEHNQFITAAMDTAMDNYSWRLMPSQASAFSLSSYPMLGTLSDLDQSAICSLAKTEREPLSFFGGGGDFDDDSAAVKQENQTLRPFFDEWPKDRDSWPELQDHDANNNSNAFSATKLSISMPVTSSDFSGTTAGSRSPNGIYSR

SEQ ID NO: 15957 - protein, 314 aa, Hordeum vulgare
MGPGMLEMAIFYAQERSFFHRLVRDLGQEREHMRWVIALWLWLEADGHDKFMRRASALPGPVVLRFVDEALACLARLAGRELAGAGTLLPCTNALLNRPIDDVTYFEEHRDKIMPGVKLLYKTVCRVVLDDTCASDDAIFLPRSSTASVPRAIGSPAFAGPTPVPETPTTPTTPRFADLNAIMTPRFSQLNAMAPPWSPVRVAQQHHQQHQMIIDPLPEEFRSLFITFSRGYPIDKDDIKEFFNSLHGPCVEDVMVERAPAGQLPVYGRVVLQSPDMIPVLLGGEPTAKYIIKGRHLWARVYVPSSRHSTFIEA

SEQ ID NO: 15958 - protein, 289 aa, Phaseolus vulgaris
MDSPLLFSHLKGADPFFLLAGPNVIESEDHILRMAKHLKSIASEVGIPLVFKSSFDKANRTSSKSFRGPGMVEGLKILEKVKIAYDIPIVTDVHETIQCEAVGRVADIIQIPAFLCRQTDLLVAAAKTGKIINIKKGQFCAPSVMANSAEKVRLAGNPNVMVCERGTMFGYNDLIVDPRNFEWMREANCPIVADITHSLQQPAGKKLDGGGVASGGLRELIPCIARTAVAVGVDGIFMEVHDDPLNAPVDGPTQWPLRHLKELLEELVAIAKVSKGKQQFKIDLTPFRE

SEQ ID NO: 15959 - protein, 497 aa, Phaseolus vulgaris
MASLAMVQGGGVDERCVQKSYWIEHTTELSVESMMLDSNASHLDKEERPEVLSLLPAYEGKSVLELGAGIGRFTGELAKKAGQLLAVDFIESAIKKNENINGHHKNVKFMCADVTSPNLQISEGSVDLIFSNWLLMYLSDKEVENLAGKMMKWLKVGGYVFFRESCFHQSGDSKRKYNPTHYREPRFYTKVFKECHKSDDRGNSFELSLIGCKCIGAYVRNKKNQNQICWIWQKVRSEDDRGFQRFLDSVEYNHKDILLYETVFGQGFVSTGGLETTKEFVAKLGLKAGQKVLDVGCGTGGGDIYMAENFDVEVVGIDLSINMISLAIERVIGLKCSVEFECADCTKKSYPENTFDVIYSRDTLLHIKDKPSLFRSFYKWLKPGGTLLITDYCKSVGSLSVGYANYIQKGGYYIHEMKTYSQMLEFAGFNDVIAMDQSNLFMKTLQQELNDLESKKDDFIDYFSKEDYNKISERWKAKQMRGADGEQIWGLFIAKKK

SEQ ID NO: 15960 - protein, 446 aa, Setaria italica
MKITVRGSEIVYPAAETPRRRLWNSGPDLVVPRFHTPSVYFFRRKDAEGNDLAAADGSFFDGARMRRALAEALVPFYPMAGRLARDEDGRVEIDCNAGGVLFQEADAPDATVDDFGDFAPTMELKRLIPTVEYTDDISAFPLLVLQVTHFKCGGVAIGVGMQHHVADGFSGLHFINSWADLCRGVPIAVMPYINRSHLRARDPPAPAYPHIEYQPAPAMLSEPPQAPLTAKPAAPPTAVAIFRLSRADLGRLRSRIPAREGAPRFSTYAVLAAHVWRCASLARGLPADQPTKMYCATDGRQRLQPPLPEGYFGNVIFTATPLADAGTVTAGVAEGAAVIQEALDRMDDGYCRSALDYLELQPDLSALVRGAHTFRCPNLGLTSWVRLPIHDADFGWGRPVFMGPGGIAYEGLAFVLPSANRDGSLSVAISLQAEHMEKFRKLIYDF

SEQ ID NO: 15961 - protein, 452 aa, Setaria italica
MDSLPRKRKGARAACSLAGSLHEAPAAAATARKRTCREPKPRPEKKKLSSGGGDEAASASARGGVVMTAPPASGRAAPDSPGRGLKRKLGCIESATRMGRKKRLDSEYELGAEIGQGKFGSVRICRARAGGEEFACKALAKNGEETVHREVEIMQHLSGHPGVVTLKAVFEDADQFYLVMELCGGGRLLDEIAREGKFSEQRAAIVIKDLMAVLKYCHEMGVVHRDIKPENILLTKAGKMKLADFGLAARVTNGQKLSGIAGSPAYVAPEVLSGSYSEKVDIWGAGVLLHVLLLGSLPFQGGSLDAVFESIKMVELDFSSSPWESISGLGKDLIGRMLNRDVSSRLTADEVLSHPWVLFYTECPLKVVTANLCVTNKIIAPIIPRGRLRSECESLSDLSQSSEEQDECGIVDALTAAITRVRISEPKRSRLCSPALQQECSSNLKSNLCTAF

SEQ ID NO: 15962 - protein, 288 aa, Setaria italica
MAARKEWSMSDFEIGRYIGEAARASFAREKKFHSHLRREIEIQKGLDHPNVLRLFAWFHDEERVVLVLEYAARGELYKVLRTAGRFTERTAATIRTPCPYENGRGKGRRKKSTLSASFVLNYHSFCLAGALAHCHRKQVIHRDIKPENLLLDIEGRLKIADFGWAARSNAKRHTLCGTIDYLAPEMIDKKAHDHAVDNWTLGILCYEFLYGSPPFEADKQADTFRSKIVRVDLTFPSTPSVSSEAKDLISKLLVKDSSKRLSLEDIMKHPWIKKNAEPSGSCIKQKDL

SEQ ID NO: 15963 - protein, 87 aa, Setaria italica
MALTKCAIAVFLVLAVISNTSTCCVRAICSGCPTPKPKPGMPCFHAGSSQHPCTTEKCSRLCEHLNHNGTLAYCRSASPGVCCCPNE

SEQ ID NO: 15964 - protein, 542 aa, Setaria italica
MAREQALLSTEIVNRGVEPSGPDAGSPTFSVRVRRRLPDFLQSVNLKYVRLGYHYLISHGVYLATIPVIVLVCGAEVGSLSRDELWNKVWGEATYDLATVLAFLAVLAFTISVYIMSRPRPVYLIDFACYKPADELKVSKAEFIDLARKSGKFDEDSLAFQSRLLAKSGIGDESYMPRCVFEPNVNCATMKEGRAEASTAMFAALDELFDKCRVRPKDVGVLVVNCSLFNPTPSLSAMIVNHYKMRGNILSYNLGGMGCSAGVIAIDLARDMLQASGAGLAVVVSTEAVSFTWYPGKRRSMLIPNAFFRAGCAAVLLSNRRRDFHRAKYQLEHVVRTHKGADDRAFRSVYQEEDEQRIKGLSISRDLLEVGGHALKTNITTLGPLVLPFSEQLLFFAGVLFRHLFPSKTSTPPPATTPGDASAAAPYIPDFKRAFEHFCMHAASRDVLEHLQSNLGLRDGDLEASRAALHRFGNTSSSSIWYELAYLEAKGRVRRGDRVWQLAFGSGFKCNSAVWRAVRRVRRPSRSPWLDCVDQYPARMDA

SEQ ID NO: 15965 - protein, 406 aa, Gossypium raimondii
MCTSKAKVTTGTTHVEITPPAVARINGRPVLQPTCNRVPSLDRRNSLKKIPPISPPPPASLPFTPSATSTTTVANGSRARASLTLPLSPSSKFTTKRGSDPNALNSSSEKVAIPRNTTKTLDRKKSKSFKEGMGNNGLSSYIEPSLSYSSSLLVEAPGSIAAVRREQVALQQAQRKMKIAHYGRSKSAKFESKVVPLDNTKPAEEKKRCSFITPNSDPIYVAYHDEEWGVPIHDDSMLFELLVLSGAQVGSDWTSILKKRQDFRDAFSGFDAETVANFTEKQMTTISSEYGIDISRVRGVVDNSNRILEVKREFGSFDKYIWGFVNHKPMSTQYKFDHKIPVKTSKSESISKDMVRRGFRFVGPTVVHSFMQAAGLTNDHLITCHRHLPCALLAIQRPPVHSLPDL

SEQ ID NO: 15966 - protein, 506 aa, Zea mays
MPAAAAPAPHTRTRTRSSGSPSAAIGPPLPYWGGAAVGAEEQRWRIGMDSAAAALLDSASASASSANAAGKEMPTARHIAHRTAHNMSSSSLRKKSDLALLRKVPCAPLRRLLDNLQEVLLATKLALLFPAVLLAIAARIFHFGQEWVFVLSLIGLVPLAERLSFLTEQVAFYIGPTVGGLLNATFGNVTEVIIAIFALYQGKVVVVKCSLLGSVLSNLLLVLGTSLFFGGLANLGTEQLYDKMQVDVSTGLLILGVLCHSLPLMLRYAVSSGEHAESSWDSGLELSRACSIVMLLAYVAYLFFQLKTHRQLFEPQPQEVEDDGDDSVSQDEAVLGFSSAMIWLGVMTLMTALLSEFVVSTIEAASESWELSVSFISVILIPIVGNAAEHAGAVIFAFKNNLDITLGVSLGSATQISMFVVPLSVLVAWIMGVPMDLDFNLLETGCLFLAILVTAFTLQDGSSHYLKGLLLVFCYIVISLCFFVLRQHGNGSNDDQLGVASKPWRI

SEQ ID NO: 15967 - protein, 172 aa, Zea mays
MAASAPAVRPLARAAIPIPLSARPRTARVSLLPLAPLAPAQRLALGRTGQARLPARSRSVRCLAALSPEMRETLDKVVGSSKVLLFMKGTKDFPQCGFSHTVVQILRSLDVPFETLDVLANEALRQGLKEYSSWPTFPQLYIDGEFFGGCDITVEAYKSGELQETLEKAMCS

SEQ ID NO: 15968 - protein, 132 aa, Zea mays
MASCSSSPRPPTIPLLLLLLFLLLHFSSVLAAPAPPALSQQAGTGGGNATDSAAAWTPRLRKTFLDGGMERWRGRRLVGRFQVCAVCTCCGGPHGMCIPAPCCYAINCNIPNRPFGVCSFTPRTCNCLTCHL

SEQ ID NO: 15969 - protein, 539 aa, Zea mays
MDSPLMKPLLVPNNHSPGPVVAATPGEHGGAAADESSTLVDAASGTDESHRALADADVKMNDDGDVQGDELSASVQRRLDESSAVEGEDEEEEIGDDAEADDMAARMGRRLAALPGNAHESEPFTIFRVAGPMRDRNRHLYEPQMISIGPFHRGAGRHLAAMEEHKWRYLRDILARPGGATLASYARAARSMEASARRRYAEPVLLPAAEFAEMLLLDGCFLVEFFLKGQESAEDALIDASWAMQNVYNDMLLLENQLPFFVLERFYDLATGGLGRDYFVTNVLVNYLTVDMCVGPRDPESTRPPDGEIHHLLHLYYYWFLPPEDRDGSGTGSKDKEDGEALEELMSTSADERMPWQLPPASELKDSGVTFRAKKSPRSMVDVTFDRRSGALEIPAVESYTNHAIFANLLAYEQSRGRWELQRLVSYVLLMASVVDARRDVEVLQRAGVFVRGDEETAAFYAHLGELCPPPEFVNNCYADLFRDVLEYCGRSWNRHRAVLVHDYFSNPWTSMSAAAAVFLLVLTVVQTVYTVLPYYSQN

SEQ ID NO: 15970 - protein, 803 aa, Zea mays
MVKFSREYEASIIPEWKAAFVDYRCLKKLVKRIKIARRDATREAGGGSSSDATSSYGFSVLDPVRALAAHFASATPPAVSPANGDEEEEDDDAESLEPDSGELVVVATAKHEREFLEKAGEELEKVNKFYAAQEADMLARGAALVEQLRILADVKRILANHAVASRRSRPAGDSPPPPPSADGRSNSGRHLLSSSSPFLQASPQSMLDGSAELPQARVAEEVMAALERNGVSFVGSGLGSKAKKDGGGKQLTGRAAALPATVRIDVPPTSPGRAALKVWEELVNVLRKDGADPAAAFVHRKKVQHAEKSIRDAFLALYRGLDLLNKFSSLNVKAFTKILKKFVKVSEQQRKTDLFSEKVKRSPFSSSDKVLQLADEVECIFSRHFAGNDRKVAMKYLKPQQPRNTHMITFLVGLFTGTFVSLFIIYSVLAHVAGIFSSTGNTAYMEIVYHVFSMFALISLHVFLYGCNLLAWKSSRISHNFIFDFSPSTALTHRDAFLVSASIMCTVVAALVVNLFLSNAGATYANALPGALLLLSAAALFCPFNVFYRSTRYCFMRVMRNIMLSPFYKVLMADFFMADQLTSQIALLRHLEFTGCYFMAGTFTTHAYGSCTSSSQYKNLAYVLSFLPYYWRAMQCLRRYLEEGHDIDQLANAGKYISAMVAAAVRFKYAAAPTPFWMWMVIVSSTGATVYQLYWDFVMDWGFLDLRSKNRWLRDQLILKNKPIYYASMMLNLVLRLAWAESVMKLRLGMVESRLLDFSLASLEIIRRGHWNFYRLENEHLNNAGKFRAVKTVPLPFRELETD

SEQ ID NO: 15971 - protein, 514 aa, Oryza sativa
MASISAASPVAGKAAAFAHKNELAAAAVAPSQQQLQRRVSGRRARSGRVRAVATPARAPRAPSSTGSVKSAMTMTEKILARASERASLEPGENVWVDVDVLMTHDVCGPGTIGIFKREFGEDAKVWDREKVVIIPDHYIFTSDERANRNVDILRDFCMEQNIKYFYDIKDLSNFKANPDYKGVCHVALAQEGHCRPGEVLLGTDSHTCNAGAFGQFATGIGNTDAGFVMGTGKALLKVPPTIRFVLDGEMPPYLLAKDLILQIIGEISVSGATYKSMEFVGSTVESLNMEERMTLCNMVIEAGGKNGVVPADQTTFNYLEGKTSVEYEPVYSDAQARFVSDYRFDVSKLEPVIAKPHSPDNRALARECKDVKIDRVYIGSCTGGKTEDFFAAAKVFLASGKKVKVPTFLVPATQKVWMDIYSIPVPGAGGKTCSQIFEEAGCDTPASPSCGACLGGPRDTYARMNEPMVCVSTTNRNFPGRMGHKEGQIYLASPFTAAASALTGYVTDPRDFLM

SEQ ID NO: 15972 - protein, 257 aa, Oryza sativa
MAAAAAAPALSLAEAAPVTAVLAPCPTPSRTFRRRSWVAAICRPALKCHHSRPLTAVVAAAAAAAAAGDSTSAGVFHGECFVVGDNIDTDQIIPAEHLTLVPSKPDEYRKLGSFAFVGLPTAAYPTPFVAPGEETTRYAVIIGGANFGCGSSREHAPVALGAAGARAVVAEGYARIFFRNSVATGEVYPLELADTGAWKECKTGDVVTVELDNCVMINHTSGKQYKLKPIGDAGPVIEAGGIFAYARKTGMIASKSA

SEQ ID NO: 15973 - protein, 485 aa, Oryza sativa
MKQSMRSRQEPRRVSNGVIIAAMLLSLCVLSIVKARYCSTPFVKPDDQLQEQMNSSIRMETDEPATMAAGEQEEDEEEESSGGGGAEPEVSATPAVVVTAAAGGGGGKRKPTCRMTSKRSERCEARGDIRVEGNASTIYIGGIDKEWKTKPYARYHDPVAMAVVREFTLKPVTESSPACTRNHSVPAFVFSNGGFSGNLYHDYTDVLVPLFLSTHQFKGQVQFLLSGLKPWWVNKFNLFFRQLTKYDILDIDNDKDVHCFPRIVVGATFHKDMGVDPKRSPGHVSVVDFKRALRRAFGLERVAASRGGATGNGKPRLLIISRKNSRRFLNEREMAQAAAAVGFEVRIAEPDQHTDMSTFAQLVNSADVMIGVHGAGLTNMVFLPRGAVLIQVVPFGGLEWLTTVTFKNPAKDMEVTYMDYNVQLEESSLIDQYPRNHQVLTDPYAVHKQGWDALKTAYLDKQNIKMDMDRFKKTLQEALDRLPPA

SEQ ID NO: 15974 - protein, 258 aa, Oryza sativa
MAATGAGEGKETAAVAGGGGGGSLHSKTLLKSEPLYQYVLESTVFPREPDCLRELRLATANHPMAVMAASPDQVQLFGLLIELISAKNAIEVGVFTGYSLLATALALPDDGKIVAIDVSRESYDEVGAPVIDKAGVAHKVDFRVGLAMPVLDELVAEEGNKGRFDFAFVDADKVNFLGYHERLLQLVRVGGLIAYDNTLWGGSVAAPPAAADEAVPSGRDRSLAALAREFNAAIAADRRVKPCQLAIADGVMLCRRVA

SEQ ID NO: 15975 - protein, 616 aa, Oryza sativa
MPLLIVQPVPISTGPIACASTARPAAAAHDDDGHLFDDLVLGYGGDDKTSADADDPARKLEWLRSQVIGADAEFASPFGTRRVTYADHTASGRCLRFVEDFVQRNVLPYYGNTHTVDSYVGLHTSKLASEAAKYVKRSLGAGAEDVLLFCGTGCTAAIKRLQEVTGMAVPPTLRSVALDVLPPSERWVVFVGPYEHHSNLLTWRESLAEVVEIGLRPDDGHLDLDALEAALAAPERAGRPMLGSFSACSNVTGIRTDTRAVARLLHGYGAYACFDFACSAPYVGIDMRSGEEDGYDAVYLSPHKFLGGPGSPGVLAMAKRLYRLRRTAPSTSGGGTVVYVSAYGDTVYCEDTEEREDAGTPAIIQKVRAALAFRVKEWVGEACIEAREDHMLALALRRMQASPNLRLLLGGDRPSGGRCLPVLSFVVYSPRDGSEQDERPQLHCRFVTKLLNDLFGVQARGGCSCAGPYGHRLLGITPARAKAIKSAVEKGYHGVRPGWTRVSLAYYTSTREAEFVLDAIDFVASFGHRFLPLYAFDWETGDWEYNHSFGRVLANNNAISNAAAAASSGRVKAEDEYRSYMAFARSLADSLGGCLDNTPARHVPKGIDPQLLYFPM

SEQ ID NO: 15976 - protein, 280 aa, Oryza sativa
MRGGAAGPTAGEPPGTEAEAEEVEESSAGDDEELELGLSLGSKKQQQQQHAPCRILTARDLQPAAALSPDSSVSSSSPAAAAAAGGKRAEGPTATTSPGTVASGHPHSFGVVGWPPIRQFRMNSLFNQAKENTSETDTKKTATNESDVQKDKEEGEKKGRVAGWVKVNMDGEVIGRKVDLNAHRSYKTLALALELMFTKPSIGLCASHNTKSLKLLDNSAEYQLTYEDRDGDWMLVGDVPWEMFVSSVKRLRIMRTSDANGLGQRYQGIHRTIASTRGRS

SEQ ID NO: 15977 - protein, 483 aa, Oryza sativa
MAASETAPFGVSAASKGGGGVAGARAQHGQLAVAGRVHDALVFAAGAVAAVLVLLATASFLSPMPVTNLVAFRSLPVSVASTSAASAAIDADVGVRGGPGAAGRTFYDDSRVSYAVEVGRRGGITGWDARRAAWMRLRYPRGLNATAAGRERVVMVSGSQAPPCRGEGGDHLLFRFLKNKVDYCRLHGVELLYNNALLQPRMLAYWAKIPAVRAAMLAHPDAEWVWWVDADAVFTDMDFSLPLHKYKDHNLVVYGWNKEVYGERSWVGLNAGVFLIRNCQWSLDFMDAWARMGPASPEYARWGSVLHDTLRGKSDKESDDQSALVYLLSEHEEKWGAKTYLEKGYFFQGYWVEVVDRLDDIAARYEAAERRPSAAAAHLRRRHAEREHERYAAARNAAVRGAVPGPAGGGQSGWRRPFVTHFTGCQPCGGEPNKIYSKKSCADGMNRALNFADDQVLRNYGYRHKDPLSDEVRPLPFDYPAAR

SEQ ID NO: 15978 - protein, 117 aa, Oryza sativa
MARSSSSLLVLTVLVVAAAACSTTAAARSVPAEEKKTAAPVAAADVKQPETFHEGTVLIPGLGRFELGSTYVPDITGVDHSVPAAEHGQFLPGADDTWVPNPGFEVPNPFQPGSSSP

SEQ ID NO: 15979 - protein, 73 aa, Oryza sativa
MAVAARAPLGVVAVVAVLVVGIFMPAAAQAPAPAPVSDGTSIDLGIAYILMLVALVLTYLIHPLDASSPYKLF

SEQ ID NO: 15980 - protein, 826 aa, Oryza sativa
MSASEFRIPYQQVSSSQTTENAGQFKICRCGEGDPNTNTSETGDKSPTSCPNCQVLKSGHLLLSSKGIGWTTWKKRWFILTRASLVFFRSDPNAPPRGNEPIVTLGGIDLNNSGSVVVKEDKKLLTVLFPDGRDGRTFTLKAETTEELNEWRSALENALAQAPVVANTVGQNPIFSTDIAEPAEAPAEQSDNKSIIGRPAEFALVDADGSPAFLEKALKFIEDYGVKVEGILRQSADVEEVKRRVRDYEKGKNEFSPEEDAHVIGDCIKYVLREMPSSPVPAPCCTALVGAYRTDKTRRLDAMNRVIYEVFPEPNRQLLQRTLKMMQIVESHKAVNRMSQSALAACMAPLLLRPLLLGECEIDSDFSMAGDGSFQLLQAAAAANHAQAIVIIMLEEYDQIFDDLEDGSYSSDAYTESEDGDFDKEYSTDNDGPEEDDSYDSGEDNIEEGMDDDTEHSSGGSECDNNIKTSVSDDKVKSNNSGTASNGNDQGLQPPKKAARTGHGAVREDTCQIESNDPSNRKQELYESNGSTDQIEKLNVRSSSARAKFMEKSSSSRNKSKKTLWGRTSARKNLSAEEIDYCSDDETLIEKLENSKTDLQSKITKEAKENSILQASLERRKVELHKRRLALEKEVENLRDQLQKERNLRVSLESGLMNLRRGQASFPSTIDNKGSDLRGQLNNQVQMSSASLCDSCNKRLLNTDKLTEGEQSTTSSNVGPNSISDMVSATHMAQRMLISKGEIVKDGQDPLASKWNLAQKQYSNNPLLGRLGSRTEDSGAPSALAKLTNRLNFLKERRAILASEMQNLDLARPPGPPAPAPKRDST

SEQ ID NO: 15981 - protein, 134 aa, Oryza sativa
MALPIKLLLVSAFLSLLLLIQGAAARSSPAAGKCAAASVEVEQANTGEKAGYDPVFEVTVRNRCACAARGVRLRSEGFASSVAVDPRLFRLDRDAGDYLVGDGRRIEPSAAVTFRYAWDRAFRMAPAALLDDCS

SEQ ID NO: 15982 - protein, 319 aa, Oryza sativa
MVAVVMMAMRKRMRGALLALALLLTATAVVPLLLLGEAGDDGVGAVAAAPPFNASRVRAVSWRPRVFVYKGFLSDDECDHLVKLGKRKMQRSMVADNKSGKSVMSEVRTSSGMFLDKRQDPVVSRIEKRIAAWTFLPEENAENIQILRYEHGQKYEPHFDYFHDKVNQALGGHRYATVLMYLSTVEKGGETVFPNAEGWENQPKDDTFSECAQKGLAVKPVKGDTVLFFSLHIDGVPDPLSLHGSCPVIEGEKWSAPKWIRIRSYEHPPVSKVTEGCSDNSARCAKWAEAGECEKNPVYMVGAEGLPGNCRKSCGVCDS

SEQ ID NO: 15983 - protein, 217 aa, Oryza sativa
MSLFGRSSRSQLTFRPKKSSPSGSKGLPLKKHIDATLGSGNLREAVRLPIGEDLNEWLAVNTVDFFNQVNFLYGTLMEFCTSSTCPIMSAGPKYEYRWADGMKVKKPVQVSAPKYVEYLMDWVESQLDDEAIFPQKIGAPFPQNFREVIRTIFKRLFRVYSHMYHSHFQMILKLKEEAHLSTCFKHFVLFTWEFHLIDRAELAPLNELIEPIVFRYF

SEQ ID NO: 15984 - protein, 373 aa, Oryza sativa
MAGKENAAAAQPRLTRAAAKRAAAVTAVAVAAKRKRVALSELPTLSNNNAVVLKPQPAPRGGKRAASHAAEPKKPAPPPAPAVVVVVDDDEEGEGDPQLCAPYASDINSYLRSMEVQAKRRPAADYIETVQVDVTANMRGILVDWLVEVAEEYKLVSDTLYLTVSYIDRFLSAKSINRQKLQLLGVSAMLIASKYEEISPPNVEDFCYITDNTYMKQEVVKMERDILNVLKFEMGNPTTKTFLRMFIRSSQEDDKYPSLPLEFMCSYLAELSLLEYGCVRLLPSVVAASVVFVARLTLDSDTNPWSKKLQEVTGYRASELKDCITCIHDLQLNRKGSSLMAIRDKYKQHRFKGVSTLLPPVEIPASYFEDLNE

SEQ ID NO: 15985 - protein, 578 aa, Oryza sativa
MMEGHSNELGRANTLKKGGLRPIPVIIANEVSERIVSASVTANLIIYLTTKYHLGAASSAIIIFVYQAAANFLPVCGAIVSDALLGRYLMVTLTLFSCTTGTFMLFLTSLIPKLTPPDCGLSNQGCTSPSPLQLFVLCASLGFMSLGASGVRPCCLAFAEDQIAHWDEAQKDRALRGLFSWYYVSVGFAQIVAVTILVYFQDQVGWKVGFGISAAVMLSITLVNLAASPFYVKMKPQRSIWISLLQVVVVSLKNHHLVLPKTYQSAQFHNASGLRELVPSEKMRFLNKACILRYHATNVSDGAGRTNSWNICTVEQVENLKSALSVIPMWSAMIMTFLIQSSSFGVLQAATMDRRVGTKKFQLPAGSISIFEIITFTIWSGCYDRYIVPFLRRITGRQQVLTLKQRMGIGVSLSIASMLVASAVETYRRKVAVKGGLQHDAKGTLEMSVLWLAPQYVIIGLAGAFSSIGQIEFYYAVLPKSMGSFVLALLFFGAGVASIIATLVIKAINLITGRNGMAPWLSNNLNEGHYNYYYFLLAVLGAIDLIYFIVCSYVFDERTQNMSLETSGDAKDMVEFQG

SEQ ID NO: 15986 - protein, 698 aa, Sorghum bicolor
MNPYFVGILVPVAVSLLLRKRRKAERKRGVPVEVGGEPGYAVRNYRFEQPVETHWEGVSTLAELFEQSCKEYVNMPLLGTRKLISRETEAAPGGRSFEKLHLGEYEWKCYAECFKSVCSFSSGLIRVGHEKNERVAIFAETRAEWQIALQACFRQNITVVTIYASLGEEALCHSLNETEVTTVVCGQKELKKLIDISGQLDTVKHVVYINEEGISAEVSLAQNCTSWKVESFEEVIRLGSESPVEANMPLPSDVAVIMYTSGSTGLPKGVMMTHRNVLATLSAVMTIVPALGSKDIYLAYLPLAHILELAAEALMAAVGASIGYGSPLTLTDTSNKIKKGTLGDASALKPTLMTAVPAILDRVRDGVRKKVDAKGGIAKQLFDIAYNRRLAAINGSWLGAWGLEKHLWDTLVFGKVRAILGGKIRFVLSGGAPLSGDTQRFINICLGAPIGQGYGLTETCAGGTFSEYDDTSVGRVGAPLPCSFIKLIDWPEGGYLTTDLPMPRGEIVIGGPNVTKGYFKNEAKTNEVYKDDEKGMRWFYSGDIGRFHPDGCLEIIDRKKDIVKLQHGEYVSLGKVEAALIVSPYVENIMIHADPFHNYCVALVVAAHIELESWASQQGIKYSDFSDLCQKQEAVKEVLGSLAKAAKQARLEKFEIPAKIKLIPEPWTPESGLVTAALKLKREVIRKTYENDLAQLYA

SEQ ID NO: 15987 - protein, 694 aa, Sorghum bicolor
MRRAAAAAVAVDPQLLAGAVEAAIASRSPRLGRAAHARALRLLAPALPPFICAHLVNLYSKLDLPGAAAAALAADPSPTVVSYTAFISGAAQHARPLQALSAFAAMLRLGLRPNDFTFPSAFKAAASAPPRCAAAVGPQVHALALRFGYLPDDAFVSCAALDMYFKTGRLALARRLFDEMPNRNVVAWNAVMTNAVLDGRPIETVEAYFGLRGAGGMPNVVSVCAFFNACAGMTCLSLGEQFHGFVAKCGFDKDVSVSNSMVDFYGKCRCMGKARLVFDGMGVRNSVSWCSMVVAYAQNGAEEEAFLVYLGARRAGEEPTDFMVSSLLTTCAGLLGLDLGRALHAVAARSCIDANIFVASALVDMYGKCGGIQDAEQVFFEMPQRNLVTWNAMIGGYAHIGDAWNALAVFDEMIMGRETAPNYITIVNVLTACSRGGLTKEGYELFQTMKQRFGIEPRIEHYACVVDLLGRAGMEEQAYEIIQGMPMRPSISVWGALLGGCKMHGKTELGRVAAEKLFELDPQDSGNHVLLSNMLASAGRWAEATDVRKEMKNVGIKKDPGRSWITWKNIVHVFQAKDTTHEMNSEIQALLAKLKGQMQGAGYMPDTQYALYDLEEEEKESEVFQHSEKLALAFGLICIPPGVPIRIMKNLRICVDCHRAFKFISGIVGREIIVRDNNRFHHFKDYECSCNDYW

SEQ ID NO: 15988 - protein, 104 aa, Sorghum bicolor
MFALKVAVLLLLITIIAVNPATAWPCTAQEKDQIVGVCRIYILKGALVQLPPQTGPCCGAVRQLEKLHKSPQMNCIASKLNAADLQKYDPTKVRHLDESCYQKH

SEQ ID NO: 15989 - protein, 406 aa, Glycine max
MEGSKENCVPRIPLIPSSNLQEGPRMKPLLHHRLPLGNISQNVNMPHSQVNKLDLSRKCTAHTIQHHFPQETKKQNLLAPNPSCKLDCDIVDIDDDDGDGSDDAVPVFVKHTEAMLDEIDKIEEVEMEDVEEEPVLDIDACDRKDPLAVVEYIDDIYSFYKDIENSSCVSPNYMTSQLDINERMRAILIDWLIEVHYKFELLEETLFLTVNLIDRFLERQAVIRNKLQLVGVTAMLIACKYEEVTVPTVEDFILITDKAYTRNEVLDMEKLMMNILQFKLSMPTPYMFMRRFLKAAHSDKKLELLSFFLVELCLVECKMLKFSPSLLAAAAIYTAQCSLYQFKQWTKTTEWYTDYSEEKLLECSRLMVTFHQKAGSGKLTGVYRKYNTWKYGCAAKIEPALFLLDN

SEQ ID NO: 15990 - protein, 469 aa, Glycine max
MAMAIAMVPQPLLTLFLFFSLLSIANSSPSQHLQIANAERRIDLTSHIIKVYLTLKVENLGTSPASEVHIAFSPTEVEHLAIVKAAATSGKRKKKTYVPLDVKSAELPDGPNGTKFFSITLLTPLSKGETTTLEVLYILTHSLEPFPVEISQSESQLVYFRDSAILLSPYHVKQQTTFIKTPSTRVESFTVVDPTKRAGTELKYGPYENHPPYSYSPVLIHFENNNAFAVVEELEREIEISHWGSIQVTEQYSLVHAGARHKGVFSRVEYQTKPGGTGVSSFKHLLAKLPPRVHSVYYRDGIGNISSSHLRTDSWKSELEIEPRYPLFGGWKSTFVIGYGLPLQDFLFESPDGRRYLNFTFGCPLVETVVDKLIVKVVLPEGSKDPTVEIPFEVKQHLEIKYSYLDVVGRTVVVLEKRNAVPEHNAPFQVYYSFNPIFMLAEPLMLVSAFFLFFVASVAYLHIDLSIRK

SEQ ID NO: 15991 - protein, 525 aa, Helianthus annuus
MRDREMCRVEDRDKKRRRFAIGTMGLRKLGEIRVEKLKNSMVNVRSGKMKMMLIRAMTTVLLWICLVQLTALGGSLGPRVLKGWPSCFTQDSHSAAALDVKLLPVHARVLPHKRVYKNNGYLVVSCNGGLNQMRSAICDMVAIARYLNVTLIVPELDKTSFWADPSEFEDIFDVDHFITSLRDEVRILKQLPPRLKKRVELGIVHTMPPVSWSDISYYHNQILPLIQKYKVVHLNRTDARLANNGQPLELQKLRCRVNFRALRFTNQIEELGRRVVKLLRQNGPFLVLHLRYEMDMLAFSGCTQGCNAEEVEDLTRMRYAYPWWKEKIINSDLKRKDGLCPLTPEETALTLRALDIDRDIQIYIAAGEIYGGKRRMDSLAAAYPKLVRKETLLGAADLQYFQNHSSQMAALDYLVSLESDIFVPTYDGNMAKVVEGHRRFLGFKKTILLDRRVLVELIDKYTSGLLGWDEFSSAVKDTHAQRMGNPRKRLVIADRPKEEDYFYANPEECLQPSDDDDEEEAVNIL

SEQ ID NO: 15992 - protein, 392 aa, Helianthus annuus
MMAVGVSALQITAARPSVFLTQRTLGATMATFVHESDRILSSKLTSSSHLSSVLNIKHKCTTSRPRFQKFVTRSMSEASGSKSVSQLSIDLKGKRAFIAGVADDNGYGWAIAKSLAAAGAEILVGTWVPALNIFEMSLRRGKFDESRVLPDGSLMEITKVYPLDAVFDNPEDVPEDIKTNKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSFANAPLQKTLSADEVGNTAAFLASPLASAITGALIYVDNGLNAMGVGVDSPLFKDLNVPMDKH

SEQ ID NO: 15993 - protein, 757 aa, Helianthus annuus
MTVGAGISVTDRKLNVFGNPVLKDVHDNVFVTSSTGDGMINGAFIGVRSEQTGSRMVFPVGKLEGLRFMCVFRFKLWWMTQRMGNCGQDIPTETQFLIVETSEGSHFGENNEIDDGSHQSALYTVFLPILEGDFRAVIQGNSNNELEICLESGDPAVKEFEGSHLVFVAAGPDPFDVITNAVKSVERHLQTFSHRERKKMPNMLDWFGWCTWDAFYTDVTSEGVKQGLESFQKGGISPKFVIIDDGWQSVGMDPTSVEAKADNSANYANRLTHIKENHKFQKDGKEGHRVEDPSMGLRHVVTDIKDHHNVKYVYVWHALTGYWGGVRPGTGQYDSKLSFPIPSPGIESIENCDAFIAIAKNGLGLVDPEKVFNFYNELHSYLASAGVDGVKVDVQNILETLGAGHGGRVKLTRKYHQALEASVARNFPDNGIISCMSHNTDGLYSAKRTAVMRASDDFWPHITASHTVHIASVAYNTVFLGEFMQPDWDMFHSLHPMADYHGAARAVGGCAIYVSDKPGHHDFNLLKKLVLPDGSILRAKLPGRPTRDCLFTDPTRDGKSLLKIWNVNNYTGVVGVFNCQGAGWCKDGKKILTHDEQPSTITGVIRAKDVNYLPKVADSTWDGDAVAYSHVGGGLVYLPKNASIPVTLKPREYEVFTVVPISKLSCGVGFAPIGLTEMFNSGGAISELRYETEKEGNVELKVRGCGVFGAYSTRKPTRVIIDSKETEFGYEERSGLVSIKLSVPEKEMYLWDIIIQV

SEQ ID NO: 15994 - protein, 772 aa, Solanum lycopersicum
MAASSDTVTPSSLRLAFGNVFSLFILILIGVLAFSIRIFSVIKYESVIHEFDPYFNYRVTQFLTKNGIYDFWNWFDDRTWYPLGRVIGGTVYPGLTLTAGTLWWILNSLNIPLSVETVCVFTAPTFSAFAAWATYLLTKEVKGVGAGLTAAALLAMVPSYISRSVAGSYDNEAVAIFALIFTFYLYIKTLNTGSLFYATLNALSYFYMVCSWGGYTFIINLIPMHALLCIVTGRYSSRLYIAYAPLVILGTLLAALVPVVGFNAVMTSEHFASFLVFLILNVVGLVYYIKGMLTPKMFKVAVTLVVSAGLIVCCAVVAVLVALVASSPTKGWSGRSLSLLDPTYASKYIPIIASVSEHQPPTWPSYFMDINVLAFLVPAGIIACFLPLTDASSFVILYLVTSVYFSGVMVRLMLVLAPAACIMSGIALSSAFGVFTRSIKFASTGKQADAGDNGDGVTQNDVVKSDRNEELPKEKASRKKKKEKENVEKVPIANKKSEKRLLMLPMEASFVAILLLVLLGAFYVVHCVWAAAEAYSAPSIVLTSQSHDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSMATPTMLNSLMYKLSYYRFVETDGKGYDRVRRTEIGKKHFKLTHFEEVFTTHHWMVRLYKLKPPKNRIRGKTKKSKSKATSSSSRRSATQKKNPWQ

SEQ ID NO: 15995 - protein, 630 aa, Solanum lycopersicum
MRKHGWQLPYHPLQVVAVAVFLALGFAFYVFFAPFVGKKLFQYIVMGLYTPLIISAFGLYIWCAAADPADPGVFRSKKYIKKLDHEKQVQLKESKLGCETNSSIQDANAASIGENASGKSNKGAEPAADHNETEQKITATRERSFSSGLLALLPCALISNCTGRHEESSQQQLSEDGMFYCSLCEVEVFKYSKHCRVCDKCVDQFDHHCRWINNCIGKRNYRKFFALMVSALLLLILQWSTGILVLICCFIEKKKFSAEITSKLGSSFSIVPFVIVVAVCTILAMIATLPLAQLFFFHILLIKKGISTYDYIIALRDQEQQGVAGQQSPQMSTVSSLTGLSSASSFNTFHRAAWCTPPRLFVEDQYDVVPPDTVSVSSLGKRSTADEPIKKKNPAAVKISPWTLARLNAEDVSKAAAEARKKSKILQPVVRNKEPYILETNSSLGSSGRRMVPRLDNNRRRASKRVRLPAELPFETMSKIPNDIAQNSRRPMLTESSSSLAPLQLEARSDFRTTRGLSTSGVVVASSPESSLDSPDIHPLRMSSSGVEDAARLVGHLSSGMTLQKDTPLSRSTSDGYEASGGEDSDRVPTRIVQRSTRWSSILFGSDQQDDRVRRLMVPSSSTQANIRKH

SEQ ID NO: 15996 - protein, 296 aa, Solanum lycopersicum
MPICSSSSSSSSSSSAKSWILHGLAVGAAAAAVALGAHAYLSRSGKFRSRVIGIIPARFASTRFQGKPLVQILGKPMIQRTWERAKLAETLDQVVVATDDEKIAECCRGFGAEVIMTSESCRNGTERCNEALQKLDKKYDIVVNIQGDEPLIEPEIIDGIVKALQSAPDAVFSTAVTSLKPEDAFDPNRVKCVVDNRGYAIYFSRGLIPYNKLGKVNPQFPYLLHLGIQSYDTKFLKIYPELTPTPLQLEEDLEQLKVLENGYKMKVIKVDHEAHGVDIPEDVEKIEQFMRERNMA

SEQ ID NO: 15997 - protein, 432 aa, Triticum aestivum
MARDNGDGLAAIAGRIGVLGSVALNIAALAIYLRGRAAAEKQASKKVKKAAAVAPSSGKPPVACDSVINLDHGDPTMFETFWRGPIGESATLVIPGYQTMSYFSDVGNLCWFLEPSFEREVRRLHSLVGNAAVEGYHVLVGTGSSQLFQAALYALALPIADAPVSVVSTTPFYSMYPPLTDFLNSGLYRWAGDANTFDGDDYIEVVCSPSNPDGSIREAVLKSKSGKDIHDLAYYWPQYTPITQMLAHDIMLFTVSKCTGHAGTRIGWALVKDKEVAQKMSKFMEQSTIGVSKDAQLRAAKVLGAVTDGYEHQLATAAGGDANLLFHYARRKMAHRWCALRAAVAASGIFSLPNEVAGFCTFTKDTVTSNPAFAWLRCEKQEVEDLESFLRENKIITRSGTKFGADQKVVRISMVDTDEAFGIFVNRLAAIK

SEQ ID NO: 15998 - protein, 531 aa, Triticum aestivum
MAAMMGISALRSHHPLPLSTARPATALPRATSPTSHQPSSLTLLRCRCRCRRSLPHSCCSSSPRASLSPGAPDSAAFMALAPNNAALRHRLIAPNSTAGSGDAAATGGLPSVVGIAHLAVSLGIVLATDKYLKQAFVAASIKFPSALFGMFCIFSVLLVLDTVAPALAKAFMDFFEPATLFIQRWLPLFYVPSLVVLPLAVRDVPAASGLKICLITFGGWFASLAVAGYTALTVRKIVKTELIAAEPMGKPSAFATLEFWAWGAVFVASFATAFVNPTALGTTARTCLPFMLASTVLGYMVGSGLPPGIKKLLHPIICCALSANLSAVAYGYLSGSGIDAALGDYLTKVPSNPGAGDVLMGFLGSVILSFAFSMFKQRKLVKRHAAEIFTSIAIASTFSLYSTAILGRLIGLEPTLTISILPRCITVALALSIVSFFEGANTSLTAAVVVLTGLIGANFVQAAMDKLGLNDPIARGIGTASSAHGLGTAALSAKEPEALPFCAIAYALTGIFGSLICSSPAVRQSLVFIAG

SEQ ID NO: 15999 - protein, 626 aa, Oryza sativa
MTMMGCAVLLVVVASMAGEAAGRFVVEKNSLRVTSPAGLRGVYECAIGNFGMPQYGGTMHGVVVYPKANKKACRSFDDFDLSFKPKPGGLPIFLLVDRGDCYFTTKGWNAQTAGAAAVLVADDRLEPLITMDSPESSGTDYIEKITVPSALVTKKFGDDLKKALENGDMVNVLLDWRESLPHPDERVEYEFWTNSNDECGAKCDMQMNFVRNFRGTAQVLEKRGYTQFTPHYITWYCPEAFVLSKQCRSQCINHGRYCAPDPEQDFNIGYDGKDVVLQNLIQICLFKVGNETHKPWVWWDYVHDFSIRCPMKEKKYTRECANGVIKSLGLDLERINKCVGDPEADEENPVLKAEQDAQIGQGSRGDVTILPTLVVNNKQYRGKLEKSAVLKAVCSGFEETTEPDVCLSQEIQTNECLESNGGCWQDKTNNFTACKDTFRGRVCECPIARGVKFVGDGYTHCEASGVGRCQINNGGCWKETKNGKTVSACSNEESKGCKCPPGFKGDGIKSCEDIDECKDKLFCQCKDCSCENTWGSYECSCGGSNMLYMREHDTCISKVASSSVGWGFLWVIFFGLALAGIGAYAVYKYRLRSYMDSEIRAIMAQYMPLENQETPNQHRPVEHADI

SEQ ID NO: 16000 - protein, 779 aa, Zea mays
MGCTASKVEQEDTVRRCKERRRHMKDAVAARQLLASAHADYLRSLRVTAAALSRFAKGHPSLAVSHHTTPVLLSAAAPPPAPSAARALPTPAPSTAASSSLPPPTPLAQHPHPPPQPPAAMAAPQPAPARAPRPRRLRVPHILSDSSVASPARSSFRKQPPVGTPSSSSAWDWENFYPPSPPDSEFFDRRKAEVEHASRLRELEEEEKARAYLQHHTQYNLKEEDEAAEDDDGEVDHEPEGMHCGGWEDDEHYASTTTSETRSEDEGEMGDRSECGFAARSECGFVARSEYGGTAPSEYAAVPLPLRRDERSEAGDSSTVTAATEMRMVVRHRTLEEIVAAIEEYFVKAADSGNDVSELLEASRAQLDRNFRQLKKTVYHSNSVLSALSSTWTSKPPLAVRYKLDTNALEMESTEGKSHGSTLERLLAWEKKLYEEVKARESVKIEHEKKLSTLQSLEYRRRDSAKLDKTKASINRLQSLIVVTSQAATTTSSAIVRVRDNELAPQLVQLCFALLGMWRSMNHFHEIQNEIVQQVRGLVDNSMAESTSDLHRLATRDLEAAVAAWHSNFNRLIKYQRDYIRSLYGWLKLTLCQVDSSVPQEVHASMISRELTSFCDEWKQALDRLPDAVASEAIKSFVNVVHVIYTKQAEEMKIKKRAETYSKELEKKANSLRSIEKKYYQSYSMVGLGLPGSGRDGIESHAAYDARDPLAEKKTEIAQCRRKVEDEMTRHAKAVEVTRSMTLNNIQTGLPGIFQAIAGFSGTVVEALDVVCRRAGSVR

SEQ ID NO: 16001 - protein, 721 aa, Zea mays
MGSSPSKATGEDALVLCKDRMRHIRQAIDSRDALSAAHLSYTQSLRSVGTALRQYAESEISPESSLSISEVDKSPSHSSMASPSPSRAVESVASLGHRASPSITPPSTRIHCMKAAATTPLTFVIDQSTAEFVGRESPVSAFVPPPPPLPPELCTTWDFFDPIDAAGTSSSNNENEVTLNFSRLRDLRESRVAEVVPLKEVEEEIMSRRHTEISDDNTPPEQEREPKQGGTGKPSQLVDTSTKATSEQVAAKLEESEMEKELCAEAEDPSEFITHRAKDFVSSMKDIETRFMRAAEAGNEVSRMLETKKIRLDICAKIPGSPVKLPSARFVSALRVCCNRDVILNQETAQHVSKVVTWKRSVSSLSSSSKSALMTSIMKDDVDDSNSDFVEEFAMVSGSHSSTLDRLHAWERKLYDEIKASENVRKAYDEKCNLLRRQFARGLNAQVIDKTRAVVKDLHSRVSVVIQAVDAISKRIEKIRDEELQPQLVELIQGLIRMWKLMLECHHKQFITITLAYHVKDSTSARQGEHHHHRQAAMHLWNEMDSFSSSFRNWVTAHKSYVEALNAWLQKCVLQPPQDRRRRKRKVSFPPRQAVSPPIFILCGDWLARTEPLPADELCRSLKDVMQLLRGSFEHRDEQNRPRSGESQECGMLENSSEQEAAAKSGSCAASAEGLQSRLTAVLDRLTKFSEASLKCYEELKQNYEMACADYRRVGPNAQLA

SEQ ID NO: 16002 - protein, 441 aa, Brachypodium distachyon
MMETKPPSPGTASAAAAAHHHRRWAAPLLASVLLSSLLISASLFFSSSRALLLSFSPLPSAASAEPLFVEAKLRQQQQQMRPDGVARTQRAVPRIAYLVSGSAGDGVALRRTLRALYHPANRYVVHLDLEAPAAERAELAAALRADPVYSRFRNVRVVTRANLVTYRGPTMVANTLHAAAILLREGGDWDWFINLSASDYPLVSQDDLLYVLSTLPRELNFIEHTSDIGWKEYQRAKPVIVDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLNDFDGMVNSNAPFARKFGREDPVLDKIDQEILGRQPDGFVAGGWMDMLNTTVKGKHFTVERVQDLRPGPGADRLKNLVTGLLTQEGFDDKHCL

SEQ ID NO: 16003 - protein, 471 aa, Oryza sativa
MARWPWRWRVLLPLLLLHSSPVFAQEGQDNDPSTLFKRASEMMNLRKYDGSLGLLNAVLEVDPNHSEAYRQRASVLRHKCRYKEAEGDYSKYLELKPGSSSVEKELSQLLQAQNALESAYGQFESHDFSKVLEYINKIVLVFSPNCLKAKLLKAKALLALEDYSSVISETGFILKEDEDNLDALLLRGRAYYYLADHDVASRHYQKGLRLDPEHSELKKAYFGLKNLLKKTKSAEDNAAKGKLRVSAEDYKAALAMDPDHTSYNVHLYLGLCKVLVKLGRGKEAISSCTEALNIDGELVDALTQRGEAKLLTEDWEGAVQDLKEASQKSPQDMGIREALMRAEKQLKLSKRKDWYKILGISKTASAADIKRAYKKLALQWHPDKNVDNREEAENMFREIAAAYEVLGDEDKRVRYDRGEDLDEMNMGGGGGGFNPFGGGGQQYTFHYDGGFYGGGGFPGGGFPGGFQFNFG

SEQ ID NO: 16004 - protein, 326 aa, Hordeum vulgare
MATLQHQNQGAAAPMTTTGGGLRAMDLYEKLEKVGEGTYGKVYKAREKATGRIVALKKTRLPEDDEGVPPTALREVSLLRMLSQDPHVVRLLDLKQGQNKEGQTILYLVFEYMDTDLKKFIRGHRQNHQKIPAHTVKILMYQLCKGVAFCHGRGVLHRDLKPHNLLMDRKTMALKIADLGLSRAFTVPLKKYTHEILTLWYRAPEVLLGATHYSTPVDMWSVGCIFAELITTTALFPGDSEVQQLLHIFQLLGTPNEEVWPGVGKLPNWHEYPQWNVSKLSSVIPSLDAVGIDLLEKMLQYEPAKRISAKKAMEHPYFDDVDKALY

SEQ ID NO: 16005 - protein, 96 aa, Hordeum vulgare
MGMEEAAAGGAARQAKESLELAFQMSQILDTGLDRHTLSLLMALCDRGANPEALAALVRELSSAAPPTPATPTAPASNAAAAPTAPSLFPSGFRQL

SEQ ID NO: 16006 - protein, 246 aa, Zea mays
MDDGDGGLSFDFEGGLDSAPAAGGPVPSSTDPGAGGGDGPGMHGRGRGRGSYRQTVCRHWLRGLCMKGEACGFLHQFDKARMPVCRFFRDFGECREPDCAYKHSYDDVKECNMYKMGFCPNGPNCRYKHIKLPGPPPSVEEVLQKILQMRSFNRYSQNRNSNYNQQGERPQHPQGSALPNQNSAENATAAAPPAGGQQAQTLNQQPPQQQQKPNTNDQAQGVSNGHQATRIATPLPQGPSRCVWSF

SEQ ID NO: 16007 - protein, 716 aa, Sorghum bicolor
MATADRTRSFMKDVKRVIIKVGTAVVTRHDGRLALGRLGALCEQVKELNALGYEVIIVTSGAVGVGKQRLKYRKLVNSSFADLQKPQMELDGKACAAVGQSGLMALYDMLFTQLDVSSSQLLVTDSDFENPNFRERLRETVESLLDLKVVPIFNENDAISTRKAPYEDSSGIFWDNDSLAGLLAIELKADLLVLLSDVDGLYSGPPSEPQSKIIHTYIKEKHHNEITFGDKSRVGRGGMTAKVKAAFVASNSGTPVVITSGFASQSIVRVLQGEKIGTLFHKDASLWEPSKDVSAREMALGARESSRRLQNLSSDERKKILLDVADALEENVDLIRTENEIDVSAAQEAGYEPSLVARLTLKPGKIASLAKSIRTLAYMEDPINQIIKRTEVAEDLVLEKTSCPLGVLLIVFESRPDALVQIASLAIRSGNGLLLKGGKEAMRSNTILHKVITSAIPSNVGEKLIGLVTSRDEIADLLKLDDVIDLVIPRGSNKLVSQIKSSTKIPVLGHADGICHVYIDKSADMNMAKRIVLDAKIDYPAACNAMETLLVHKDLINAPGLDDLLLALKTEGVAIYGGPVAHELLCIPKADSLHHEYSSMACTIEFVDDVQSAIDHIHRYGSAHTDCIVTTDDKVAETFLRQVDSAAVFYNASTRFSDGARFGLGAEVGISTGRIHARGPVGVEGLLTTRWIMRGSGQVVNGDKDIAYTHKNLPLQ

SEQ ID NO: 16008 - protein, 619 aa, Sorghum bicolor
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYFQAEVQGQKITWLTPHALQQVLTDDVDFNVMLSFLEFYETLLGFVNFKLYHSINVNYPPILDPRLEALAAELYALCRYMSAGSRRMIGNSQSDEVMEDKDEKSKADGITEEEKDVKNKASSKADESELRLAQLQHQLPTNEPGALMNLVEESTADDADDDDTKECKGLFKNLKFYLSREVPRESLLFIIPAFGGTVSWEGEGAPFKEVDEDITHQIVDRPTQSHVFLSREYVQPQWVFDCVNARIILPTEGYLVGRVPPPHLSPFVDNDAEGYIPEYAETIKRLQAAARNEVLPLPGIGDEDLDNSLVAAMMDRTESNEAAEKKRKLEMLEKQYHDELKMEIDGVAFSSLSNKEANKSPDAKDDTQSDHEADAIKQEEKDDDDIGTALMSRKQQGLYKAMKMGKEKKKEKIELLKKRKKNADSSASSKKRH

SEQ ID NO: 16009 - protein, 462 aa, Glycine max
MEKLEAENVLVLPSEQPNNNRPKPKPKRFVKNQIPDSILNNPLLSAAISVLPSNYNFEVHKCVWRVLSTGAKRVALQFPEGLLMYSLPLSDIFTTFAGVTHCFVLADVTYGACCVDDLAASALGADLLIHYGHSCLVPIDATTIPCLYVFVDIKIDVPHFVDTLSLNLLAQTKTLVVAGTIQFASAIRAAKPQLEELGFRVLIPQSKPLSAGEVLGCTAPKVSSSKLLGGGGDIGECVLVFVADGRFHLEAFMIANPGIRAFRYDPYMGKLFLEEYDHLGMKRSRKNAIFKAREARSWGLVLGTLGRQGNPRILERLERMMRERGLDYTVVLMSEMSPTRIALFEDSLDAWIQIACPRLSIDWGEAFVKPVLTPFEAEVALGVIPGWWEKNEVCEEGEGCCNKSGSCCEDAKGGEDFGGDYPMDYYAQDGGEWNSSYVKKSTRPARRVSVSSVADTAISQQP

SEQ ID NO: 16010 - protein, 339 aa, Brassica juncea
MGSTFRDRTAEFRSLYQTLKKIGAIPSVHQPESDPTTSSKRSPPGSSRSEFNKKASQIGLRIHETSQKTARLAKLAKESSIFNDRTLEIQELTVLIRNDITGLNMALSDLQTLQNMEIADGSYSHDKVGHYTAVCDDLKTRLMGATKQFQDVLTARSENMKAHENRKQLFSAKNAGVDKQNNAKAVPEPPPWSSSSTPSGNLQQPLLPPVNSGASSGSQLRRRSAIENAPSQQMEMSMLQQTVPRQENYSQNRAVALHSVESTITELSGIFTHLATMVTQQGELAIRIDDNMDESLVNVEGARSALLQHLTRISSNRWLMIKIFAVIILFLIVFLFFVA

SEQ ID NO: 16011 - protein, 132 aa, Phaseolus vulgaris
MASAFRSVKVLPNSASMEEARQRVFNFFREACRSLPSVMEIYNIYDVTSVAHLRSTIASEIRKNIHVSDPKVIDMLLFKGMEELKNVVDHSKQRHHIIGQYVVGQHEQVPDSASKDPAISPFLKNFYSSNYF

SEQ ID NO: 16012 - protein, 404 aa, Glycine max
MACRSVLSSSPHITNSMAIKEGVLSFAPNPPLLLRLPKAVTFLSFSASTKPPTKSFQVRSVAGTTEAASGFDEMISGTKRKYYMLGGKGGVGKTSCAASLAVKFANNGHPTLVVSTDPAHSLSDSFAQDLTGGALVPVEGPDYPLFALEINPEKFREEFQNAAQKKGGTGVKDFMDGMGLGMIADQLGELKLGELLDSPPPGLDEAIAISKVIQFLESQEYSMFTRIVFDTAPTGHTLRLLSLPDFLDASIGKILKLRQKIASATSAIKSVFGQEETRQNAADKLEKLRERMIKVRELFRDTDSTEFVIVTIPTVMAVSESSRLSASLKKENVPVKRLIVNQILPPSTSDCKFCAMKRKDQMRALDIVQNDPELSSLSMIQAPLVDVEIRGVPALKFLGDIIWK

SEQ ID NO: 16013 - protein, 380 aa, Medicago truncatula
MDENDVSNEVVKGKKKGKHDKPKPWDDDPNIDHWKVEKFDPSWNESGMLEVSSFSTLFPQYREKYLQEAWPLVKSSLKEFGISAELNLVEGSMTVSTTRKTKDPYIIVKARDLIRLLSRSVPAPQAIKVLDDEMQCDIIKISGLVRNKERFVKRRQHLVGPNSSTLKALEILTGCYILVQGNTVSVMGSYKGLKQVRRIVEECMLNKMHPVYNIKILMMKKELEKDPALAQENWDRFLPKFNKKNVKQKKVNAKPKKPYTPFPPPQQPSKVDIQLETGEYFLSDKKKSAKKWQERQVQQAEKTAENKRKRDESFVPPKEPANLVGNSEDASNNVAEMAMSLKEKARKFGKRKSEENINAETYIMGSSDQPSKKKSKKQKS

SEQ ID NO: 16014 - protein, 750 aa, Medicago truncatula
MDPKNNVKNDDPPAESPTSVLEEEEVEVKSEEEVIADDGSSLVPKTMAEEEEKLLKVRVKEEEEKIEVAPNLNDSQFNKLDELLTQTKLYSEFLLEKMDDITMAAGEQEKPDEEESKPVAKKKGRGSKRKAASQCNTGKAKKAVEAMITRSKENVKTEDVDLTEEERTEKEQRELMPLLTGGKLKSYQLKGVKWLISLWQNGLNGILADQMGLGKTIQTIGFLSHLKSKGLDGPYMIIAPLSTLSNWMNEINRFTPTLPAVIYHGNKHQRDEIRRKHMPRTVGPKFPLVITSYEIAMNDAKKCLRSYSWKYLAVDEGHRLKNANCKLVRMLKYISVENKLLLTGTPLQNNLAELWSLLHFILPDIFSSLEEFESWFNLSGKCTTGATMEELEEKRRTQVVAKLHSILRPFLLRRMKSDVELMLPRKKEIIIYANMTEHQKNLQDHLINETLGKYLDKKRSIGRAPTSLNNLVIQLRKVCNHPDLLESVFDGSYFYPPVNEIIEKCGKFQLLDRLLERLFARNHKVLIFSQWTKVLDIMDYYFSEKGFEVCRIDGSVKLDDRKRQIQDFNDTTSNCRIFLLSTRAGGLGINLTAADTCILYDSDWNPQMDLQAMDRCHRIGQTKPVHVYRLATAQSVEGRMLKRAFSKLKLEHVVIEKGQFHQERTKPSIMDEMEEEDVLALLRDEETAEDKMIQKDISDEDLEKLLDRSDLVINSSTDDKAAVSTFSLKGPGWEVVMPTAAGGMLSTLNS

SEQ ID NO: 16015 - protein, 591 aa, Medicago truncatula
MISALDLYHVLTAVVPLYVAMILAYGSVKWWKIFTPDQCSGINRFVALFAVPLLSFHFISTNNPYTMNYRFIAADSLQKTIILTLLFIWSRTSSRGSLEWSITLFSLSTLPNTLVMGIPLLKGMYGDDSGTLMVQIVVLQCIIWYTLMLFLFEYRGARILIVEQFPDTAGSIISFKVDSDVLSLDGKEPLQTEAEVGEDGKLHVKVRKSTSSRSEIFSRRSHGVNSGVSLTPRPSNLTNAEIYSLQSSRNPTPRGSSFNHTDFYSMVNNGRNVSPRQSNFGSLGFDEESGVAKANGNGGNGYPAPHSAGIFSPVANKKKGHGGGAGDGGKDLHMFVWSSSASPVSEGGIHVFRGGGDYGNDQLNGVAHQKDYEEFGHDEFSFGNRTVANGVDKEGPVLSKLGSSSTTELHPKAGSQGEAKPTNMPPASVMTRLILIMVWRKLIRNPNTYSSLIGLTWSLVSFRWNVVMPAIVAKSIAILSDAGLGMAMFSLGLFMALQPRIIACGNTVASFAMAVRFLTGPAVMAFSSFVVGLRGVLLHIAIVQAALPQGIVPFVFAKEYNVHPDILSTGVIFGMLIALPITLVYYILLGL

SEQ ID NO: 16016 - protein, 1058 aa, Oryza sativa
MAAAIAAAADDSIVYKLSALLEEVRPSAAALRAASEAADAVAGLVKRIPTQQATHEAVAGFVRDLGLAGEKLAFTFRPPEVVRVAGSHAAGGAVARPDVSADLLVRLPKECFHEKDFLNHRYHAKRCLYLHVIEKSLRSSPLIQKISWSTFLDEARKPILHYFTVAAKEIAELPGFYVRIIPTASFLFNVSKMNLSTRNNVRAYTKDGINLPTPKYNCSILEDMFLEENVEFISSSVADWKALQEALVLLKVWARQRTSIYTHDCLNGYLISAILVFLTVDSAGSMINRSMTSRQIFRVVMKFLATSKMWTKGLVIQPTKKRTITKEDMVCFLKTFDVVICDVSGHVNLASRMTKSAFIELQDEAACALNCLDKCKDGGFEELFMTKVDLGAKFDSCLRINLKGNLKITTSSFCLDDLAWRKLEKDVQSLLQQGLTDRTKMIRVLWRSTPSEWNIMDGFSEFGSSPLLVGIMLSSLEKSFRLVDIGPNPENRDEAIKFRKFWGEKAELRRFKDGTIAESTVWESESWEKHTIIKKIADHVLTKHLSLQKEDLIHVVDQLDFCLLVGGQDPVSSSGALFEAFDSLAKKLRLLGDVPLKISTVQPLDPAFRHTSVFPPEPHPLAYEKRSSQRLPNFTATCMQSLEVMIQLEGSGNWPLDPIAMEKTKSAFLLKMGESLEDQGMFVTASEDEVNVLTSGYSFLLKIFHERGLLLQKRDGDGKAQNVPSEDKELFLRSQHSSMINGLHGRYQVYGPVVRLAKRWISAHLFSSFISEEAVELLVAYLFLKPYPFNVPSSRVAGFLRFLRLLSSFDWTFSPMIIDINNDFNLKDEKEINENFMLCRKSYEQNPHDIEPAMFLATSYDKASEAWTRHSPSKPVLKRMASYAKSSAELLTNLIIQGQSGQYTWECVFRTPLSNYDAVVLLHQEKLCRPHQVLFPAETPNGKLVICGKPCKDFHPYMPLNKGVVKSLHDSREKILVNFDPTTYFLRDLKSAFPKTFKLWYDSIGGDAIGLTWENSKKRGRDEADETMLDPASILKEVGNVGKGLVRGVYLLKAPKLQ

SEQ ID NO: 16017 - protein, 138 aa, Oryza sativa
MSSAGGGGGRGKSKGSKSVSRSSKAGLQFPVGRIARYLKAGKYAERVGAGAPVYLSAVLEYLAAEVLELAGNAARDNKKNRIVPRHIQLAVRNDEELSRLLGAVTIAAGGVLPNIHQTLLPKKGGKDKADIGSASQEF

SEQ ID NO: 16018 - protein, 469 aa, Oryza sativa
MASSSENVEAPRDEQRDPPPSPPNPSEEAGAGEEMEAEGEGEEEVKTLERAEELFERGSKAIEEGDFVDAVDCLSRALEIRVAHHGELAPECVSTYFKYGCALLYKAQDEADPLGNVPKSSSNKESMKSTTNKDDSGSSKTPGSNTEDAPSTDKADAEEGQNSTGKGQEEENGDSDKDDDEMVGDEDDSDLDQAWKMLDIARAIVEKSPDDTLEKAKIFSALAEVSMEREDIDNSLGDYFKALAILEKLFEPDHRRIIDLNFRICLVYELVSKISDAIPYCAKAISLCKSRIQSLKNDKDALLAGKDDNASAADGGSEKSAPEGEIEQLSGILSELEKKLEDLEQAMSTPSSVMDEIMKRIASKAGGEQNATDTMPAAASFNSSSQMAGSSNGFDSSTLSTAATTGSTGSTVTDLGVVGRGIKRANIKPISAEPPPKRAAADSLSVKGDSSNNSDVHTPAQEGDDSVSK

SEQ ID NO: 16019 - protein, 846 aa, Oryza sativa
MGKSSSKKKKDKVILPPQLPPEVDDDDVVVSDEDVEFFRGNEGHARALATLDRKSIDSYVTRVAHHDEDEVERLYEERERRRKAVEALRPKNHDDDDFEVDRVDALPVKTLQGELVYNNAKKARFDDSSNNVESKSEDKVGNSKQTIQKGERKEKSKSKKGDGKLQNVQAQTEASNGKLQSKVLEEVKEELSAEELFEKKKAQLAEIGMSMLEDPESHIRSLNDMLNICNDKDQKVVKLSLMSLLAVFRDIIPSYRIRQLTEKELTVEVSKDVKKMRYYEYTLLRSYKAYLQKLISLEKQPNFSALAVRCMCTLLDTAPHFNFRESILASVARNLSSPDDAVRKMCCETIRSLFVDEGKHRGEATVEAVRLIADHVKLNDCQLHPDSIEVFLSLRFDDDLGKDDTEEEKGKPKKNKRRQNQEVPKQLPVSDNKKAKQELISKAREEVDAELRSVSFTLDPKERRRIQKEALSALFETYFRILKHSMSISNSRGKVINVSPDGSHPLLAPCLEGLGKFSHLIDLDFMGELVACLKKLSGYTDHHSGTVHDNTLSVSERLQCCIVAFKVWRSNLEALNVDLQDFFVQLFNLILEYRPDRDRGEVLADALKTLLWEGKQQDMIRAAAFIKRLATFALSFGSAEAMAALITLKHLLQKNSKCRNMLENDSGGGSLSCLVAKYDPEAKDPYLSGALASVLWELSLLQKHYDSSVSSMASNILSMANLNPTQNPVPISNANPLEAYRDLSMERKLSKPANKLLPLNCRKKRRGKEFVALSPAALEGSDCVAGGDELKEKLKNHFAVLRGISENERLRAELNHTLSSINLYKEYKKQKKSRKSKAVKKKVSRA

SEQ ID NO: 16020 - protein, 1174 aa, Oryza sativa
MIKPRVNWSDHANAVQSSCIKDEFLSSSFLFSLPTQRPNQEADCTGMLPLRSAACRIQGLERLQAPSIEKAWRSLRNTQVARKNYLRPGLSGKVKDCDSDHAHTYGTSSSYNVNKMDSVSRNRNPTQESMHQTTESGTMEKNSSHLPAGTKSCTRTYLNNHVVQADTITTTNQSLARTGPELFKTAPFIDNMCDDAKLDAMDEDELLASIDVDRIVMEHYQATNTPRGSSKSPLEKCNFNGFDENNLPQELSIMCDHGSKLAFCPEAKSHLLEMKDNLLAISHELIDGQLSPQQSDDLHQKRALLKKQIELLGEYTARLTQDEERQQSHSMASTTAHQGHHPTSILSSSFVKDTNIFQSPIYTRNEPGESGLCFSSAPYSYMDGLSMPLPSVQRDYTPRAIDISYTEGSGDKQWSSTHFAWTKELEANNKRVFGNRSFRPNQREIINATMSGNDVFVLMPTGGGKSLTYQLPALICNGVTLVVSPLVSLIQDQIMHLLQANISAAYLSASMEWSEQQEILRELMSPTCTYKLLYVTPEKIAKSDALLRQLENLYSRGHLSRIVIDEAHCVSQWGHDFRPDYQHLGILKQKFPQTPVLALTATATASVKEDVVQVLGLANCIIFRQSFNRPNLRYFVWPKTKKCLEDIHNFIHANHNKECGIIYCLSRMDCEKVAAKLREYGHKASHYHGSMDPEDRANIQKQWSKDRINIICATVAFGMGINKPDVRFVIHHSLPKSIEGYHQECGRAGRDSQLSSCVLFYNYSDYIRLKHMVTQGFAEQGTSAPRGGSSQEQALETHKENLLRMVSYCENDVDCRRLLQLIHFGEMFNPSCCAKTCDNCLKELRWVEKDVTNIARQLVDLVMMTKQTYSTTHILEVYRGSVNQNVKKHRHDTLSLHGAGKHLAKGEAARILRHLVIEEILIEDVKKSENYGSVSSVLKTNHKKSGDLLSGKHNVVLKFPTPEKAPKMGVLDESSVPRINKTNQQSQVDGSLAAELYEALQCLRTQIMDENPQLLAYHIFKNETLKEISNRVPRTKEELVEINGIGKNKLNKYGDRVLATIEDFLARYPNATRKTSSGGSNEHSEAVKKRRGFSVTNTSTNCDDFEERTVQSKKRAAKTRTRQEISDAASIVQDVRYIDLELDGCEQVNEVPYSVQKPMASGRVLPAWQSARIA

SEQ ID NO: 16021 - protein, 327 aa, Glycine max
MATNIGIMDAAYFVGRSEILSWINSTLQLNLSKVEEACSGAVHCQLLDAAHPGIVPMHKVNFDAKSEYEMIQNYKVLQDVFNKLKITKHIEVSKLVKGRPLDNLEFMQWMKRYCDSVNSGLQHNYNPLERREVSKGGRETSKKSANSQASTKGSTAQRPQSSHNSRRNEVSNANPTNQAAKVARAAPSAGNPAYEEKITELKLSIDSLEKERDFYFAKLRDIEILCQTPEIEHSPIVAAIQKILYATDDNGTAVAEAQAMISVGRKEIEGLSPIAEVSEEKSSSETHKRKNIANIDFDVAGLATLSPRQRLSDVSDVHCSESPLMTC

SEQ ID NO: 16022 - protein, 997 aa, Glycine max
MSNPQDQKPWKAEYAKSGRSSCRTCKSPIASETLRLGKMVQSTKFDGLMPMWNHAACILKKANQIKLLEDVENLESLRWEDQQKIRKYIESGGGGGGGSSSGSAAKSDSKTVKDTKCGIEVSQNSRATCKDCGQKIIKGEVRISTKPGGQGAKGLAWHHAKCLMELSPSIDVYKLSGWNNLSSSDQSAVSDFAKKGGSDTKIETEEGKESTQQQTSKGGIKRGKDVDSERKSKVAKAKGDVSVGSAMLVKSGEACDLEKKMETQSKELWDLKDDLKKHVTTTELREMLEANGQDSSGSEIDLRDRCADGMMFGALGLCPICSGFLRYSGGMYRCHGYISEWSKCSYSTCEPNRIEGKWKIPEETNNQYLKKWFKSQKGKKPVRILPLPSPRKSAESQMIASQHHHSSNSENLRDLKVAICGLPNDSIAEWKRKIDGIGGVFHAKVNKDTNCLVVVGSLNDEAEMRKARRMKKPIVREDYLIDCIERKKRLPFDMYKVEMIGETSSMVTIKVKGRSAVHEASGLQDSGHILEEGKSIYNTTLNMSDLSTGTNSYYILQIIEEDKGSDCYVFRKWGRVGNDKIGGTKLEEMSKSDAICEFKRLFYEKTGNPWEAWEQKTIQKQPGRFFPLDIDYGVNKQVPKNKKNDADSKLPPPLIELMKMLFNVETYRAAMMEFEINMSEMPLGKLSKSNIQKGFEALTEIQNLLKISNPDPSVKESLLINASNRFFTMIPSIHPHIIRDEDDFKSKVKMLEALQDIEIASRLVGFDANNDDSIDDNYKKLHCDISPLPHDSEEFCLIEKFLQNTHAPTHTDWSLELEEVFSLEREGESDKFAPYRDKLGNRMLLWHGSRLTNFVGILNQGLRIAPPEAPATGYMFGKGVYFADLVSKSAQYCFTDKKNPVGLMLLSEVALGNVYELKKAKYMDKPPEGKHSTKGLGKKMPQESEYVKWRGNVTVPCGKPVPSNVKSSELMYNEYIVYNTAQVKMQFLLKVRFHHKR

SEQ ID NO: 16023 - protein, 460 aa, Glycine max
MSASRAPPAGAGASKPPDQIMHSMKRQLPFSSMKPPFVAAGDYHRFAPDQRHDAAEAIVVKTPQLKRKSEAADFEADSGDRMTPGFTEAANSPFQTPVSGKTGKGGKSFRLTKGNRLGTQTPGSNIGSPSGNNLTPAGPCRYDSSLGLLTKKFINLIKQAEDGILDLNKAADTLEVQKRRIYDITNVLEGIGLIEKKLKNRIQWKGLDVSRPGEADDSFPSLQAEVENLTMKERQLDEQIREMQERLRDLSEDENNDKLLFVTEEDIKNLPCFQNETLIAIKAPHGTTLEVPDPDEAVDYPQRRYRIVLRSTMGPIDLYLVSQFEEKFEEINGVDVAPKLPSSPDGTKHQSTVVPEDRGKDIEVQGQEAPGPSSDFTTSQDFVSGIMKIVPSDVASEADYWLLSDADVSITDMWRTEPGVEWNELEPLQEDYCMTRENTATPSHPSNVDEVSSAPKSTGG

SEQ ID NO: 16024 - protein, 594 aa, Glycine max
MDLGVVGLEGVVGSESGCVFGSSLASDPETKHKWYGSGVLKQERSAIASEDDEWGTYKVAKIDHDMSSAPKAMIFQQRNNSLLRSNNATLFSDGHHQSQMLSFSSPKSETLLVDTASSNATLPFSYHQLSSYSRNTGYSSGSISMHGALAGVRGPFTPSQWMELEHQALIYKYITANMPVPTHLLIPIRKALDSVGFCNFSTGLLRSNSLGWGGFHLGFSNSTDPEPGRCRRTDGKKWRCSRDAVVDQKYCERHMNRGRHRSRKPVEGQSGHALTTTTTTTNTLNASSNSTVVPGNNTFAHNKVHHPLPPNSSPANTINRMFMNNKENNSTSERMEDCSALPMLPPTLELKPKEKNNFMIHKHQDPYDESSRNNNEFGLVTSDSLLNPTQKRSFDSSSSQKDDSESQQQHSLRHFIDDSPKPPSHNHHRSSSIWPELDNIQSDRTQLSISIPISSSDFMSFTTSSPSNEKLTLSPLRLSRALDPIQMGLGVGSGASNEANPRQANWIPITWESSMGGPLGEVLNLSNNSNASDQCGKNNTSALNLMKDDDDDGWDNSPPLGSSPTGVLQKTAFGSLSNSSAGSSPRGAPENNKE

SEQ ID NO: 16025 - protein, 550 aa, Glycine max
MGKKGSGSSWLTAVKRAFRSPTKDSDKRSGRRREDCDQEEDEEKKREKRRWIFRKTHMSHEGVNNNSNHTTQQKVQHDVAASGGGSRTDQDQKHALAVAMATAEAAMATAQAAAEVARLSKPASHAREHFAAVVIQTAFRGYLARRALRALKGLVKLQALVRGHNVRKQAKMTLRCMQALVRVQARVLDQRIRSSLEGSRKSTFSDTASVWDSRYLQDISDRKSISREGSSIADDWDERHHSVEEVKAMLMQRKEAAAMKRDKTLSQAFSEQIWRNGRTSSIGNEDELEERPKWLDRWMATKPWENRGRASTDQRDPIKTVEIDTSQPYSYLGTNYRRSHPNYQYNPNHHQPQRHSIASPLHRSHQNGSSLHQSPATPSPAKSRPIQVRSASPRCVRDDRSYHTSQTPSLRSNYHYTGNLYQNGRIVSTGTSSGGATATLPNYMAATESAKARIRSQSAPRQRPSTPERDRVGSAKKRLSFPAPDPYGVGVSYGNYGHSLRSPSFKSVSGSHFGGLEQQSNYSSCYTESIGGGGGEVSPSSTGDLRRWLR

SEQ ID NO: 16026 - protein, 589 aa, Glycine max
MREQNVESFYAKLRESALSSSSSPVLIFPSTSDVDSLCALKIIFHILESDSIQYACYPVSSFHEIHKYTSSSSSNDEPLSVVLVNWGNHRDLSKTLNLAPNARVFVVDSHRPIHLRNLSDQNDAVLVLFTKDDENQSDLASDFNLATLANAAPTVDSDSQSDSESESDSDSDSGSERNGSRKRRKKNPEDDDEDPIKLYRKLKKGYYRLGTFHGKPSGCLMYELADKLRKNTNELLWLACISLTDQFLHDRLSDERYHDGVMELEQHINSSGNLDVVTLVTLKDGTKIRAPNLSRITYEDQPRLMLLQEWSLFDSMMCSSYIATKLKTWSENGMKKLKLLFGTMGFALGDCQQKFQHMNVEVKRNMKKEFERFLPEYGLTDFYYRSFIRTLKYSSKISAADVVYGVTALLESFVRSDGSCASKQFGVAYDALSLNNIDNLRTGMQHAIKIQRAILRQGSAAITKIGCIRSGRSFRWLKLEDSNDAMLLGYPQALTKFCLFIMDALREKGAKMKPLICVCVSQEPGKVLIVGVCGRPRLGGAQANAFGIAFRTAAEEIGTEFFHELFESSWIVLDASAVNSFMVRLTKKL

SEQ ID NO: 16027 - protein, 756 aa, Glycine max
MGTNLHQVLGSLCLNTHWNYAIFWKLKHRARMILTWEDAYYNNPDDFDSSENKHCQKTLEQIGCGKFSHSALGLAVAKMSYHAYSLGEGIVGQVAVTGKHRWICADNQVASSGLSFEFADGWQSQFSAGIRTIAVVAVVPLGVVQLGSLNKVIEDMGFVTHIRNLFLSTQNYSIQCPSQIQGSLKSSSQLDKSKENFSSDIMRTCFYDTQKSMKSETADVLMPLQCSGTGRNCTPPSACEKMSDNVAKQEGPELYNDESSILLQSISNMMNVDCQEFEEMKPLYGTKYEGGSSGCKDMRLESEKNVSSFLNDFVTDNASFNDVICPSEKVRVDSACFPSVFLDTVVCESDKLHYADINQKGAVNFAQPSEANSQQHIEKSKFHTEPCYKDIPDFQTEPCYKDASHILKFPAGCELHEALGPAFLKGGKCLDWPAQINQEMKSVEMSDEISTSQLTSESCPEHLLEAMLANFSHSNNDVNSELSFCKSKQSAIVSAKNHEASIHNVHTINSEGYSIDQLSLVREDKHHSLSSSSGICGVMSSKGISSTFHSSNSGQLERSSEPSKNSKKRARPGESCRPRPRDRQLIQDRIKELRELVPNGAKCSIDSLLERTIKHMLFLQSITKHADKLTDFSDTKSKLHHKEADILGSSSYEQGSSWAMEVGGHLKVHSILVENLSKNGQMLVEMLCEECNHFLEIAEAIRSLGLTILKGATKAHGEKMWICFVVEGQNKRNVHRLDILWPLVQILQSKSTVYSH

SEQ ID NO: 16028 - protein, 1123 aa, Glycine max
MAEQQSSRISVFFSASKPLLPRKRPSDSSPLHPHRIKSAGDVASVSVAKRVPLAEVPLNRLNAIGSVHGPSPDAIHSSFSARTVSVPAVGSADENLCRSLFETPRREPEGSKPKQLDCFSTTGLLDDDFDDSFLEQIDILCEQKSAEQQADRSSDEKLSSKSNVVGDVNLSSESGTVSEGIGNGHLLSSGIELDSREEEVDSSWRDLLNSTMPEEYLKYLKSLNDRQREAACTDISTPLMIVAGPGSGKTSTMVGRVLMLLNEGISPSNILAMTFTTAAASEMRERIGAIAGKATAKELTISTFHSFSLQLCRSHGEKLGRTSEFLIYGQGQQRNAIIEAIRLLEIGKSENKDGALLIGELSNSLNNPKQFKDKAKKWQKFVAQAKASGRTSAEYRKMGNEIGAAILKNYNNILKSCNALDYHDLISCSVKLLSDFPEVFKECQDSWKAIVIDEFQDTSAMQYKFLKMLASHHKITIVGDDDQSIYSFNGADISGFISFRNDFPNYKEIRLNKNYRSTRCIVEAASSLIQNNSKRCQLKNVLTDNSSGSKIVMKECHNEDAQCAFVVDKIIEISSNYSAANCCYGNIAILYRRQISGKAFQMAFRDRKIPFNIHGVAFYRKKVVRTIMAMLRTALPGCDDGSYSRVFKALMPLEKDKKKRIIDHINKISTIRRCSFLSAASDIFSAKISGTFKRSELTHGRKILMTLEMISKLIQREKSISAIISSVANMIPEKYLLEQRAVVDVDGGTLLNEDYDIRSVLQYLLDDVSEFLSTKLVEVKEEREISEDKGCIFVLKAFIDYLLEREKENFGARRKDNENSVTLTTIHQAKGLEWDVVFIVKANDSEIPLLHDFKGTVKDTAALLEEERRLLYVAMTRAREKLFILHVMMDSNWQMLQPSRFLKEIPRHLTEVQGEISFQELLIKQEALQKETAHCTTDLLIKEKQSEADVIPMPHEILDNHSSETSNELAQFAEANNRNDFLRRFSVENRSIVSHLFHQWAKKKAFQDPKRLLDKVSFVIDERLRQKRNKNKDLLNTLKSCLSCDEAFQYAQYVLRWEQIPADKRAHLMREKQEHFLKLKIENAMGSATPTDKQISYLKKLGCTAIPTSRLHASHLIEQFKSL

SEQ ID NO: 16029 - protein, 635 aa, Solanum lycopersicum
MAAKVAAAGMVHQSNALNFGGGSSKVTTTTLKRKTPSELRGEQLKKKNIVELVDESTVPNGGPMSGLFPGPKRCDVSKNPRYVDTRVDELFPARKSSIRLKLVSIKENGKENFQAENSDNTKNCSIPSAFPTENQQRSKCPKFSLASSVTGKDHATETCSTSERCSENTFRSVTELSLGSVDVHGLSTVDMDKALRGLATHEHLGAAAKIAESFETDGGIRSKNFCPEFHVPCKMTPLDLTMKTNIRVVSSSSINWFHRLINCGANNVVARSSVNCFTKLKMTSLSEVTSVSQAINPMSLHSWMYPQSPLPPSVISALTLSASVGGQLDFLSERQLAWQDSFRSLYYMLRKNVCSIFYVCTAQFVIMFTSSYSEENKYVCNAYISQSTRGLRSLLKEHDVSYSMPLCHSKLEELNTEELVELSEIEKQNLGQTRRRSAMCDVDNRPDSLLAFTGNKNVHSLYDFLLNYRYFLTSLTGVDVPELYSPIPFENAALTAPEVKCKEVRRIDQAAFQGMESNVTCEPNQQPSSGMCYSVEIKGRYLAPWVTSAICDAFSSNSTSFEASFITEPASVNLNASLGITGKHSDPQVSATEALDKDNLCFGIPNTKSCSQMNSGFLKGLKYNGGSYTAFLSPV

SEQ ID NO: 16030 - protein, 930 aa, Solanum lycopersicum
MGSVEEKNKPGSLVSGAHTLLEEMKLLKEMQDHTGGGRKLISSELWHACAGPLVTLPQVGSLVYYFPQGHSEQVAVSTNRTATSQIPNYPNLASQLLCQVHNVTLHADKETDEIYAQMSLQPVNSEKDVFPIPDFGLKPNKHPTEFFCKTLTASDTSTHGGFSVPRRAAEKLFPPLDYSMQPPTQELVVRDLHDNTWTFRHIYRGQPKRHLLTTGWSMFVGAKRLRAGDSVLFIRDEKSQLLLGVRRANRQQTSLPSSVLSADSMHIGVLAAAAHAAANRSTFTIFYNPRACPSEFVIPLAKYRKSIYNTQLSVGMRFGMMFETEESGKRRYMGTISGISDLDPLRWPSSKWRCLQVEWDEPGCGDKQNRVSPWEVETPESLFIFPSLTAGLKRPYQSTFLGAQTEWDSLMQHRPFMRVPENVYGDLQSSSISNLWSEQLMKMLIRPPPGLTGLQCGVPTVQDIKVALPQEARNVVQPAGNQKPELITVEATPAQSETNSEVVLNQPVGVVNSISSQQATLQAKSKPPEKVETDIIGKNSEPRKETSNSSVKLDQFQCNEDKVAIKPASPHDLPTDASVTASHHNSFSQLQASPWLIPHNPQIDSAASNNILQCPTNNEWNMSSLQSAAGLLKYPVSTSTLTKHDNSFMLPDTIGHGLAPIGQDLWDHQLNDVKCFSQTNLQVPLDITNMQFLPDSYGFKDLSEESHNQSDIYSCLNFDSNSGSTVIDNSVSSTVLDEFCNLKHTDFQNPSDFLLGNISSSQDVQSQITSASLADSQNFSVQEFADNSGGASSSNVNFDECNLLQNSSWQQVAPRVRTYTKIQKTGSVGRSIDVSGFKNYEELRSEIERMFGLEGLLNDTRGSSWKLVYVDFENDVLLVGDDPWEEFVGCVRCIRILSPTEVQQMGEEGMQLLNSAGLQGINGSTSEFPN

SEQ ID NO: 16031 - protein, 553 aa, Solanum lycopersicum
MALYLLYESASGYGLFLAHGIDEIGQNTEAVRNSIDDLNRFGKVVKIEAFNPFESALDALNQCNAVSEGQMTEELQNFLERSLPKVKEGKKAKFSLGLAEPKLGSHIHEVTKIPCQSNEFVLEILRGVRLHFEKFVKNLKPGDSEKAQLGLSHSYSRAKVKFNVNRVDNMVTQAIVLLDTLDKDINTFAMRVREWYSWHFPELVKIVNDNYLYAKVAKFVDDKSQLSEDKISALTEIVGDEDKAKEIVEAAKASMGQDLSPVDLINVKLFAQRVMDLVEYRKNLYDYLVAKMHDIAPNLAALIGEVVGARLISHAGSLTNLAKCPSSTLQILGAEKALFRALKTKGNTPKYGLIFHSSFIGRASARNKGRMARYLANKCSIASRLDCFLDKSTTTFGEKLREQVEERLDFYDKGVAPRKNLDVMKAAIETVEDKDTEMDVDEPSTKKSKKKKSKVDVVEYAQPMIEDKPLETNGDASEEPKSEKKKKKKEKRKSEEEAEHEEDQTVGNGNGVHEDGTAKKKKKKKNKEDNGEELQAAVEIKKKKKKSKVQDDE

SEQ ID NO: 16032 - protein, 1012 aa, Solanum lycopersicum
MSDIRKWFMKQHDKGTGNGSMSKNSAAEKPSPTSPKPENLVQEGQETANRRKTSKYFATDKVKAKEEKVEEVSAKRKAPNAAGISSAPAAKRIHKAEDEDDFVPVVSAMGSRDVTPSKKSVSGSGRGSAQKNVISDDSDDDLKNKKSDLKSAGRGRGGRAAKTSGKGVPLDESEDDASAVKDNKSGGRGRGGKGPSAAPSGGRGRGGGGRGGFMNFGERKDPPHKGEKEVPEGAPDCLAGLTFVISGTLDSLEREEAEDLIKRHGGRVTGSVSKKTTYLLCDEDVEGRKSSKAKELGTAFLTEDGLFELIRSSKKSKSATQPESKKSVDTIVSSGKRNSQKTSDGTGSTATKILAAKQLAPSASPAKISGSPAKSSASPAKKKTQAKESLLPWTEKYRPKAIVDIIGNKSLVEQIQRWLESWDEHFLKASSKGKGKKQADSGAKKAVLLSGMPGIGKTTSAKVVSQLLGFQTIEVNASDSRGKADSKIEKGIGGSTANSIKELVSNESLSANVGRSHHQKTVLIMDEVDGMSAGDRGGVADLIASIKISKIPIICICNDRYSQKLKSLVNYCLPIVFRKPTKQQMAKRLNQVANAEGIQVNEIALEELAERVGGDMRMALNQLQYMSLSKSVIQYDDIRRRLLSSSKDEDISPFKAVEKLFDFNSKNLKIDQRIDLSMSDPDLVPLLVQENYLNYKPSSAGKDDNDLKRMSLIAHAADSIANSDLINVQIRRYQQWQLSPAGCLSSCIIPASLLHGQRQTLEQGERNFNRFGGWLGKNSTMGKNYRILEELHVHLLASRESYLGRANLRLDYFSLLGKKLTDPLKVLPKDEAVENVVAFMDSYSISQEDFDNIVEISKFKGQPNLLDGVQPAVKAALTKAYNKGSKSRVIRTADLITLPGIKKAPKKRVAAMLEPLDEGVAEENDETLAEDEENSSDTEDIDVGKKLQSDLQSLSSRGIEVNMDLKGAGSSGSKKTSAGRGRGRGSSNSSATAESSGKRGGRGSGAAAKRKR

SEQ ID NO: 16033 - protein, 1007 aa, Solanum lycopersicum
MSNKEKGVNVQVLLRCRPFSNDELRSNAPQVVTCNEFQREVAVSQNIAGKHIDRIFTFDKVFGPSAQQRDLYDQAIIPIVNEVLEGFNCTIFAYGQTGTGKTYTMEGECKRSKSGPNGELPQGAGVIPRAVKQIFDTLESQNAEYSVKVTFLELYNEEITDLLAPEDLCKVALEDRQKKQLPLMEDGKGGVLVRGLEEEIVTSANEIFTLIERGSSKRRTAETLLNKQSSRSHSLFSITIHIKEATPEGEELIKCGKLNLVDLAGSENISRSGAREGRAREAGEINKSLLTLGRVINALVEHLGHIPYRDSKLTRLLRDSLGGRTKTCIIATVSPAVHCLEETLSTLDYAHRAKNIRNKPEVNQKMMKSTLIKDLYGEIERLKGEVYAAREKNGVYIPKERYYQEESERKAMSDQIEQMGVSIENQQKQLEELQSRHDCQVQQCSDLTCKLDATQKQLNQTSKLLAYTEEQLRQNLYTLKERDFIISEQKKAENALAHQACVLRADLEKSIQENASLFQKIAREDKLSTDNRSVVDNYQTELAKQLGSLSSTVATSVSRQNEHLHHVEKICHNFLASHEKAALDLTNKINSSKALYISHFEAMQNVVKLHKATSNAALEEISTLASSNSISTKEFLDAESVETNLIFDELQNTLSTHQGEMANFARELRQRFNDSTEHLTNISEIIQGFFDKLLEESKRLERHSTTADEIQTKSIAEFEKAYEEQSRSDAEKLIAEVTSLVSNHMRRQKELVGARLGDLRETVSGNKTFLDGHVSSMEGITTDTKRKWQDFYTQAEGETKENADFSAAKHCRMELLMQKCVSTSETTVKRWQSTHELAKDMCNQHVSTMHSVVRNLCDSNEQHVIEFDSTREAAEEAVKRNSEDIIKSIDGLSGEERGSISGILDTASAHSETLDELKKDHCTQSTSIEQKAIETFQQKFMDYEPTGTTPIRSEPDVPSKGTIESLRAMPMETLLEEFRENNSLESFQVKELKPSLIPRSPLSLINN

SEQ ID NO: 16034 - protein, 269 aa, Solanum lycopersicum
MGRLGVKTDYEELRNAQIMENKARLASLGLQKAVAELRSIRSKPQSEKRKHNKVDYFSTPLRRSSRLKGNSSESNSSGTTPLAKRKLGLFDDEDDEDDIEKRPANAPLLRVKDGLTLRLTPEALARRCTSKDRGTLYDPYLGICCHFCRQKKLCGEEDCKRCGDSDMDQPCIGKTDCSSCHSSQGVLCRGCLKVRYGEEMEDVRANKEWICPHCTEEKGINPYWICNSSLCLKKRKMAPTGIAIFRAREMGYKSVAHLLMDQLQGAVRG

SEQ ID NO: 16035 - protein, 187 aa, Phaseolus vulgaris
MLKQAIGRICRTSAYAFEGNRVLPWIRVASCFFHNGQTHMAPRSFFGVEDFLDDDNSRPYTYQKGKKSKNPHKHISFKQRTIAYMEPFTLDVFISKRFVSASLTHRMTSKQVAVAGTNSKDIKAVLRSRSDIPACISIGKILSERAREADVYTASYTPRERDKFEGKIRAVVQSLIDNGIDVKVYLD

SEQ ID NO: 16036 - protein, 1369 aa, Phaseolus vulgaris
MNQYHIYEAIGRGRYSTVYKGRKKKTIEYFAIKSVDKSQKTKVLEEVRILHTLDHINVLKFHDWYETSAHLWLVLEYCVGGDLLSILRQDSKLPEDSVHDLAYDLVKALQFLHSNGIIYCDLKPSNILLDENGCAKLCDFGLARKLKDISKSPSSSLPRAKRGTPSYMAPELFEDGGVHSYASDFWALGCVLYECYAGRPPFVGREFTQLVKSIISDPTPPLPGNPSRPFVNLINSLLVKNPAERIQWPELCGHAFWTTKLALVSLPSQPAFDDMIELHTKPCLSERNGDKSSHNRTPPKYREKDVKGVLKKDENSVLGSRGTETPTRATPNGPRTQIKGSSRTNEVKQKDHSNVKKGVNLLRLSRIAKTNLQRENEKENYRRPLPNNSENDSEVKIENTDMELDFNENTEDDTHEETDGNEQTTSVPDEKIDNHFLNQGQTEELENNTHQLDTPSAVNPPVSDDPRSFDHESTPDHPDISGISPSVSPQVKKHRAKEDTGSGLDSDSSRLSNNLSEVLWHPSDLSVRPVMPSRKVDKVSEVIPSLPFEALQASDFVKMPKEQLEAVHNRILTILNGNTSIGEKQNVIRYLEMLSINADAANILTNGPIMLMLVKLLRQSKASALRVQLASLIGLLIRHSTFVDDSLANSGILGALTDGLRDRQEKVRRFSMAALGELLFYISTQNADCRDNNQLESPSKDNRATYGWQVPNSLISLVSSMLRKGEDDITQLYALRTIENICSQGGFWVGRLTSQDVFSNLCYIYRAAGKQESMRLTAGSCLVRLVRFNPTSIQSVVEKLSFKDLASALVKGSPREQQISLNLLNIAMLGSHLFTNIGRYLVQLAEDKNLIPSLLSLVEQGSEVLRGKALVFVALLCKHGRRWLPHFFCSQKLLSVVDRLGKEKDSYVRQCLDAFVHIVASSIPGLLDIITGEVQQMMGGRRHGHISALTSRSSKANIHLFPVVLHLLGTSTFKHKVVTPQVVLQLANLIKLVETPFQGRDDFQITLLRIFESLTEESPIILGNADIFIREILPSLTVLYKGNKDGDARFLCLKILFDVMIILLSEPIDEEQRLKDLKFISNTRFLPLYPTLIEDEDPIPIYAQKLLVMLLEFSFIAIPDILHMKTISQCFEFLLGDLSNANVNNVKLCLALASAPDMESKLLSHLKVVRRIGNLLEFVHAKGMEDLLEPTLGLCRAFIARSVCTKGLSSTTEPTLLGDCPPELSGGAVDPQQCIKDIADFGSNFGVLLELSASAETSIADIASECVVLLFKASPREATTGILTNLPKVTVILESWNRGIPHLMVQRMLHSLGYACKQYLLHAMILSISKPEISRIEVVVSELKSSGVPALAKTAALAALELQRLPRCI

SEQ ID NO: 16037 - protein, 980 aa, Phaseolus vulgaris
MASATSFPGIALRPSVPFRSHISHTRFSQFQVSFGFPANPTSLKSLNSVPSKKREAFSNGSSRTRRDLSQFSVRCSVSSSGKITQQEFTEMAWQAIVSAPEVAKENKHQIVETEHLMKALLEQKNGLARRIFSKVGIDNTQLLEATDKHIKRQPKVLGESAGTMLGRDLEALVQRARDFKKEYGDSFVSVEHFVLGFSQDKRFGKILFRDFQISEQALKSAIESIRGRQSVIDQDPEGKYEALEKYGKDLTAMAKAGKLDPVIGRDAEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVFVDQPSVEDTISILRGLRERYELHHGVRISDSALVDAAILSDRYISGRFLPDKAIDLVDEAAAKLKMEITSKPTALDEINRSVLKLEMERLSLVNDTGKDSKDRLNRLETELSLLKEKQDEMTGQWEHEKSVMTRLQSIKEEIDRVNLEIQQAEREYDLNRAAELKYGSLNSLQRQLESVEKELHEYMNSGKSMLREEVTGNDIADIVSKWTGIPISKLQQSEREKLLYLEEELHKRVVGQDPAVKAVAEAIQRSRAGLSDPHRPIASFMFMGPTGVGKTELAKALASYLFNTEDALVRIDMSEYMEKHTVSRLIGAPPGYVGYEEGGQLTETVRRRPYAVILFDEIEKAHSDVFNVFLQILDDGRVTDSQGRTVSFTNTVIIMTSNVGSQYILNTDNDTVPKESAYETIKQRVMDAARSIFRPEFMNRVDEYIVFQPLDRDQISSIVRLQLERVQKRIADRKMKIQVTEAAIQLLGSLGYDPNYGARPVKRVIQQNVENELAKGILRGELKEEDTILVDTEVTAFSNGQLPQQKLVFRRVGTDSESSSTVKDSREGFPQIL

SEQ ID NO: 16038 - protein, 387 aa, Zea mays
MAAAEEMMAVLDKETLALMGLGNAAAAVVAECEKFKENARPLKRGRDVSKLNHALKAHADPAQRATLLEARKKLIEAIYEYQGEDPLQPWLDCIKWVQEYFPTGGECSGLVVLYEQCVRTLLDDERYKDDLRFLKVWLEYAGNCADAEVIYRFLEANQIGQGHAIYYMSYASLLESKNKLRKANEIFDLGIARKAKPLEKLEAVYRAFLRRSIKKREQEDDTVDDDLPKRSFGNNLKRDENRNQQAGNSHLGRPRALQRPLSVYKDESPLPNQGLDRVRSKENNTSWRVLGTRAERNKENNMMPAKWTSHKIPQKLGARGAVQSTRASCSIEVFVEEDCTQEPARPVPKSPNPSVLKLRQTTSKSLKKETELLKENPLRNFPLSRLR

SEQ ID NO: 16039 - protein, 88 aa, Trifolium pratense
  Sequence also found in Organisms: Lupinus angustifolius, Medicago truncatula, Trigonella foenum-graecum
MASTKVQRVMTQPINLIFRFLQSKARIQIWLFEQKDLRIEGRIIGFDEYMNLVLDDAEEVNVKKKSKKTLGRILLKGDNITLMMNTGK

SEQ ID NO: 16040 - protein, 121 aa, Medicago truncatula
MVKVHELRQKNKTDLLAQLKDLKAELSLLRVAKVTGGAPNKLSKIKVVRLSIAQVLTVISQKQKAALREVYKNKKYLPLDLRPKKTRAIRRRLTKHQSSLKTEREKKKETYFPMRKYAIKA

SEQ ID NO: 16041 - protein, 294 aa, Medicago truncatula
MALRPIDNALPTITQERPKKQPKIALSTQKPQHSSNDENQIPLEPTIDYISSDNLKPMSDPEAQIQSLIEDLDSKNWVKVCESLNDVRRFALFNSSLLLPILDKIVLVVVKAMKNPRSALCKTSIMAASDIFNAFGDKLFDPSISEAFDGLLLQLLLKSSQDKKFVCEEADRALGSMVESMTPLPLLQKLRLSVSHKNLRIRAKAAVSLSKCVSKMGIEEMEEFGMEKLIEVAADLVNDRLPEARDAARSIATSVYEAIIKDVEEEQKMEVWQSFCHSKLTLINALSILKIVKL

SEQ ID NO: 16042 - protein, 394 aa, Medicago truncatula
MSDDEREEKELDLTSPDVVTKYKTAAEIVNKALKLVISECKPKAKVVDICEKGDSFIREQTSNVYKNVKKKIERGVAFPTCISVNNTICHFSPLASDETVLDEGDIVKIDLACHIDGFIAAVAHTHVLQEGPVTGRAADVIAAANTAAEVALRLVRPGKKNKDVSDAIQKVAAAYDCKIVEGVLSHQLKQFVIDGNKVVLSISNPDTRVDDAEFEENEVYAIDIVTSTGEGKPKLLDEKQTTIYKRAVDKSYHLKMKASRFIFSEISQKFPIMPFSARALEEKRARLGLVECMNHELLQPYPVLHEKPGDFVAHIKFTVLLMPNGSDRVTSHPLQELQPTKTIDDPEIKAWLALGTKTKKKGGGKKKKGKKEDKADETAEAEPVDSTNEATSQE

SEQ ID NO: 16043 - protein, 221 aa, Medicago truncatula
MKILYLLVSILALASSIAFAYDPSPLQDFCVAIKDPKDGVFVNGKFCKDPALVKAKDFFKHVEAGNASNALGSQVTPVTVDQLFGLNTLGISLARVDFAPKGLNPPHIHPRGTEILIVLEGTLYVGFVTSNQDNNRLFTKVLNKGDVFVFPIGLIHFQLNVGYGNAVAIAGLSSQNPGVITVANALFKSNPLISDEVLTKAFQVDKSIIDYLQKQSWYDNN

SEQ ID NO: 16044 - protein, 675 aa, Oryza sativa
MASSLLRASPLSLLSRLKPLNPSPTASHLRRLLLLSTASSTSSASCSPSPLRTLAATDAATPPPEEEAAAPAAEAKRERLQPLQWPARDALCGELGAGDAGRRVRLCGWVALHRAHAGLTFLTLRDRSGTVQVTTLPEYPEVYAVVNKLRVESVVAVEGVVRSRPTEAINTDMKTGAIEVAADNIYVLNSVTRSLPFPITTADTVKEKFPEEIRLRFRVLDLRRPQMQSNLRLRHNVVKHIRRYLEDRHDFVEIETPVLSKSTPEGARDYLVPSRVQPGMFYALPQSPQLFKQMLMVSGFEKYYQIARCFRDEDLRADRQPEFTQLDMEIAFTSMEDMLKLNEELMRHIFQEVGDIKLPNPFPRLTYTEAMNRYGTDRPDLRFDWQLKDVSDAFLGSSFKIFADTLENGGVIKALCVPGGAKEFSNTDLKKGTVYTEASKAGAKGLPFLKVMDNGELEGIGPLVASLKPEKKEQLLKHLDAKSGDLILFALGEQSAANRILGRLRLFIAHKLEVIDTSAHSILWVTDFPMFEWNSDEQRYEALHHPFTAPNPEDMNDLPSARALAYDMIYNGVEIGGGSLRIYKSDVQQRIFEIIGISPEQAEEKFGYLLECFDMGAPPHGGIAYGLDRLVMLLAGENSIRDVIAFPKTTTAQCSLTKAPSPVDPQQLKDLGFRT

SEQ ID NO: 16045 - protein, 369 aa, Oryza sativa
MATVMQKIKDIEDEMARTQKNKATAHHLGLLKAKLAKLRRELLTPTSKGGGGGAGEGFDVTKSGDARVGLVGFPSVGKSTLLNKLTGTFSEVAAYEFTTLTCIPGVIMYKGAKIQLLDLPGIIEGAKDGKGRGRQVISTARTCNVILIVLDAIKPITHKRLIEKELEGFGIRLNKTPPNLTFRRKDKGGINFTSTVTNTNLDLETVKAICSEYRIHNADVSLRYDATADDLIDVIEGSRIYMPCIYVVNKIDQITLEELEILDKLPHYCPISAHLEWNLDGLLEMIWEYLDLVRIYTKPKGLNPDYEDPVIVSSKKKTVEDFCNRIHKDMVKQFKYALVWGSSVKHKPQRVGKEHELEDEDVVQIIKKV

SEQ ID NO: 16046 - protein, 940 aa, Oryza sativa
MVKAYLRYEPAISFGVVASPESNVAYDPSGRLLLAAALDRFAAWDLKRGLPSLSFATAAPSPSLAVSCLATFPSAASASASSIASGHADGSIRLWDTETGSCEATLHGHRSAASALVFGPSGAIIASGSKDCDIILWDVVAQAGLYRLRGHRDQVTGLVFLDSGKKLVSCSKDKLIRVWDLDTQHCLQIVGGHRSEIWSIDVDPSERFLVSGSADQELRVFTVRKSAEEGEDWSKWDMLKLFGEIPRQSKERVATVKFNKNGNLVACQVAGKTVDIYRVLDETEAARKAKRRMHRKKEKALAKSMAAEGNGTVIDPLSAQDLQNPTPVVTDIFKLLHVLRVNKKICSVAFSPNNPPKGCLATLSLSLNNNMLETYSVDNENVSNMYSIEMHGHRSDIRSLALNSEDNLLMSTSHNAVKIWNPSTGDCLRTIDSDYGLCSAFVPGNRYALVGTKSGTLEIIDINSGSSIEVIEAHAGSIRSIVLIPNEDGTAGAWGFVTGSADHDVKFWEYQLMQKSDNDSKQLSVTNVKTLKMNDDVLAVTISPTGNHIAVALLDGAVKVFTMDSLKFALTLYGHKLPVLCMDISSDGVLIVTGSADKNLKIWGMDFGDCHKSIFAHTDSVMDVKFVSKTHYMFSVGKDRTVKYWDADKFELLLTLEGHHAEVWCLAISSRGDFIVTGSHDRSIRRWDRTEEQLFIEEEQEKRLEETFEADLDSAMDHKYGQKDGAPDEGSVGVPGRKTKETVTAADAIIDALDTAEEEVKRLDQHQEGQNNGNGTTFQPNVIMQGQSPSDYVLNVVSNVRPNDLEQALLSLPFSDALKIMSYLKEWSMVPLKVELVCRVCLVLLQTHHSQLTTTPSARSILTELKGILYSRVKECKDAIGFNLAAMDHIKELLAMRSDAPFRDARAKLMEIRQEQSRRSDRSDGAEKRKKKKRRTSGES

SEQ ID NO: 16047 - protein, 891 aa, Oryza sativa
MASSQGLKKNYRCDRSLQQFYTGGPFAVGSSPGGGEGEVEGGEAEAEAFLACACGGEVRLVSAADASAIGEPIEGENEAVTALALSPDSRLLFTAGHSRLIRVWDLASRTCTRSWKGHDGPIRAMACHASGGLLATAGADKKVCVWDVDGGFCTHFFRGHAGVVTTVMFHKDPKRLLLFSGSEDATVRVWNLESKKCVAVLKEHFSAVTSLALSEDGQTLLSAGRDKIVNVWDVRKYNSKKTIPAFEMIEDVSFIGPGSNLLSCLGEPANIKRKTDGYFLTVGERGVVRIWCLESAQCIYEQQSSDVTVNTENEESRRGFTSAVMLSDDQGLLCATADQQFLFYCPTRTDGGDFQLNLYKRLVGYNDEILDLKFVGEDEQYLAVATNLEQVRVYDVASMSCSYVLSGHTEIVVCIDTCISSSGKTLVVTGSKDSTVRLWDMERRSCIGIGKGHLGAIGSVAFSKKSKNFFVSGSSDRTIKIWSWDDTLDDVGSEVPLKAKAVVAAHDKDINSLSVSPNDGLVCSGSEDRTACIWKLPNLVPSVVLKGHKRGIWSVEFSPVEQCVITSSGDRTVKIWAVADGSCLKTFEGHTSSVLRASFLSHGTQFVSCGSDGLVKLWTIKTNECIATFDKHDGKVWALAVGKKTEMLATGGTDAVLNLWHDCTMEDKQEDFRKKEEELLRGQELENAVSDYDYAKAIQLAFELRRPHRLLELFTQLCRESDLEDPIEKALIGLPKEGLRVLLEYIREWNTKPKLCHVAQFVLFRVLRSLPPTDILEIKGISELLEGLIPYSQRHFSRVDRLVRSTFLLDYTLTRMSVVDPDIDEGTTRDDANGSSVENCEIAQAKPDALVAEENLQKSVKKRKSSKSSKKGGKKVKIASTGGSKDVPIEA

SEQ ID NO: 16048 - protein, 544 aa, Oryza sativa
MEIGQHPASGYSKEHQKTYQEWFAFADSDGDGRITGPDAIKFFAMSKLPRADLKQVWAIADSKRQGYLGFSEFVTAMQLVSLAQAGDEITQDSLKRDDLGSLNPPTMDGLDALLVKSKHHAKRVDPDIDGFPQAQSPATSQWFSSKSSKKIPLNAVTSVIDGLKKLYIEKLKPLEVTYKFNDFVSPLLTNSDFDAKPMVMLLGQYSTGKTTFIKHLLRTSYPGAHIGPEPTTDRFVVVMSGPDERTIPGNTIAVQADMPFSGLTTFGTAFLSKFECSQMPHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVARVYIGSFNDKPVNESAVGPIGKELFEREQDDLLSDLKDIPKKACDRRINEFVKRARAAKIHAHIIGHLKKEMPAMMGKAKAQQRLIDNLENEFAKVQREQHLPAGDFPYVEHFRDVLGGYSIDKFEKIKPKMVQAVDDMLGYDIPELLKNFRNPYE

SEQ ID NO: 16049 - protein, 286 aa, Glycine max
MDVSELAKKLGLSDSKLVVRKAAELRRLCEVQFDSSVIGVGEVAKSIICLEIAAMRLSILFDRSSAARLSGMSERAYIRSYNSLHNGLGVKMKLDVRELAIQFGCVRIITLVRDGLKLYKDRFVSSLPASRRASADFTRPVFTAVAFYLCAKKHKLKVDKLKLIELCGTSESEFSSVSATMKDLCHDVFGVAKEKKDPKQVQSNRDLLDVLPSKRKAEDGGYSSDDGPELSSYKKAKKMEKRDFEKWKSSVLASNEQNKKAPCKRTRQTSLNFLNKASDNQELEAM

SEQ ID NO: 16050 - protein, 1551 aa, Glycine max
MGSASLLNPSQPGVKKNDKSKQKSVVSKTEEEVMFKDKQKKRSLSESSEQTAAMRKMPKRAAACKNLKEKSFLIYEKSCLIETEKDHIVEEESLAVRMTAGQDNGCPNRRITEFILHDETGKSQPLEVLEVDDLFITGLVLPLEASSGKKKEKGVKCEGFGRIESWDISGYEDGSPVIWLSTEVADYDCQKPAASYKKVYDLFLEKARACVEVYKKLAKSSGGDPDISLDELLAGMVRSMSGSKCFSGAASIKDFVISQGEFIYKQLVGLDMTSKANDRMFADIPALIALRDESKKQVHAQVMPSNGSLRIDSGVGDEENKNQMDSVASVNEEDEDAKLARLLQEEEYWQSMNQKKNSRSASASNKYYIKINEDEIANDYPLPVYYKTSLQETDEFIVFDNDYDIYDTQDLPRSMLHNWSLYNSDARLVSLELLPMKPCSDIDVAIFGSGIMTSDDGSGFHLDTEAGKSSSVGSGAQVADGMPIYLSAIKEWMIEFGSSMIFISIRTDLAWYRLGKPAKQYAPWYDTVLKTARLAISIITLLKEQSRVSRLSFGDVIRKVSEFDKKDGSYISSDPLTVERYVVVHGQIILQLFAEFPDDKIRKSAFVTGLTNKMEERHHTKWLVKKKKVVPRSEPNLNPRAAVGPVVSKRKAMQATTTRLINRIWGEYYSNHLPEDAKEGIASELKDEDEVEEQEENEDDDNEETILLEGTPKAHSASKQTKKFSAETEIRWEGEPEGKTSSGYPVYKQAIIRGEVISVGRSVLVEVDETDEFPDIYYVEYMFESKIGRKMFHGRMMQRGCQTVLGNAANEREVFLTNECRDLGLHDVNQTVVVNIQNRPWGHQHRKDNIIADRVDRAQAEERKKKGLPTEYYCKSLYWPERGAFFSLPLDTLGLGSGVCPSCKIQDAEKEKDVFKVNSSKSGFLLKGTEYSLNDYIYVSPFEFEEMIEQGTHKSGRNVGLKAYVVCQVLEIVVKKEIKEAEIKSTQVKIRRFFRPEDVSNEKAYCSDIQEVYYSDETHIISVESIEGKCQVRKKNDIPECSALGRMFQNVFFCELLYDPATGSLKKLPAHVKVKYSSGQTSDAAARKRKGKCIEGDDVLESPNEGKTLNEKRLATLDIFAGCGGLSEGLQQSGVSSTKWAIEYEEPAGDAFKANHPEALVFINNCNVILRAVMEKCGDTDDCISTSEAAELAAKLDEKEISSLPMPGQVDFINGGPPCQGFSGMNRFNQSSWSKVQCEMILAFLSFADYFRPRYFLLENVRNFVSFNKGQTFRLTLASLLEMGYQVRFGILEAGAYGVSQSRKRAFIWAASPEDVLPEWPEPMHVFSAPELKITLSENVQYAAVRSTANGAPLRSITVQDTIGDLPAVGNGASKGNMEYQNDPVSWFQKKIRGDMVVLTDHISKEMNELNLIRCQKIPKRPGADWRDLPEEKIKLSTGQVVDLIPWCLPNTAKRHNQWKGLFGRLDWQGNFPTSITDPQPMGKVGMCFHPDQDRILTVRECARSQGFPDSYQFAGNIIHKHRQIGNAVPPPLASALGRKLKEAVDSKSST

SEQ ID NO: 16051 - protein, 327 aa, Glycine max
MKPNKLKCITTFFILYLFNQNAHSELQVGYYSYSCSMAEFIVKDEVRKGVTNNPGIAAGLVRMHFHDCFIRGCDASVLLDSTPLNTAEKDSPANKPSLRGYEVIDNAKAKLEAVCPGIVSCADIVAFAARDSVEFARGLGYDVPAGRRDGRISLASDTRTELPPPTFNVNQLTQLFARKGLTQDEMVTLSGAHTIGRSHCSAFSSRLYNFSTTSSQDPSLDPSYAALLKRQCPQGSTNQNLVVPMDPSSPGIADVGYYVDILANRGLFTSDQTLLTNAETASQVKQNARDPYLWASQFADAMVKMGQIIVLKGNAGEIRTNCRVVNS

SEQ ID NO: 16052 - protein, 668 aa, Glycine max
MAETLSPNPAMGRKQRLRIQSPTSPFVLGSNNDQLERARARDARAAANRRKSLALNQPLQANSHPGLNKQQILDLFQNCIKLASENKINQKNTWELNLIDHLTDIIKAEEEHDAETNFQKASCTLEAGVKIYSLRVDSVHSEAYKVLGGMNRAGQEAEEDTTLDGVNIESRQEESRKETSKKLSPLSTLESSFEALNVKKFDAAFVVDPLYRQTTAKFDEGGAKGLLMNNLGVYGGCRVLFDSQEVPAKCMASQNQSDISDTIDLSFLKDCIDQMVLDMRVKDEISPSLRTIVNQFDESNRRPTDIQLQGPSSAEDLDNADNNENGFDREEYENCTAWSDDHDDQTVVADLDYNDADPSFSSYPQDNAEQFPSPETDMDDRFENVEGYLFLSLGFSSKQNAWAGPDHWKYRKSKVSEVHPTSEDGSTLKSRQPKSKRQTEVDLNFTDSLEKKVLDTFSPPKNPKLLLLPESRLPCNTKLPEDCHYQPEDLVKLFLLSNVKCLGRKANRFSDGSREQSNEYESFPSWDNGSVCGDDAGDYGGDLHSDMEDSNTLITQPRQVNKIEVQYDKTSKQVDVHALKITLWDHVQESVKLPLEGQKDTLSFKNILANFPSECNAAATISDISPHLCFICLLHLANEKGLSIQNSSNLDDLAIRLPQVADSIRGTV

SEQ ID NO: 16053 - protein, 424 aa, Glycine max
MEFLKIKKFRKSQKADGEKDLADKAVPEPEEPKLNTDCPDQCKSENADSAGEAEDDDDFITNEVKRRLKELRRNSFMVLIPEEDSCPEEGEEEEEEGETSSNEWRDVEAEGQQWWRGFDAVFEKYCERMLFFDRMGTQQLSEVGKGSQYTSTPSPRSASKKLVSPLRCLSLKKFEEPDDETEHLQQPEHDPYLDIETAYVGQICLTWEALHCQYSHMSQKISWQHDNPTCYNHSAQEFQQFQVLLQRFIENEPFEQGRRAEIYARTRNNLPKLLQIPNIRGSDHELTDDSETRVLAPDLIRIIESSILTFHLFMKRDKKKSSGATSQNQLATPLQQIQSTLEKKVAKLKELRRKKKSWKKNSWPQKHEDIHLLLGLIDVKILARVLRMTRMTREQLFWCEEKMKKLDLSNSRLERDPCPILFPC

SEQ ID NO: 16054 - protein, 962 aa, Glycine max
MTVKTPGTPASNIDRTPVSTPGGARAKEEKIVVTVRLRPLNRREQLAKDQVAWDCINDYTIVYKPPAHERASQPASFTFDKVFGPASVTEAVYEEGVKKIALSALTGINATVFAYGQTSSGKTYTMRGITEKAVNDIYEHIMNSPERDFTIKISGLEIYNENVRDLLNSESGRSLKLLDDPEKGTVVEKLVEETAKDDRHLRHLISICEAQRQVGETALNDNSSRSHQIIRLTIQSTLRENSDCVKSFVATLNFVDLAGSERAAQTHADGTRLKEGCHINLSLMTLTTVIRKLSVGKRSGHIPYRDSKLTRILQHSLGGNARTAIVCTLSPALSHVEQSRNTLLFATRAKEVTNNAHVNMVVSDKQLVKHLQKEVARLEAVLRTPDPSKEKDWKIQQMEMEIEELRRQRDLAQTQVDELRRKLQDDQKVSNPVESPHQPVKKCLSFTGALSSLKPELGCERVRSSILRQSMRQSSTAPFTLMHEIRKLEHLQEQLGEEANRALEVLQKEVACHRLGNQDAAETIAKLQAEIREMRAVRSITPKNVGVGSMVSINKSVSANLKEEITRLHSQGSTIANLEQQLENVQRSIDKLVMSLPNNFQHSPNEASPKNKKEHKRKKLLPLSSSNAANRQNFLRSPCSPLSATQQVLESDVENRAPENDDIVSTDTLPESEKETPSKSEEAGDVSSKENTPVYRRSSSVNMKKMQKMFQNAAEENVRSIRAYVTELKERVAKLQYQKQLLVCQVLELEANEANGHNIDNEEYSCEPEEPQISWQIAFKEQRQQILELWDLCYVSIIHRTQFYLLFKGDPADQIYMEVELRRLTWLQQHLAELGNASPAPHVGEEPTISLSSSIRALKREREFLAKRLTSRLSLEEREALYMKWDVPLDGKQRKMQFISKLWTDPHDQIHVQESAEIVAKLVSFRTGGNMSKEMFELNFVLPSDNRPWLMGWNHLTNLLNL

SEQ ID NO: 16055 - protein, 188 aa, Glycine max
MGMATITMGGNHNSSITPRHYNTHKVFLFCNYILLGAASSCIFLTLSLRLIPSLCGFFFILLQVFTIAGAVSGCAAVGTNRWYSAHMVATVLTAIFQGSVSVLVFTRTGDFLGQLKSYVREEDGAVILKLAGGLTILIFCLEWVVLTLAFFLKYYACVEGNSGAVVPVRSGKVQQDEDLKDWPWPFQV

SEQ ID NO: 16056 - protein, 427 aa, Glycine max
MGSELIFRGHEAQPVDDSYSPKPHKPWFTVTRPIHYMLREQRLVFVLVGVIIATLFFTLVPSSSSSSVPYESLPISYFERESKIPAYHHRVAAAVHSVGKVPLGIKRKGLRIVVTGGAGFVGSHLVDRLIARGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLIRLMEGEHVGPFNLGNPGEFTMLELAKVVQETIDPDARIEYRPNTEDDPHKRKPDISRAKDQLGWEPKVDLRKGLPLMVSDFRQRIFGDQKEKASVA

SEQ ID NO: 16057 - protein, 452 aa, Glycine max
MDHVIGGKFKLGRKIGSGSFGELYLGVNVQSGEEVAVKLESVKTKHPQLHYESKLYMLLQGGTGIPHLKWFGVEGDYNVMVIDLLGPSLEDLFNYCNRKLSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLRAGTKKQKYDKISEKKMLTPIEVLCKSYPLEFTSYFHYCRSLRFEDKPDYSYLKRLFRDLFIREGYQFDYVFDWTMLKYPQIGSSSRARPSGKPVINPGQSGERIERPSGAVEAFARRNGSGLVLHSELSRHKSSDDVPSSKDVQANSERPRSSSRNGSSSKKPVLSSSRPSSSGEPSESRSSRLVLSSGRLSTTQRLQPGFESKTSLSRASATRGGRDDTLRSFELLSLGSGKRK

SEQ ID NO: 16058 - protein, 781 aa, Glycine max
MPAGIMIPARNMPSMIGRNGTVGGFGLSSGLSLGHIENHKASESQRSVEMFQPNLMEAGQLHPLDMPQNTSESDVPRIREDDFDSATKSGSENLEGASGEDQDPRPNKKKRYHRHTQHQIQEMEAFFKECPHPDDKQRKELSRELGLEPLQVKFWFQNKRTQMKTQHERHENTQLRTENEKLRADNMRFREALGNASCPNCGGPTAIGEMSFDEHHLRLENARLREEIDRISAIAAKYVGKPVVSYPLVSPSSVPPRPLELGVSGGFGGQPGGIGGDMYGGAAGDLLRSISGPTEADKPIIIELAVAAMEELIGMAQMGEPLWLTTLDGTTVLNEDEYIRSFPRGIGPKPVGFKCEASRETAVVIMNHVNLVEILMDVNQWSTVFSGIVSRAMTLEVLSTGVAGNYNGALQVMTAEVQVPSPLVPTRESYFVRYCKQHGDGTWAVVDVSLDNLRPSPSARCRRRPSGCLIQEMPNGYSKVIWVEHVEVDDRGVHNLYKQLVSSGHAFGAKRWIANLDRQCERLASAMATNIPTVDVGVITNPDGRKSMLKLAERMVISFCAGVSASTAHTWTTLSGTGADDVRVMTRKSVDDPGRPPGIVLSAATSFWLPVSPKRVFEFLRDENSRSEWDILSNGGVVQEMAHIANGRDTGNCVSLLRVNSANSSQSNMLILQESCADSTGSFVIYAPVDIVAMNVVLNGGDPDYVALLPSGFAILPDGTTAHGGGIGDIGHGGSLLTVAFQILVDSVPTAKLSLGSVATVNNLIACTVERIKAALSGEVA

SEQ ID NO: 16059 - protein, 216 aa, Glycine max
MASSSSLSLDTAKDLSNSSGEVHVIVGPMFAGKTTALLCRIESELNAAKNVVLLKSSKDTRYAIDSVVTHDGIKFPCRALPDLLSFREKHGDDAYQKLDVIGIDEAQFFEDLYEFCCKAADEDGKTVIVAGLDGDYLRRSFGSVLHIIPLADSVTKLTARCELCGKRAFFTLRKTEQRETELIGGADLYMPVCRLHYLNSQVAERSVLESQNFKTD

SEQ ID NO: 16060 - protein, 292 aa, Glycine max
MTNTSNSLSFSLSRVSKMFSGSQFDATTAFSGGGFTSSQPSTLNDSSPAPSNSRETPGLVPVTVKQISEASQSGDEKSNFVINGVDLNNVTLVGMMFEKVERNTDVSFVLDDGTGRIKCRRWINEAFDTKEMEAVMNDMYVRVYGHLKSFQGVKQLVAFSVRPVTNFDEIPFHFIDCIHNHLRSKIKVEGITSANPSSGSSLETPVKSAPNRSQASNPVCAQHSVDGLKGIDKLVMDYLEQHSDRSDGRGIHVDELSRELKLPIEKIKLSLKTLADDGEIYSTIDDDHYKKA

SEQ ID NO: 16061 - protein, 331 aa, Glycine max
MSTTVQRTPRSSRQSLFFQDLASPVSARRGKFSSPSQAAAVSSLWRENFGSSDLPPPPVFTLEDRSDFSPESGILDYQISPETKSDTRTPIQTSNKEFSTPVKSKSEASTSYALRGVQQNQQGSPGLSWWSPTTAKSGGEQDERGRSSPVEGVVQPGALITLPPPLEVARPEVQRNSLPAGNLNEEEWVTVYGFSPGDTNMVLREFEKCGEILKHVPGPRDANWMHILYQNRSDAHKALNKNGMQINGVLIVGVKLLDPMQRQALNERLKNQGFMPLPLPSARNSEVSSLKAPSRPYYLQNGNSTARQTGGTIASPTKSLVSKIMDLMFGV

SEQ ID NO: 16062 - protein, 510 aa, Glycine max
MQATDIILLGLGLLFVRWWWRRWSTTGGGPKNLPPGPPGWPIVGNLFQVILQRRHFIYVIRDLRKKYGPIFSMQMGQRTLIIVSSAELIHEALIQRGPLFASRPRDSPIRLIFSMGKCAINSAEYGPLWRTLRKNFVTEMITPLRIKQCSWIRKWAMEAHMKRIQQEAREQGFVQVMSNCRLTICSILICICFGAKIEEKRIKSIESILKDVMLITLPKLPDFLPVFTPLFRRQVKEAKELRRRQVELLAPLIRSRKAFVEGNLLELGNHYDMASPVGAAYVDSLFNLEVPGRGRLGEEELVTLVSEIISAGTDTSATAVEWALLHLVMDQDIQERLYKEIVECVGKDGVVTESHVEKMPYLSAVVKETFRRHPPSHFVLSHAATEETELGGYTVPKEASVEFYTAWLTENPDMWEDPNEFRPERFMSGDGVEVDVTGTKGVRMMPFGVGRRICPAWTLGILHINLLLAKMVQAFHWLPNPNAPPDPTETFAFTVVMKNPLKPLIVPRSI

SEQ ID NO: 16063 - protein, 157 aa, Glycine max
MGSDSEAEKSVQKEKEKKKMLALAPIAKPLAGKKLCKRTLKLVRRAAEHKCLKRGVKEVVKSIRRGHKGLCVIAGNISPIDVITHVPILCEESDIPYIYVPSKEDLAGAGATKRPTCCVLVQTKPAKGEIEQGEQEKLKSDYDQVVAEVTELTTSLF

SEQ ID NO: 16064 - protein, 510 aa, Glycine max
MFFNQKIVLFKSFALMGTSNLLLFFSLMSLCAMAASKVVLIGNNITLSFDDIEANFAPAVKGSGKYGVLYLAEPLDACAELTNKVEQLPNASSPFALVVRGGCSFEEKVRIAQKAGFKAVIVYDNEEGGILVAMAGNSAGIRIHAVFVSKASGEILKKYAGLTNVEIWLIPTFENSAWSIMAISFISLLAMSAVLATCFFVRKHRIRRERPRASLVREFHGMSSRLVKAMPSLVFTSVLEDNCTSRTCAICLEDYCVGEKLRILPCCHKFHAACVDSWLTSWRTFCPVCKRDARTGLTDPPPSESTPLLSSTPASMASSVLSSARSSLASSSAIQIARTASMASSALPSARSSLASSSAIQIARTASMASSALHSARSSLASSSAIQISRAASQTPSVSRNHSIASTPYVQPSLRSSYHQSPSLSISRSSVDLRNASQRSLASHLNSPCSMGYPSLSSLNSRYMSPHIPSPSNASVSYMGSSSHQQHPLRYSESAASFSPFASTHSLPEC

SEQ ID NO: 16065 - protein, 535 aa, Glycine max
MGEIQESKALAKSKPSTEQDVTDELDLRMKKYLRGEGANLEGLKDKKLKGQLAVKEDLYGKSAKAAAKAEKWLMPSEGGYLEAEGLEKTWRIKQEAIAREVDISSSGKQYDIILPELGPYTLDFTSSGRYMAVSGRKGHLGIVDMINLSLIREFQVRETVRDVAFLHNELFFVAAQKKYPYIYNREGTELHCLKEHGPVLRLQFLENHFLLASINKFGQLRYQDVTMGSMVGNFRTGLGRTNVMQVNPFNGVVSLGHSGGTVTMWKPTSASPLVKMLCHHGPVSALAFHSNGHLMATAGKDKKIKLWDLRKFEVLQTLPGHATTLDFSQKGLLACGNGSLIQVLRDVSGTQNYSKYMTHSMVKGYQIGKLVFRPYEDVLGIGHSMGWSSILIPGAGEPNFDSWVANPFETSKQRREKEIRSLLDKLPPETIMLDPSKIGTVKPRREKPTKQEREAEIEADVEAAKGKKLKKKTKGRNKPGKRVQKKQEAVARVKRPYLEQKIQEEESISRKKQKTREGVELPKSLQRFVRKKASS

SEQ ID NO: 16066 - protein, 311 aa, Solanum lycopersicum
MNDLMTKSFTSYIDLKKAAMKDVEASPDLEMGMTQMDQNLTAFLEEAEKVKLEMNSIKEILRRLQDTNEESKSLHKPEALKSMRDRINSDIVAVLKKARAIRSQLEEMDRSNAINRRLSGCKEGTLVDRTRSAVTNGLRKKLKELMMDFQGLRQRMMTEYKETVGRRYFTVTGEHPDEEVIDKIISSGNGQGGEEFLSRAIQEHGRGKVLETVVEIQDRHDAAKEIEKSLLELHQIFLDMAVMVEAQGEKMDDIEHHVVNAAQYVNDGAKNLKTAKKYQKSSRRCMCIGAIILLILILVVIIPIATSFTKS

SEQ ID NO: 16067 - protein, 442 aa, Solanum lycopersicum
MEAINAVRLTPLSVLSDRKNEAKKIPSHPISFPFKNLCSVENLSRNVQGGLVLVSSVLNTGLAKALTYEETIEQSETIPGAEFDATAVVETVTTFASENPIIIAGGFAALALPIVLFQVLGKPPKSWGVESAKTAYAKLADDAGAQLLDIRATAELREVGTPDIRGLKKKPVTVVYKAEDKTGFLKKLSLKFKEPENTTLFILDKFDGNSELVAELVTENGFKAAYAIKDGAEGPRGWLNSSLPWILPKKTLGLDLSNLSDALDGVLGEGSDAVTVGLGVAAATGLGILAFSEVETILQLLGSAALVQLVSKKLLFAEDRKKTLQQVDEFLTTKVAPKELVDEIKQIGKALLPDSVSSNALPAPVEASPAAATSTVEETESVPKEDIAPPKVEAISPPTPEVSSVPNAEVKADALPESSRPLSPYPNYPDLKPPTSPMPSQP

SEQ ID NO: 16068 - protein, 168 aa, Solanum lycopersicum
MASPTLITPSTSTPKSLITPIRSKLITSVTTTTITLRRREFLSLSAGILSPSLLLPATSAFAATDEEYVKEASEVIQKVRSTLNMDKGDPNIADSVAELREASNYWVAKYRREKALLGRASFRDIYSALNAVSGHYVSFGPTTPIPAKRKVRILEEMDTAEKALKRGR

SEQ ID NO: 16069 - protein, 174 aa, Solanum lycopersicum
MAVFSRNVFVMAILFFSLLSFTEARDHLVGGKTNSWKIPSSESDSLNRWAEKTRFLVGDSLVWKYDGAKDSVLEVSKKDYVTCNTSSPIAMHNDGNTKIVLEHFGAYYFISGVKGSCEQGQKLVVVTLSKRRYADAPVPSPVEFDGPAIAPTSNGFSLKASLVVAFGVLVGFWV

SEQ ID NO: 16070 - protein, 420 aa, Solanum lycopersicum
MAMAFSPLTTSGCSSYCNLGLSWKSSSLFVELGFVSNGSKGVSAKPAKLNASKVFRACASSSNSDPLLVKAARRERVSRPPAWMMRQAGRYMAVYRKLAEKHPSFRERSETTDLIVEISLQPWEAFHPDGVIIFSDILTPLPAFGVQFDIEDVRGPVIQSPIRSEEGLKALHSIDLEKLQFVGDSLSILRKEVGEQAAILGFVGAPWTIATYIVEGGTTRTYTKIKDMCHTAPHVLRALLSHLSKAIAEYIVYQVESGAHCIQIFDSWGGQLPPHMWDCWSKPYIDEIVGIIKRKCPQTPLVLYINGNGGLLERMKTTGVDVIGLDWTVDMADGRRRLGTDIGIQGNVDPATLFCPLPALTDEIKRVVKSAGSSGHILNLGHGVLVGTPEEAVAHFFDVAKSFDFDKVEDHVSEADKVVA

SEQ ID NO: 16071 - protein, 664 aa, Solanum lycopersicum
MEGVDYLADERKKAGFDVDEMKIVWAGSRHDFELTDRISKLVANDPGFSKEGRTMLPRKELFKNTLRKAAYAWKRIIELRLSQEEATMLRRYVDEPAFTDLHWGMFIPAIKGQGTDKQQEKWLPLAYKMQIIGCYAQTELGHGSNVQGLETTATFDPQTDEFVIHSPTLTSSKWWPGGLGKVSTHAVVYARLITDGKDYGVNGFIVQLRSLEDHKPLPGVTVGDIGMKFGNGAYNSMDNGVLSFDHVRIPRDQMLMRVSQVTKEGKYVQSDIPRQLLYGTMVYVRQSIVADASLAMSRAVCIATRYSAVRRQFGSQNGGQETQVIDYKTQQNRLFPLLASAYAFRFVGEWLKWLYTDVTQRLAANDFSTLPEAHACTAGLKSLTTSATADGIEECRKLCGGHGYLCSSGLPELFAVYVPACTYEGDNVVLQLQVARFLMKTISQLGTGKKPVGTVSYMGRIEHLMQCRSDVKQAEDWLKPSAVLEAFEARSARMSIACAKNLSKFENQEEGFAELAADLVEAAVAHCQLIVVSKYIEKLQQNIPGKGVKQQLEVLCGIYSLFLLHKHQGDFLGTGYITSKQGSLANDQLRALYSQLRPNAVSLVDAFNYTDHYLGSILGRYDGNVYPKLYEAAWKDPLNKSDIADGFHEYIRPLLKQQLRTAKL

SEQ ID NO: 16072 - protein, 210 aa, Solanum lycopersicum
MAISVASLASSFASLSFSSQISQKPYAVSLAHSKQFSFSLASKISTLVVSASVAEAPETEELETRENLLKLVKSRLPGGFAAQPIFGTGRRKSASARVVLQEGSGKIIINYRDAKEYLQGNPLWIQYVKTPLATLGYEASYDIFVKVEGGGLSGQAQAISLGIARALLKVSESHRKPLREEGLLTRDARVVERKKVGLKKARKRPQFSKR

SEQ ID NO: 16073 - protein, 320 aa, Solanum lycopersicum
MESCIYHQLKSQPVWLLLLLSLGFLKVLCFSVIFLKWVYVNFLRPAKNLKKYGSWALVTGPTDGIGKGFAFELARKGLNLVLVGRNPDKLKDVSESIKAKYGQTQIKTVVVDFSGDLDEGVKKIKETIEGLDIGVLINNVGVSYPYARFFHEVDDKLLADLIKVNVEGTTKVTQAVLPGMIQRKRGAIVNIGSGAAIVIPSDPLYAVYAATKAYIDQFSRCLYVEYKKSGIDVQCQVPLYVATKMASIKRSSFFVPSTDGYARAALRWIGHEPRCTPYWPHSLLWGVLCSLPESMVDAWRLNFCIGIRRRGQLKDSRKKE

SEQ ID NO: 16074 - protein, 302 aa, Solanum lycopersicum
MKAAAAMVNTVTLSNSTFWHKPISRINQNFKIRASISTSGNMVAPAIIVGGGRVGRALQDLGNGDDVLVKRGEPVPIDFVGPILVCTRNDDLEAVLEATPKSRWSDLVFFQNGMLEPWFQSKGLGDADQVLAYFAVSKLGEPPTDGKTDTNPEGLTAAYGKWASAVAARLQNGGLSCKVLDKEPFQKQMLEKLIWICAFMLVGARHPGATVGAVEKEYRSEVSKLIAELAAAAAAEKGLVFEDAMEDRLCAYSRAVAHFPTAVKEFKWRNGWFYSLSEKAIAEGKPDPCPLHTAWLKELKIV

SEQ ID NO: 16075 - protein, 221 aa, Medicago truncatula
MKIIYFLVSILALASSLAFAYDPSPLQDFCVAIKDPKDGVFVNGKFCKDPALVKAEDFFKHVEAGNASNALGSQVTPVTVDQLFGLNTLGISLARVDFAPKGLNPPHIHPRGTEILIVLEGTLYVGFVTSNQDNNRLFTKVLNKGDVFVFPIGLIHFQLNVGYGNAVAIAGLSSQNPGVITVANALFKSDPLISDEVLTKAFQVDKSIIDYLQKQSWYDNN

SEQ ID NO: 16076 - protein, 500 aa, Sorghum bicolor
MAAAILAPKPPPSLPTSAFPSSFPSPSRLCLSPRHPLTRLLLRPIPCASSPSSSVLMPDPDPDLEPEPAHDRDRAQDEAPESRPRRIALFVEPSPFAYVSGYKNRFQNFIKYLREMGDEVIVVTTHEGVPQEFHGAKLIGSWSFPCPWYQKVPLSLALSPRIIGEVARFKPDIIHASSPGIMVFGALIIAKLLCVPLVMSYHTHVPIYIPRYTFSWLVKPMWLIIKFLHRAADLTLVPSVAIGRDLQAAHVTAANKIRLWNKGVDSESFHPRFRDMEMRSRLTNGKPEKPLIFYVGRLGVEKSLDFLKRVMDRLPGARIAFIGDGPFRAELEQMFSGMPAVFTGTLQGEELSQAYASGDVFVMPSESETLGFVVLEAMSSGIPVVGARAGGIPDIIPEDQEGKTSFLYTPGDVDDCVGKIGQLLSSEELREAMGRAARKEMEKFDWRAATRKIRNEQYSAAIWFWRKKRAQLLRPLQWALRLLRPTTSGAAIADAMAKQS

SEQ ID NO: 16077 - protein, 925 aa, Helianthus annuus
MVSSHLTPILYLTLLLVTFSCVCSKTSKPPVAPTKIGNGYRLVSLQESPDGGLVGHLQVNKQNKIYGPDIPHLQLYIKHETDDRLRVHITDAQNQRWEVPYNLLPRTQPPTPSQQPFTRTLKNPITVSESSGNELIFSYISNPFSFAVRRKSNGQTIFNSSSDGSNSLVFKDQYIEISTTLPKTASLYGLGENSQPHGIKLYPNDPYTLWTTDQSAINLNMDLYGSHPVYMDMRNVGGDPYAHGVLLLNSNGMDVFYRGDSLTYKVIGGVLDFYFFAGPTPLAVVDQYTQLIGRPAAMPYWSLGFHQCRWGYHNLSVVEDVVENYKKANIPLDVIWNDDDHMDGHKDFTLNPNAYPRDKLLDFLQRIHARGMKYIVIIDPGIGVNTSYGTYQRGLAKDVFIKYEGKPYLAQVWPGAVNFPDFLNPATVAWWGDEVRRFHELVPVDGLWIDMNEASNFCSGLCTLPEGKQCPTGTGPGWICCLDCKNITKTRWDDPPYKINASGTHVPIGYKTIATSAVHYNGVREYDAHSIYGFSHAIATHKALQGLEGKRPFILSRSTFVGSGHYTAHWTGDNQGTWNDIKYSIYTMLNFGIFGIPMVGSDICGFYPQPTEELCNRWIELGAFYPFSRDHANYYSPRQELYQWETVATSARNALGMRYKLLPYLYTLTYEAHTTGAPIARPLFFSFPTIQELYGLSTQFLLGESLMVSPVLDQGRTNVSAVFPPGTWYSLFDPSQAIVSKDTQTFTLDAPLHVINVHLYQNTILPMQRGGMISKEARMTPFTLIVTFPAGATDAKAKGKLFLDNDELPEMQLGNGQSTYVEFSASTSKEMVKVWSDVQESKFALDKGWVIEKICVLGLSGVGSAFSVEVEGNSDILDVSNVELAQTEHKFIYGAEDMKSVMVEVGGLDLPVGKKFTMSWKMGIS

SEQ ID NO: 16078 - protein, 1295 aa, Hordeum vulgare
MFSPAIRKPHLHRREKEEATPSPPPPAPVHSPSPGGFALSDRPATGTPAPWTSSSLLARISTSKQTDRAGDSGQIQPVHVAEFPQVVRNAQANLLQKNFAGKSMLVGGIDKETSLAWMICGNELFVWSYLAAVAKDCLALEIPSSLVGDKDGKPLSGNQWTVCIMRWHSSGPSTRNSGDMLHRRSSTGVILCNGRTQAIAYWPDIYDESSSKGPVLSLFGQTGTSASDAISGCYRFNSLIAASVPGAAHECIAVASEPTGALWLFQCSPLGIHRRKVHHDTLEDNGTDHSQKNNGGRSLVWLPSNESSEAAEWKFFLLTSHGIQCWGISLLHGINVKILGSQEIVGSDGELGIKKDIAGQKNIWLLDMQIDERGKEFNILVATFCKDRVSGSNYTQYSLLTMLYKSNQKFPSENNVVKCERFLEKKAPAQVIIPKARVEDEEVLFSMRLKTGGKPSGSVIILSGDGKATVAIYWRGSTRLYQFDLPWDAGKVFDASIIPSSEDRDEGAWVVLTEKAGIWAIPEKAVLVGGVEPPERSLSRKGSCNEAVAEEKRRSQAFSASIVPRRVSSEAWSAGDRQRPTLTGVAQQAVVDEEAEMLLNRLFHDFILSGAVHEALQKLRVAGAFEKEGEMNVFVRVSKSIVNTLSKHWTTTREAEFLASTIVSSLAEKRQKHEKFLQFLVLSKCHEELSSKQRAAMLSVMEHGEKLSGMIHLRELQNALSQQSSSTRLSPQSKTPTAGALWNLIQLVGEKARRNTVLLMDRDNAEVFYSRVSDIEDLFYCLSHQLRYIITGEEHPSVQMQRALELSNACVTLVQAALHYRAEYKDWYPSPEGLTTWNSQPVVRSGIWSLASSVMELLRESGSAGMPMKSNLWSQLEGLTDMLLEGYIGLLTAKFERGEDHGVLAQEYCERRDELLGSLYDLAKQIIEAKYQESREGNDNPNLKESIFREVTSPILATAKRHEGYQTLWQICYDISDTVLLRNLMHDSVGPHGGFSFYVFKQLINSRHYAKLLRLGEEFQEELANFLKDRSDLLWLHEICLNQFSAASETLHTCALLSSPGEDVDLTSTRKSMSFVERRRLLYLSKIAATAGKDVDYEVKVAQIDADIRILKLQEEIVQHDPEYAQGKHTSKLLRPSELIEMCMKRGRELSLKAFEVFAWTGSSFRSSNKGLLEACWTNAADQDDWVELSQASVSEGWSDEVIQESLQGMVLFNASRLCYSPDAVVFDGTFEEVLPVRKEDVHARGLEAKCFSVEEVLMQHDTFPDAGKLMMTAVVMGKELSYAAPADEPVDMDS

SEQ ID NO: 16079 - protein, 218 aa, Hordeum vulgare
MVKLTMIARITDGLPLAEGLDDGRDLKDADFYKQQAKLLFKNLSKGQHESSRLSIETGPYYFHYIIESRVCYLTMCDRSYPKKLAFQYLEDLKSEFERVNGSQIETAARPYAFIKFDTFIQKTRKLYLDTRTQRNLAKLNDELYEVHQIMTRNVQEVLGVGEKLDQVSQMSSRLTSDTRMYADKAKDLNRQALIRKYAPVAIVIGIVLMLFWVKNKIW

SEQ ID NO: 16080 - protein, 1508 aa, Hordeum vulgare
MAAATSTSCRIAGTEVPITSSDKLRWIDLTVPSLAPASPADPFVSVPPRAASGCHVVSSGRDSQRYLAWRIHEENQNVLEVIELCALKEFPSSGLRLVFQEALCPFAFMCESEGARRSESVYLLYVLTISGVALMCNLRSPFSYVSGSILSQNDIVGFNLQTHTQSAKVTAVKAKPGCLVIGRQDGSICCYSLGKLAPSSPGFSNELRDDAGIGRLWTLMSRTKALGPVQDIDTATVNERELLFVLHLDGSLRVWDISSHTKLVNYNVQLDDFEGQPFRLWVGEADDEQELISLAVLHQGTVVPACDHIGVYAFSFGAGERFLLSPEPSVSAVPLLEGKIVDLKISTEKLWILKEVGPMLYEIVQYNSDSEEMCSYVLQEDTISEQMFQSSESALDDLVWTADSVFSSMKEHSFSFISSMFLRRLLQPGVNHCSALRETLLEYKRFLSDSEFQSLTTSGLRKEILSIIEQEGSSQVASSTVYHWKKFSARYLHNWCWNNRPYGLLLDTNSEVFGLIRKGSFSLFRCLEGVEQLIYGSSDDLGNLIGPGMNLSNDTDGETLIEVLRCMGHINHLLGRSSAAIYYESLISSVISPDEVTSQILKILESGFSPQSSSPLITLLGADAYVERRQTAHKSQRKFSVEMLLSFHKLQSRSTSWSAVFDVIEKFMKCLDTKVTIQEYELIRLCNVNSALVVQATSQVARTMFEAAFDLFLFLSYLVGVGGQVSLLQSDVARIKLQLFPMIQDILGQWIVLHFVGISPTTPPTIEDFSYQLSSLQLGIADELSLHRKLGSSDFTLACLLDFPKSAEGDDLSPCFPSPAKVINLVRRFSSSIMCRNSADHVDSFLGSTINLSAVFIRHGQYEAAQNLLGILETYLNYARASQTDQDTDMTCLARLHLSGFCLLMLAHDEANIVLRESKVQEAIRCFFRAASGQEAPKALKKFSSETGFQISGECRSISLWRLHYYEWAMQIFEQNSMREGACQFALAALEQVDSIVDLDNGSEVEDLPETTAMIKGRLWANVFKYSLDLKNFRDAYCAIISNPDDDSKYVCLRRFIIVLCELGETKVICNGEIPFTGLVEKVEQELFWKAERSDLSSKPNLYKVLYSFEAYRNNWRKAAAYMYRYFVRLSREGDAGGSRQLTHVLQEKLHALSTAINSLQLVEPSCAWLDSVCEADDHISPSKKPRNLLMQNSAFGTDSEISTLQFCVDIEILEKEYTLTEALYMLSTVNPKSNFSESYSIEALTDILVNENFYDLAFTIVLKFWKESGMKRELERLFAAIAQQCCPNRVGNSGRNLPDTQQLLLLPSSEDDGWDGNSKTIAVAHQVQGSCQWETLELYLDKYKDLHPRLPVIVAETLLYTDPEIELPLWLVQMFKTTKGGNRMISWGMSGKEADPAALFRLYTNYGRHAEAANLLVEYLDSFASSRPMDVLHRKKMSAAWFPYTTVERFWCQLEEMQSAGHSADQCDRLKKLLHGALMNHLQQVVVDSEDVLSSVGGGQGVESQSS

SEQ ID NO: 16081 - protein, 269 aa, Setaria italica
MVADTESSDSLPGSSNAAAETPVHGSLDQRSQEKTPKKTHKAEREKLKRDQLNELFLELGSMLDLDRQNTGKATVLGDAARVLRDLVTQVESLRKEQSALLSEQQYVSSEKNELQEENATLKSQISELANDLCARMGSSSLSLSSPGMSHPVANATSPDLATHPMPHHMWGNIPNLSSVAMAHQTTTVSPVHSQHHSANDVEVYAPPPQELQLFPGTSSSPEHECSGIRSAATNSSSLTDSLPGQLCLSLTQSSQEESSSGVLGRRKER

SEQ ID NO: 16082 - protein, 503 aa, Setaria italica
MVAAVRAAPALADKPPGLAMLEVAAAAGEDRLSDAETASSTAAPNSSLSSASSAGSLPRCSSLSRLSFDCSPSAALAAAACSPPPAPTASRPHRSGDAAWAAIRAASTSSAAPLGPRDFKLLRRVGGGDIGTVYLCRLRSPAAAAGRESPCHLYAMKVVDRRVVARKKKLERAAAEKRILRALDHPFLPTLFADFDAAPHFSCVVMEFCPGGDLHSLRHRMPSRRFPLPSARFYAAEVLLALEYLHMMGIVYRDLKPENVLIRADGHIMLTDFDLSLESTSSPSLESAAGNDAAAAGDASTSASCFPDHLFRLKRRRRRAAARQTTTFVAEPVEARSCSFVGTHEYVAPEVARGGPHGAAVDWWAYGVFLYELLHGRTPFAGADNESTLRNIARRPLAFPPGSGSCGPADAAARDLIARLLDKDPAHRLGSRRGAADVKAHPFFKGLNFALLRASRPPVVPGSSPLHRSQSCHAAPPPPTTTPGSTLPRKKPMPTADARFDLF

SEQ ID NO: 16083 - protein, 276 aa, Zea mays
MLPYPNNPHHFGVSQELPHPNPTAGFPMPPPGAHLDQRYYVDHHFFPGHGHCFNSETLEAVLRPARAAPECDEALVVTAPQAGGRRNGSLPAAAAAGQGQGQGHARARKRPFRTDRHSKIRTAQGVRDRRMRLSLDVARDFFALQDRLGFDKASKTVDWLLTQSKPAIERLAAATEPSHQRSDDAAFSPPTSGVADVSAGNKSGGVAEKLGRSRSGGSASMEMERACGLDRLVSAAPVLREYYYGLSEMMSNDNGGDGDDDGEYEEDGDFLDGMQY

SEQ ID NO: 16084 - protein, 259 aa, Oryza sativa
MTGFGSPCGACKFLRRKCVRGCVFAPYFCHEQGAAHFAAIHKVFGASNVSKLLAHLPLADRPEAAVTISYEAQARLRDPIYGCVAHIFALQQQVMTLQAQLASLKAAAAQGIHHQDVGATTKGGYMSAAATAADDQLGYGGYNQWCGSNGGGAPAASQPGAYSSNGGAGHGHDSITALLAAGSDYMQHSLYHAFEHSEGAGAVDDGHAAAAAFEAAAESSSCGMAASFAADESVWRSSSSGYQDCEDLQSVAYAYLNRS

SEQ ID NO: 16085 - protein, 465 aa, Sorghum bicolor
MGVAGGGGRLRASSAKKQRQRTLNNIKITLLCGFITVLVLRGTAGFNLLISGGDLDGAAAAAADAKVVEDVERILAEIRSDSEADDVVFVVEDDGSSLPSSSPRRNETAASFGNFSASATVVKVREYSLGPKLTDWDAQRREWMSRHPEFPPLDPRRGGRPRVLLVSGSPPGPCDNPVGDHYLLKSTKNKIDYCRLHGIDVVHNMAHLDPELTGYWSKLPLVRRLMLAHPEVEWIWWMDSDAIFTDMAFELPLSRYDGANLVIHGYPDLLFEKRSWIALNAGIFLLRNCQWSLDLLDAWVPMGPRGPSRVEAGKLLTASLTGRPAFEADDQSALIHLLLMQKERWMDKVHVETEFYLHGFWTGLVDRYEEMMEEHHPGLGDDRWPFITHFVGCKTCGRYEDYPLDRCVGGMERAFNFADNQVLRLYGFRHRSLTTAKVRRVTDPATNPLMAKEAALKMDAKFSSN

SEQ ID NO: 16086 - protein, 467 aa, Glycine max
MAATRPVQCLLRRVCRGSRTIGVATEVNASSSSQKIIDKEYEHSAHNYHPLPIVFAQAKGTSVWDPEGNKYLDFLSGYSAVNQGHCHPKILKALQEQAERLTVSSRAFYNDRFPDFAEYVTNMFGYDMVLPMNTGAEGVETALKLARKWGYEKKRIPKDEAIIVSCCGCFHGRTLGVISLSCDNEATRGFGPLLPGNLKVDFGDAEALEQIFKEKGEHIAAFILEPVQGEAGVIFPPDGYLKAVRDLCSKYNVLMIADEIQTGLARTGKMLACEWEEVRPDVLILGKALGGGVIPVSAVLADKDVMLCIQPGQHGSTFGGNPMASAVAIASLEVIKNERLVERSAQMGEELTGQLLKIQQQYPDYVKEVRGRGLFIGVEFNSKKLFPVSGYELCKKLKYRGVLAKPTHDAIIRFTPPLCISVDEIQQGSKALADVLEIDLPKLQKTKPIDAAPVATSACDRCGRVLY

SEQ ID NO: 16087 - protein, 753 aa, Glycine max
MTRVVQMSVDGDSKELKELNQRLRDGKKIAGGEHGLCEEVKCNGIAEEVKVEQGGTVESSSVQQHIPQPQGAIICWERFLHIRSLKVLLVEIDDSTRHVVTALLRNCSYEVIEAANGLQAWKILEDLTNHIDLVLTEVAMPGLSGIGLLYKIMGHKTRKNIPVVMMSSHDSMGLVFKCLSKGAVDFLVKPIRKNELKNLWQHVWRRCHSSSGSGSESGTQTQKSIKSKSLEKSDNNSGSNDEDDNESIGLNNGDGSDNGSGTQSSWTKRAVEVDSHKPVSQWDQIAECPDSTCAQVVHSNAEMGGNKVVPLAAKDCAEQNEQLVKTAGSQHSNAPDVGPSKFSEQINRGQLDLNCENQSSKLRCKGLSLSDAITSTCDSQMHSGEFEALNKKPKSSDIENKGTNNDEELPSLELSLKRLRGVEDADITIQDDRNVLRRSDQSAFSRYNAASNTKKSPTGCVGSNSPYNNSLEVTKKDSSRDIQSHSCGNPPNQNSNGASNNIDMGSTTNNAYAKSAVMSEPAGASTTKCLYQTSAFQPVKNSLVCTSQQVVLNNTEDMSATILAPPKLDRHKDSAALDFHLHCENHNCIADNMKHQLPPDHDAESIKKMATAAPHCGSSNVEEVLVEGNVGNHSINRSVSGSNNGSNGQNGSSTAVNAGGTNTESNNGLTGNSGSGDASGSGSANRVDQNKTSQREVALTKFRQKRKERRERCFHKKVRYQSRKRLAEQRPRFRGQFVRQTSNENASEATTDS

SEQ ID NO: 16088 - protein, 291 aa, Glycine max
MEKASPCHTNTPLPLPNRPSNFLQFKHQTFFFKFPNLNPNPNPNPNPNLLRLRRLNCSVSDGTVPSSVGATDSSSLAVKKKAAEVSSELKGTSIFLVGLKSSFKTSLGKLLADALRYYYFDSDNLVEEAVGGALAAKSFRESDEKGFYECETEVLKQLSSMGRLVVCAGNGAVTSSTNLALLRHGISLWIDVPLDFVARDVIEDQSQFAPSEISISGSYPEVQDELGALYDRYRVGYATADAIISVQKVASRLGCDNLDEITREDMALEALGEIEKLTRVKKMLEEAARPF

SEQ ID NO: 16089 - protein, 232 aa, Sorghum bicolor
MDPYHYQTMYDPRGFPIIHPQPPYLHHPVAVAGALSDSRVRGGGGGGGVRRRPGAKLSTDPQSVAARERRHRISDRFRVLRSLVPGGSKMDTVSMLEQAIHYVKFLKAQISLHQAALMQHEEGCHAELAAAYSAAAAAVAGDDEVTLASHGRTGACDEVMQLQLQVPGEEALSYGVVAAHQPYGLDPRHQLSGGHELPPLPASCIFVEEPADACYSVCDLDDGETGLPAGSY

SEQ ID NO: 16090 - protein, 457 aa, Hordeum vulgare
MEIFYYLVFGGLSAVVAGLELGKSGKDRVATTTAFNAFKNNYVLVYSLMMSGDWLQGPYVYYLYSQYGFDKGDIGRLFIAGFGSSMLFGTIVGSLADRQGRKRACITYCVTYILSCITKHSPQYRVLLLGRILGGVATSLLFSAFESWLVAEHNKRGYDPQWLSITFSKAIFLGNGLIAIIAGLFANLLADNLGFGPVAPFDAAACFLAIGMAIIMSSWSENYGDQSEGKDLMSQFKVAAKAIASDEKIALLGAIQSLFEGSMYTFVFLWTPALSPNDEDIPHGFIFATFMLSSMLGSSIASRLLARKMKVEGYMQIVFAVSAFTLFLPVATSLLVPASSVKGSGISFGGSLQLLGFCTFESCVGIFWPSIMKMRSQYIPEEARSTIMNFFRIPLNLFVCVVLYNVNAFPITVMFGMCSIFLFMAAILQRRLMVVADLHKLSTKSQEMTGEDEPLNP

SEQ ID NO: 16091 - protein, 740 aa, Phaseolus vulgaris
MASSSSLHLSQALLARAVYLHGSSSDRVSLSFPSFSGLKSHSPCKAATFSAGSRRRGASTSVVRATAVETLDQTTEVSLVEKSVNTIRFLSIDAVEKANSGHPGLPMGCAPMGHILYDEIMRYNPKNPTWFNRDRFILSAGHGCMLQYALLHLAGYDSVQEEDLKNFRQWESRTPGHPENFETLGVEVTTGPLGQGIANAVGLALAEKHLAARFNKPDNEIVDHYTYVILGDGCQMEGISNEASSLAGHWGLGKLIAFYDDNHISIDGDTEIAFTENVDQRFEALGWHVIWVKNGNTGYDEIRAAIKEAKAVKDKPTLIKVTTTIGYGSPNKANSYSVHGSALGSKEVDATRKNLGWPYEPFHVPEDVKKHWSRHVPEGSKLEAEWNAKFAEYEKKYSEEAAELKAIFTGELPAGWEKALPTYTPESPADATRNLSQQNLNALVKVLPGLLGGSADLASSNMTLLKSYGDFQKGTPEERNVRFGVREHGMGAICNGIALHSPGFIPYCATFFVFTDYMRAAIRISALSESGVIYVMTHDSIGLGEDGPTHQPIEHLASFRAMPNILMLRPADGNETAGSYKVAVLNRKRPSILALSRQKLAQLPGTSIEGVEKGGYTISDNSSGNKPDVILIGTGSELEIAAAAADDLRKEGKAVRVVSFVSWELFDEQSDEYKESVLPASVTARVSIEAGSTFGWGKIVGSKGKAIGIDRFGASAPAGKIYKEFGLTKEAIIAAAKELS

SEQ ID NO: 16092 - protein, 425 aa, Setaria italica
MANALLLLLFLFLSRASAAEYGEELLRRAGEEREWMVGVRRRIHAHPELAFREHRTSALVREELERLGISSRAVAGTGVVADVGSGALPIVALRADMDALPLQELVEWEHKSKVDGVMHACGHDVHTAMLLGAAKLLSQRKDQLKGTVRLLFQPAEEGGAGASHMIKEGALDGVEAIFAMHVDYRIPTGVIAAHPGPTQAAVCFYEAKIEGKTGMAETPHLNVDPIVAASFAILSLQQLISREDDPLHSQVVSVTYVKAGKALDATPAIVEFGGTLRSITTEGLYRLQKRVKEVVEGQAVVHRCKGTVDMKGEEYPMYPAVVNDWKLHHHVEDVGRRLLGPDKVNPGEKIMAGEDFAFYQQLAPGVMFGIGIRNEKVGSVHSAHNPHFFVDEDVIPIGAALHTAIAELYLSEAYALNGGGDLRSH

SEQ ID NO: 16093 - protein, 631 aa, Setaria italica
MGPLEPRYRPSGAPEDATKRRTSKSKSFKDVESFEVLVLEKNCGCKFKSLKILIIAIISATVLTLITPTLYEHQLQSASRYVDVGWMWDKTNSDPRYASSVDVQWEDVYRALRNLKSGNQDLKVGLLNFNSTEYGSWTQLFPDSHVSTIRLEHAKDSITWRTLYPEWIDEEEETEIPSCPSLPEPNVRRGVRFDVIAVKLPCTRVAGWSRDVARLHLQLSAAKLAVASSKRNHKVHVLFVSDCFPIPNLFPCKNLVRHEGNAWLYSPDSKALREKLRLPVGSCELAVPLKAKSRLFSVDRRREAYATILHSASEYVCGAISAAQSIRQAGSTRDLVILVDETISDHHRRGLEAAGWKVRIIQRIRNPKATRDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDDEEMKAKKTQLFGADPPMLYVLHYLGLKPWLCFRDYDCNWNNAAMREFASDVAHARWWKVHDKMPRKLQSYCLLRTRQKAGLEWDRRQAEKANSEDGHWRRNITDPRLKTCFEKFCFWESMLWHWGESNNRTKSSPATVTTPSLASS

SEQ ID NO: 16094 - protein, 821 aa, Oryza sativa
MAAGTASPPPDAEPPECPVCLSPFDAASAAPRVLPCGHSLCGPCIASLPPASASASASAASLRCPLCSQCVPFSRALGPSSLPKNLALISLLPSPPNPSRSRTAAAAPPPPHVPLHADHSRLLSRFRHAVLPESASPLHSPAPAAGLAIGSFASDLGAPWFCPRGHPVSLLPIETPAAAAKQESPLYYRPSHAARVAAAIDALSAAARDEVIDLVAVSSRLARRVCRVYGFWMGPEAAPLWLLSERHSRGVSCLLEERSRREETVALIRNVGMEVCEAFMGLHGEGLVLGCIGLGCFCLDRFGHCLLDLNQVLALCHGVRVGVCSSKSKAFMAPEVAEVVHDKLQIKDHDFSGLLGPSSDAWLLGCLLVALVTGDEQLAAGWSTEGSYDDWKNEVLTKVDASLVGTHMEPWSATIVSCLNYDPEGRPEIADVWKCINGSLMNSDIEALIPNVDLAARKSFMCLLLGELSSMCSNLGAVESDDTMHLSQDLDDKHSTPDDASSGGIINNEEVGAAGMDGPKCGLYNSSTLLAHRDCITGLAIGGGFLFSSSYDKTINVWSLQDFSHKQSLKGHEHKITAIVVVDNDNQSLCISGDSGSGIFVWCVDPSLSNEPLNKWYESNDWIYRGVHCLAVSGTGYLYTGSRDKSIKAWSLEDYSLRCTMTGHKSTVSCLAVACGILYSGSWDGSIRSWWLTDHSPLSVLEDGTPGSITPVLSISTELDFVVASYENGCLKIWKDDVLVKSEKLQNGAIYAAKLNDKWLYAGGWDKVVNIQELLEDDSEVEIRDVATFTCDSIITSILYWDGRLIVGLSNREIKVFYKAS

SEQ ID NO: 16095 - protein, 277 aa, Glycine max
MANGPAPFSEIGKRAKDLLYKDYNFDHKFSLSIPNSTGLGLIATGLKKDQIFVGDISTLYKSGNTTVDVKVDTYSNISTKVTVNDILHGTKAALSFNIPDHKSGKLDVQYLHPHAAVDSSIGLNPSPLLELSAAIGSKDVCLGAEVGFNTTSASFTKYNAGVAFNKPDFSAALLLADKGQTLKASYINYVDRPDGFTVAAEISHSFSTFENRFTIGSSQSIDSKTVVKTRFSDDGKAAFQCQRAWRPNSLITLSAEYDSTKIFGSSTKFGLALALKP

SEQ ID NO: 16096 - protein, 262 aa, Hordeum vulgare
MAQPAELSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALAELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 16097 - protein, 479 aa, Populus trichocarpa
MGLGSEEGKVKSSWDVCKSKERKKKKKDGTEAGCWVKLRFIGSCISSRSKVDSSVSGTSTHFESKSTNDTSIDQPAALVVSTSTTSNTESNSSTSKLEEELKVASRLRKFTFNDLKFATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLAFLHEETERPVIYRDFKTSNILLDADYNAKLSDFGLAKDGPEGDKTHVSTRVMGTYGYAAPEYVMTGHLTSRSDVYSFGVVLLEMITGRRSMDKNRPNGEHNLVEWARPHLGERRRFYRLIDPRLEGHFSIKGAQKAAQLAAHCLSRDPKARPLMSEVVNALKPLPNLKDMASTSYYFQTMQAERVGSSPNARNGVRSQAGLLSRNGHQQRSLSIPHGSHASPYHYQYPHKSPKPNGKP

SEQ ID NO: 16098 - protein, 612 aa, Oryza sativa
MSESNVDGIEISASNDERRDRGDAEISEDEPRQTRIRSLKKKALHASTRLTHSLKKRGKRKVGCRVPKITIEDVRDAEEEQAVSSFREVLFARDMLPERHDDYHTMLRFLKARKFDVEKAAHMWADMLHWRKDFGTDTILEDFEFHELEEVLQYYPHGYHGVDKEGRPVYIELLGKVEPSKLVQITTVERYIKYHVQEFERAFREKFPACSIAAKKHIDTTTTILDVHGVGWKNFSKIARDLVRCMQKIDGDYYPETLHQMFIVNAGPGFKLIWSTVKGLLDPKTSSKIHVLGTKYQHRLLEAIDSSQLPEFLGGSCTCSSQGGCLRSNKGPWSDPLIMKLVHCMESSALKDIGQVSDIEEAITGSVRLRALKLPERISYTSNAESGSDVDDLGSPIGQEDFEYHSLAPVHEEARESGSTCSGSDDKVVETNTIYNPPGNGSGQYSARQNPSINRVSPEPAGHVPNDGEGNADHGILKYISKKVLGVILEVLSFLRIFIRHRQQLENVPQHTTTVHSNQADLQIIKEDRVNPCLERLERLETMFNQLSRKPPEIPQDKDRAIQDSFDRIKCIEFDLEKTKKVLHATVIRQMQMAETLEAVKESDLRRRKFCT

SEQ ID NO: 16099 - protein, 215 aa, Setaria italica
MAGKFGATCSRAAASLFSPRHRRLLLPSTPTPPRFLPFSHRLLPRTLSTIAMTAPNGAADTDAVHEPPQKISKIAPLLKVKKLSDKAVLPSRGSALAAGYDLSSAAEMVVPARGKALVPTDLSIAIPEGTYARVAPRSGLALKHSIDVGAGVIDADYRGPVGVILFNHSDVDFAVKPGDRIAQMIIEVIATPEVAEVEDLDATVRGEGGFGSTGV

SEQ ID NO: 16100 - protein, 697 aa, Sorghum bicolor
MAPSWWGRDARANGVVSGGGGTPVVVKMENPNWSISEVAASEVSPGSPAGAGGGKAGRGKNARQITWVLLLRAHRAAGRLTGAASAALAVAAAARRRVAAGRTDSDAAPGESTALRTRFYGCIRVFLVLSLLLLAVEVVAYFQGWHLSVSLEEEVDAGLQAVDGLFAAAYAAWMRARLDYLAPPLQFLTNACVVLFLIQSVDRIVLCLGCFWIRLKGIKPVPLAAADKEDVEAGPEDFPMVLVQMPMCNEREVYQQSIGAVCSLDWPRSNFLVQVLDDSDDATTSALIKEEVEKWQREGVRIVYRHRVIRDGYKAGNLKSAMNCSYVKDYEFVVIFDADFQPQADFLKRTVPHFKGKDDVGLVQARWSFVNKDENLLTRLQNINLCFHFEVEQQVNGAFLNFFGFNGTAGVWRIKALEESGGWMERTTVEDMDIAVRAHLKGWKFLFLNDVECQCELPESYEAYRKQQHRWHSGPMQLFRLCFVDIIKSKIGFWKKFNLIFLFFLLRKLILPFYSFTLFCVILPMTMFVPEAELPAWVVCYIPATMSILNILPAPKSFPFIVPYLLFENTMSVTKFNAMISGLFQLGSAYEWVVTKKSGRSSEGDLLALVEKHSKQQRVGSAPNLDALTKEESNPKKDTKKKKHNRIYRKELALSFLLLTAAARSLLSAQGIHFYFLLFQGVSFLVVGLDLIGEQVD

SEQ ID NO: 16101 - protein, 1388 aa, Zea mays
MSPPFVFPSTLRDLELDTDGDRDEEPSLRPQNPVAVATLRAADLEEFVKGASFDLSDKELFCIEEQEVFDAIYSIVRDFNCLPPALKFNIVETLRSNLSVLLPSIDSLSRASMSSPSDATEITDRIASHRNALKIYSFFLISIVLTAEAGAESCTAAKATAHGRKKNHIYSWNWEAQRGRIMSLVANSLEANLSLLFGPGGTDERYLSFVSKCTFVLCENQNVLKDEDTRNGLCRIIGAIATKHQRISQISASVSHLIHKFDFTVPHLAEAVASAEKKFGDGSLAISLIREIGRADPKEYTRDSVGADNVGRFLVELADRLPKLMSTNIGVLIPHFGGESYKIRNALVGVLGKLAAKAFKDVEGDSNARLRSKQAMLEILIERCRDVSAYTRSRVLQVWSELCEENSISIGLWNEVASVASGRLEDKSAIVRKSALQLLITMLQHNPFGPQLRTATFEATLEKYKEKLQGMEPSNSDKDEAANDSSPGEVIMGQDESVSDSCLASSQDQNDRDATIVDITNLEQIRALVASLEAGLRFSKCITSLMPILVQLLASSSATDVENTILLLMRCRQFQIEGSEAALRKMLPLVFSQDKSIYEAVESAFITLYTRKSPIETAKSLLDLAIDCSIGDLAALESLISSLVSKAEISSSMVSALWDYFCFNINGVRPVQSRGALSILCMAAKSSPSILGNHLQDIIDIGFGRWAKEEPLLARTACLALQRLSEEDKDKLISNNSRVFAALQGLVTSFSIPEKIWYGAADKAISTIYTLHPAPELFATETAKKSLSSVFSVLGTNDVSNGDEAQNGASLSSVSPSKLGRFLFVISHIALNHLVYIENSVRKIQKQKRKNEKSQPTTEDLQPDVSKSLEAQGINAELGLSATIDIAIESLAERAEKEIVCCSSEKNLIGHCGPFLSKLCRNLALLQKFPDLQASAMLALCRLMIIDAEFCEANLQILFTVAESAPSETVRSNCTIALGDLAVRFPNLLDPWTEYIYARLRDPSVSVRKNAVLVISHLILNDMMKVKGYINEMAVRIEDKDERISSLAKLFFHELSKKGSNPIYNLLPDILGRLCNQHLKEETFCNIMQFLINSIKKDKQMEALVDKLCNRFAGVNDVRQWEYISYCLSQLTFTEKGLKKLIDNFKMFEHALSEDSVMNHFRSVISKCKKFAKPELKICIEEFEEKLSKVHQEKKEQEETTKNAEAHRQRIDSLDEFLVTKEVSENSGNSAEDETSEVVDPSVDSSTEHMENTPECSVNTSAENSQTTAPLTESEGGGEEIQSAQPVSKGMSRLRAKKTRDPVVDPSVDRSTEYKGNTPEHSADTSTENSQTSAPLTGTEGGSEEIQSTQPVGKGVSRSRARKTRDPVVEDSAAPVRRATRSTRRQGS

SEQ ID NO: 16102 - protein, 505 aa, Oryza sativa
MDPSSSSSSSSPFSTPFHSISSTSTLRPQLAIAIVATPSVCGRNEIEQQPSMVRKEMGGGGGRLAAEYQGLEVKVPTFFRCPISLDVMRSPVSLCTGVTYDRASIQRWIDSGNTTCPATMLPLPSTDLVPNLTLRRLIALWASTAAPSSPAAPSAVGPTPAAAAAELLRRVGAPGVDPCPALRKLAAFLSDDDVDEFDKNALARAGGAAETVASVLRRRGKGDDDDGGVEAVEAAVRVLAVLATSDCIEEENRRRVAAVLAAGGAAPSVAASLARVMRSGSGLEARVDAARLVESLLRDGARGATAPGVRAAVAESEELVAELIRLVGPTDEKGSLDAQAVDAGLSCLAAIVAATRRARAEMVRLGAVPAAVRVLATDHHGGSHAQALRVLEAAVGCAEGRAAVCEVAEAAIPAVVSRMMRCGGMGGAEAAVSVLWAVCHRYRDRRAVEAAAASKGGLTKLLLLMQSGCSPAARQMASELLKMFKVNAKSCLAGYDSKTTHIMPF

SEQ ID NO: 16103 - protein, 719 aa, Sorghum bicolor
MGKASRWLRNLFLTGWKGRTAKDRGAADVDCQSVLSAPLPSHSLAATATATPSGREKRRWSFRCPGASGGAQGQGPLASSSSHCFSEAEVHVVVVAQEQDQQQVAAAAAAVVPGTALSSSTAGTRRRSAGGGDRDAAAVRIQAAFRSYLVMVATVRCDEIANEKFGCITTDTEWLDVESAVQSGPVPGFGKKLGNIVDVHLQEYDKEAIYFDEAVRKGKREHLESRILNLVQPAFQKMLTHLRMKALEKFKTGLNSSLESGKGFAVSARDNTECSLKDFEQGCADAIIKQANWDCSKMLEKVRRDIEDHALSIRESKLSELTTHAKEKLRKALAEPVESLFDAADQTTWQSIRNVYKRETEAILPEFLKTLCGFEMEYGPAEEMVSKLRDYARSVVESKAKDESSKVLIHMKERFTTVFSHDKDSIPRVWTGKEDVRAIAKEARSAALKLLSVMAAIRWDDEPDSIESILTSTLLEGSVVSKIAHAASADPLASTTWEEIPPKYTMITPSQCKSLWKQFKSETEFTITQAVSTQQAHRRGNSKLPPPWAIVAIAILGFNEIMVLLRNPIYLFLLFVGYLMFKALAVQLDVSREFQNGVVPGIISVSAKLLPTIQNLVNNVAAEQQAEHQHPHPHPHPQAADPPQPQMQPPPLLLSPRSPMSELRRLHMPSSPRKVASPVPSSSSSSSAVSSPRHTGEDQKPRPGVGGAENPSTVADSIV

SEQ ID NO: 16104 - protein, 117 aa, Zea mays
MLEQLLPVSEASVSSEDGKGDSNDEEKLAKPSSSLVNGGGMPELDEIEYMESMYMKSTVAALRSLKEIRGKSSTVSMFSLPPLQGNNAQDSYQIRAEQLDEEPERWSKVTVIEQAAK

SEQ ID NO: 16105 - protein, 239 aa, Zea mays
MTDALSQDPHVVRLLDLKQGVNKEGQTILYLVFEYMDTDLKKFIRGYRANHEKIPAQTVKILMYQLCKGVGFVHGRGVLHRDLKPHNLLMDRKTMALKIADLGLSRAITVPVKKYTHEILTLWYRAPEVLLGATHYSTPVDIWSVGCIFAELVTNQPLFPGDSELQQLLHIFKLLGTPNEEMWPGVGKLPNWHVYPQWKPTKLSTLVPGLDSDGYDLLEVSEKYATHLSSRICSHGLLF

SEQ ID NO: 16106 - protein, 79 aa, Zea mays
MLNEDELRDAVLLVFANKQDLPNAMNAAEITDKLGLHSLRQRHWYIQSTCATTGEGLYEAWTGCPATLRARLEYQMRTD

SEQ ID NO: 16107 - protein, 690 aa, Sorghum bicolor
MPATAEDSPAIRKLGQLFRLTEVYLWDDSYGAGPHDGRKNWRSAEAALVDSHTDKTCNEASNGTDKGHLFVEDLELANLMGSLGLPVSFSTSKVNKNTGNKGKKKGRQALLKAAKTQINDAVRICANTEDRESAVESLDVMAHMHSCNLSGTPLGHNEPCHDDTDKMLREDSPCVEEQEESGCSTIYSADKAPSCDAKNLLTELGTFELSDNLGNPAKEDYSIQENQASDSVLLDSEEMPRHDCVDGESTHSCVDIYQEERVSTREDQTSEETLSVSHDHNDVGQEASLSLAEPSSIDEHAQSSANNFYYDYGEWRVVWDPFYSRYYFYNIQTQESTWCPPEGLEDFASYCSPDTTKELVELGSQCTSIAPQENNLATDDNHLEAQEQDHCIHDLSDIPVEKAIYQSMITTSDKAQHTENKYSDSTTIVLEMNQEVTTTKKKKRVALLHNSFLVSLSKCNFAWLLRIAYLCLDHSCQDMAGNISNDIIKYWTQRYSLFSLFDRGIKMDEEGWFSVTPEPIAKHHASRVGAGVIIDCFTGVGGNAIQFATKCKHVIAVDIDPQKIDCAHHNASIYGVNNHIDFIVGDFIHIAPHLKGETAFMSPPWGGPDYAKVDVYDMKSMLLPCDGYSLFKLGTMIASRVVMFLPRNIDLNQLADMSLSVDPPWSVEVEKNFLNGKLKAITAYFEEQDC

SEQ ID NO: 16108 - protein, 1862 aa, Sorghum bicolor
MAPPRGDRKKGKGAGGKTDLRPDRKQFKGHRKEVAAAEQGDGDGERQQLAAPGSAALLAAASDEADFPRGGRSLLSKDEMAEARAEAEQDFEREGKKGKGKRKRRGGESSGFGPDDDLGTLFGGATTGKLPRYANRITVKNISPNMKLWGVVIEVNQKDIVLSLPGGIRGFVRSEDVCDIALQENRKDSENSLCAKVVHVGQLVPCIVLRVDDDKKEGKVLAAQVKSIEDHGYILHFGVSSFSGFMQKDDKENVKIERRQLMHCVVKAIDKTRAIVHLSSDEDLLCKSIIKDLKGLSIDHLIPGMMVNARVHSVLENGVMLSFLTYFSGTVDIFNLLNSFPSGNWKDDYSKNKKVNARILFVDPSTRAVGLTLNKHLLHLEVPPINLKAGDIYDKSKVLRVDKKAGLFLEIPSPTPSPGFISIHDVSDKDAKNLEKFKEGSSLRVRILGVRNLEGVAIGTVKDSAFEGSVFTHDDVKPGMLVRAKVATVEPFGAIVQFSSGVKALCPLPHMSELEHVVKPPKKFKVGAELLFRVLGCKSKRVTVTYKKSLVKSKLDVLASYADAKIGLVTHGWITKIEKHGCFVKFYNGVQGFVSRSDLGLEAGTEAENVYHVGQVVKCRIINVIPASRKLNVSFVISHNRVIPIDTPKLGSIVSGVVERLTPAAVVVSVNGFSKGTILNEHLADHHDIEGHNLVLSAKHSLINCANDIPSEISQMHPGVVVHGYICNIIESGCFVRFLGHLTGFSPKDKAVDRRIERLSDAFYVGQSVRSHILSVTAETARVKLSLQQSMCSSTDSSFIQGYFLLDQKIAALKYSSNDWAHTFGIGSLVEGEVGAIEEYGIILNFKDHLDVVGLIEHHQLGGSSVEVGSSVKGLVLDLSDGVVNLSLKPELIGSVRNVGKKKKRQRAAVADLELHEEVNAVVEIIKGSYLVLSIPEYNYAIGFAPLMDYNSQLLPHHHYDNGQRITVVVGNIPSSDSSGRLILLPKASAQYSALSESKRAKKKSGYKIGSLVEAEIIDIKPLELLLQFGGNLHGRIHITEVPEKDSDEHPFSKLRIGQKLTARIVAEAEPSGKSGKNFKWELSIRPCIVNGEFDELTAQKEQKHTTNEIVRAYVVKVDKEWVWLTVSRNVMAHLFVLDSSSEPSELKEFQQRFSEGQAVKGRVINVNREKRLLRLKALDNQCTQLNIDEIQQSKSSVFEQTKQGDIIGGRVQKILPGVGGLVVQIGPHLRGRVHYTEIVDSWVTEPLSGFHEGQFVKCKVLSVSRSSEGSLRVDLSLRSSNLIRDSNNSGLVDDLATCTSRIEKIKDLLPGTEIKGYVKNVNSKGCFIMISRMVEARITLSNLSDEYVENPQKDFPVGMLVHGRVLSTDPSSGRVEASLRKTTCSKLEKLDDISYSDLHVGDIIDGQVKRVESFGLFVTIRRSELVGLCHVSELSDEPVVDINSCYKAGDMVKAKILKIDEKRHRVSLGMKKSYFDSDLTADTNDDEDDESALMDISVAPQMVEYHNRSLVNRKAEPMASVPPLQVSLDESECSDLEDNNNNKGPEIANGTEANAKKNDKQLKKEARKQRELEISAMEERALQGDVPQTPDDFEKLVRSSPNSSFVWIKYMATLLDLADVEKARAVAERALKTIIPREEEEKLNVWVAYFNLENEYGSPREDAVKKVFQRALQYCDPKKLHLALLAMYERTEQYELADELLDRMTKRFKTSCKIWLCRIQFALKQGKDVACIKSIVNRALLSLPHRKRIKFLSQTAILEFKCGVPEEGRSRFELILREYPKRTDLWSVYLDQEIRLGDIEVIRALFERVTCLTLPPKKMQFLFKKYLNFEKSLGEDNERIQFVQQKAIEYVQSSLPSQDNP

SEQ ID NO: 16109 - protein, 498 aa, Helianthus annuus
MRRTPDFFNKLVDSMAPTVYGHQDIKRAILLMLLGGVHKFTHEGINLRGDINVCIVGDPSCAKSQFLKYTTTLVPRSVYTSGKSSSAAGLTATVAKEPETGEFCIEAGALMLADNGVCCIDEFDKMDVRDQVAIHEAMEQQTISITKAGIQATLNARTSILAAANPTGGRYDKSKPLKYNVALPPAILSRFDLVYVMIDDPDDTTDYHIANHIVRVHQKREAAVDPTFTTAQLKRYIAYAKSKKPKLNAEARQLLVDSYVHLRKSDTAPGSRVAYRMTVRQLEALIRLSEAIARCHLDDEVLPRHVSLATKLLKTSVISVESQEIDLTEFQDENIEHGDNEENGDIGENGEAQPGGADADANNMNPENADGAGGKKLVITDEYFQRVTQALVMRLRQHEETVQREGSGLAGMRQRDLIQWYVKQRNESEAYENEEEAKAEVTKVKAIIESLVRREGHLIVVNEEEVPPQGEDDGNARRPSRNNRILAVAPNYVLDQLD

SEQ ID NO: 16110 - protein, 483 aa, Oryza sativa
MAASETAPFGVSAASKGGGGVAGARAQHGQLAVAGRVHDALVFAAGAVAAVLVLLATASFLSPMPVTNLVAFRSLPVSVASTSAASAAIDADVGVRGGPGAAGRTFYDDSRVSYAVEVGRRGGITGWDARRAAWMRLRYPRGLNATAAGRERVVMVSGSQAPPCRGEGGDHLLLRFLKNKVDYCRLHGVELLYNNALLQPRMLAYWAKIPAVRAAMLAHPDAEWVWWVDADAVFTDMDFSLPLHKYKDHNLVVYGWNKEVYGERSWVGLNAGVFLIRNCQWSLDFMDAWARMGPASPEYARWGSVLHDTLRGKSDKESDDQSALVYLLSEHEEKWGAKTYLEKGYFFQGYWVEVVDRLDDIAARYEAAERRPSAAAAHLRRRHAEREHERYAAARNAAVRGAVPGPAGGGQSGWRRPFVTHFTGCQPCGGEPNKIYSKKSCADGMNRALNFADDQVLRNYGYRHKDPLSDEVRPLPFDYPAAR

SEQ ID NO: 16111 - protein, 809 aa, Oryza sativa
MSASEFRIPYQQVSSSQTTENAGQFKICRCGEGDPNTNTSETGDKSPTSCPNCQNAPPRGNEPIVTLGGIDLNNSGSVVVKEDKKLLTVLFPDGRDGRTFTLKAETTEELNEWRSALENALAQAPVVANTVGQNPIFSTDIAEPAEAPAEQSDNKSIIGRPAEFALVDADGSPAFLEKALKFIEDYGVKVEGILRQSADVEEVKRRVRDYEKGKNEFSPEEDAHVIGDCIKYVLREMPSSPVPAPCCTALVGAYRTDKTRRLDAMNRVIYEVFPEPNRQLLQRTLKMMQIVESHKAVNRMSQSALAACMAPLLLRPLLLGECEIDSDFSMAGDGSFQLLQAAAAANHAQAIVIIMLEEYDQIFDDLEDGSYSSDAYTESEDGDFDKEYSTDNDGPEEDDSYDSGEDNIEEGMDDDTEHSSGGSECDNNIKTSVSDDKVKSNNSGTASNGNDQGLQPPKKAARTGHGAVREDTCQIESNDPSNRKQELYESNGSTDQIEKLNVRSSSARAKFMEKSSSSRNKSKKTLWGRTSARKNLSAEEIDYCSDDETLIEKLENSKTDLQSKITKEAKENSILQASLERRKVELHKRRLALEKEVENLRDQLQKERNLRVSLESGLMNLRRGQASFPSTIDNKTKADLEEVATAEADILNLKQKGSDLRGQLNNQVQMSSASLCDSCNKRLLNTDKLTEGEQSTTSSNVGPNSISDMVSATHMAQRMLISKGEIVKDGQDPLASKWNLAQKQYSNNPLLGRLGSRTEDSGAPSALAKLTNRLNFLKERRAILASEMQNLDLARPPGPPAPAPKRDST

SEQ ID NO: 16112 - protein, 652 aa, Oryza sativa
MAKTMERGRRERRRIVRLRVSKVYQIVQLNSQCLLQIRFQKGASKRREQILFCRCGDPLSLVLPWVLLMMEGHSNELGRANTLKKGGLRPIPVIIGNVFGLTNEVSERIVSASVTANLIIYLTTKYHLGAASSAIIIFVYQAAANFLPVCGAIVSDALLGRYLMVTLTLFSCTTGTFMLFLTSLIPKLTPPDCGLSNQGCTSPSPLQLFVLCASLGFMSLGASGVRPCCLAFAEDQIAHWDEAQKDRALRGLFSWYYVSVGFAQIVAVTILVYFQDQVGWKVGFGISAAVMLSITLVNLAASPFYVKMKPQRSIWISLLQVVVVSLKNHHLVLPKTYQSAQFHNASGLRELVPSEKMRFLNKACILRYHATNVSDGAGRTNSWNICTVEQVENLKSALSVIPMWSAMIMTFLIQSSSFGVLQAATMDRRVGTKKFQLPAGSISIFEIITFTIWSGCYDRYIVPFLRRITGRQQVLTLKQRMGIGVSLSIASMLVASAVETYRRKVAVKGGLQHDAKGTLEMSVLWLAPQYVIIGLAGAFSSIGQIEFYYAVLPKSMGSFVLALLFFGAGVASIIATLVIKAINLITGRNGMAPWLSNNLNEGHYNYYYFLLAVLGAIDLIYFIVCSYVFDERTQNMSLETSGDAKDMVEFQG

SEQ ID NO: 16113 - protein, 475 aa, Helianthus annuus
MMLIRAMTTVLLWICLVQLTALGGSLGPRVLKGWPSCFTQDSHSAAALDVKLLPVHARVLPHKRVYKNNGYLVVSCNGGLNQMRSAICDMVAIARYLNVTLIVPELDKTSFWADPSEFEDIFDVDHFITSLRDEVRILKQLPPRLKKRVELGIVHTMPPVSWSDISYYHNQILPLIQKYKVVHLNRTDARLANNGQPLELQKLRCRVNFRALRFTNQIEELGRRVVKLLRQNGPFLVLHLRYEMDMLAFSGCTQGCNAEEVEDLTRMRYAYPWWKEKIINSDLKRKDGLCPLTPEETALTLRALDIDRDIQIYIAAGEIYGGKRRMDSLAAAYPKLVRKETLLGAADLQYFQNHSSQMAALDYLVSLESDIFVPTYDGNMAKVVEGHRRFLGFKKTILLDRRVLVELIDKYTSGLLGWDEFSSAVKDTHAQRMGNPRKRLVIADRPKEEDYFYANPEECLQPSDDDDEEEAVNIL

SEQ ID NO: 16114 - protein, 304 aa, Solanum lycopersicum
MLTPTKQQKCRSVALLHPSSSSSTKSWILHGLAVGAAAAAVALGAHAYLSRSGKFRSRVIGIIPARFASTRFQGKPLVQILGKPMIQRTWERAKLAETLDQVVVATDDEKIAECCRGFGAEVIMTSESCRNGTERCNEALQKLDKKYDIVVNIQGDEPLIEPEIIDGIVKALQSAPDAVFSTAVTSLKPEDAFDPNRVKCVVDNRGYAIYFSRGLIPYNKLGKVNPQFPYLLHLGIQSYDTKFLKIYPELTPTPLQLEEDLEQLKVLENGYKMKVIKVDHEAHGVDIPEDVEKIEQFMRERNMA

SEQ ID NO: 16115 - protein, 624 aa, Oryza sativa
MMGCAVLLVVVASMAGEAAGRFVVEKNSLRVTSPAGLRGVYECAIGNFGMPQYGGTMHGVVVYPKANKKACRSFDDFDLSFKPKPGGLPIFLLVDRGDCYFTTKGWNAQTAGAAAVLVADDRLEPLITMDSPESSGTDYIEKITVPSALVTKKFGDDLKKALENGDMVNVLLDWRESLPHPDERVEYEFWTNSNDECGAKCDMQMNFVRNFRGTAQVLEKRGYTQFTPHYITWYCPEAFVLSKQCRSQCINHGRYCAPDPEQDFNIGYDGKDVVLQNLIQICLFKVGNETHKPWVWWDYVHDFSIRCPMKEKKYTRECANGVIKSLGLDLERINKCVGDPEADEENPVLKAEQDAQIGQGSRGDVTILPTLVVNNKQYRGKLEKSAVLKAVCSGFEETTEPDVCLSQEIQTNECLESNGGCWQDKTNNFTACKDTFRGRVCECPIARGVKFVGDGYTHCEASGVGRCQINNGGCWKETKNGKTVSACSNEESKGCKCPPGFKGDGIKSCEDIDECKDKLFCQCKDCSCENTWGSYECSCGGSNMLYMREHDTCISKVASSSVGWGFLWVIFFGLALAGIGAYAVYKYRLRSYMDSEIRAIMAQYMPLENQETPNQHRPVEHADI

SEQ ID NO: 16116 - protein, 779 aa, Zea mays
MGCTASKVEQEDTVRRCKERRRHMKDAVAARQLLASAHADYLRSLRVTAAALSRFAKGHPSLAVSHHTTPVLLSAAAPPPAPSAARALPTPAPSTAASSSLPPPTPLAQHPHPPPQPPAAMAAPQPAPARAPRPRRLRVPHILSDSSVASPARSSFRKQPPVGTPSSSSAWDWENFYPPSPPDSEFFDRRKAEVEHASRLRELEEEEKARAYLQHHTQYNLKEEDEAAEDDDGEVDHEPEGMHCGGWEDDEHYASTTTSETRSEDEGEMGDRSECGFAARSECGFVARSEYGGTAPSEYAAVPLPLRRDERSEAGDSSTVTAATEMRMVVRHRTLEEIVAAIEEYFVKAADSGNDVSELLEASRAQLDRNFRQLKKTVYHSNSVLSALSSTWTSKPPLAVRYKLDTNALEMESTEGKSHGSTLERLLAWEKKLYEEVKARESVKIEHEKKLSTLQSLEYRGRDSAKLDKTKASINRLQSLIVVTSQAATTTSSAIVRVRDNELAPQLVQLCFALLGMWRSMNHFHEIQNEIVQQVRGLVDNSMAESTSDLHRLATRDLEAAVAAWHSNFNRLIKYQRDYIRSLYGWLKLTLCQVDSSVPQEAHASMISRELTSFCDEWKQALDRLPDAVASEAIKSFVNVVHVIYTKQAEEMKIKKRAETYSKELEKKANSLRSIEKKYYQSYSMVGLGLPGSGRDGIESHAAYDARDPLAEKKTEIAQCRRKVEDEMTRHAKAVEVTRSMTLNNIQTGLPGIFQAIAGFSGTVVEALDVVCRRAGSVR

SEQ ID NO: 16117 - protein, 440 aa, Brachypodium distachyon
METKPPSPGTASAAAAAHHHRRWAAPLLASVLLSSLLISASLFFSSSRALLLSFSPLPSAASAEPLFVEAKLRQQQQQMRPDGVARTQRAVPRIAYLVSGSAGDGVALRRTLRALYHPANRYVVHLDLEAPAAERAELAAALRADPVYSRFRNVRVVTRANLVTYRGPTMVANTLHAAAILLREGGDWDWFINLSASDYPLVSQDDLLYVLSTLPRELNFIEHTSDIGWKEYQRAKPVIVDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLNDFDGMVNSNAPFARKFGREDPVLDKIDQEILGRQPDGFVAGGWMDMLNTTVKGKHFTVERVQDLRPGPGADRLKNLVTGLLTQEGFDDKHCL

SEQ ID NO: 16118 - protein, 471 aa, Oryza sativa
MAQWPWRWRVLLPLLLLHSSPVFAQEGQDNDPSTLFKRASEMMNLRKYDGSLGLLNAVLEVDPNHSEAYRQRASVLRHKCRYKEAEGDYSKYLELKPGSSSVEKELSQLLQAQNALESAYGQFESHDFSKVLEYINKIVLVFSPNCLKAKLLKAKALLALEDYSSVISETGFILKEDEDNLDALLLRGRAYYYLADHDVASRHYQKGLRLDPEHSELKKAYFGLKNLLKKTKSAEDNAAKGKLRVSAEDYKAALAMDPDHTSYNVHLYLGLCKVLVKLGRGKEAISSCTEALNIDGELVDALTQRGEAKLLTEDWEGAVQDLKEASQKSPQDMGIREALMRAEKQLKLSKRKDWYKILGISKTASAADIKRAYKKLALQWHPDKNVDNREEAENMFREIAAAYEVLGDEDKRVRYDRGEDLDEMNMGGGGGGFNPFGGGGQQYTFHYDGGFHGGGGFPGGGFPGGFQFNFG

SEQ ID NO: 16119 - protein, 651 aa, Oryza sativa
MASSLLRASPLSLLSRLKPLNPSPTASHLRRLLLLSTASSTSSASCSPSPPRTLAATDAATPPPEEEAAAPAAEAKRERLQPLQWPARDALCGELGAGDAGRRVRLCGWVALHRAHAGLTFLTLRDRSGTVQVTTLPEYPEVYAVVNKLRVESVVAVEGVVRSRPTEAINTDMKTGAIEVAADNIYVLNSVTRSLPFPITTADTVKEKFPEEIRLRFRVLDLRRPQMQSNLRLRHNVVKHIRRYLEDRHDFVEPGMFYALPQSPQLFKQMLMVSGFEKYYQIARCFRDEDLRADRQPEFTQLDMEIAFTSMEDMLKLNEELMRHIFQEVGDIKLPNPFPRLTYTEAMNRYGTDRPDLRFDWQLKDVSDAFLGSSFKIFADTLENGGVIKALCVPGGAKEFSNTDLKKGTVYTEASKAGAKGLPFLKVMDNGELEGIGPLVASLKPEKKEQLLKHLDAKSGDLILFALGEQSAANRILGRLRLFIAHKLEVIDTSAHSILWVTDFPMFEWNSDEQRYEALHHPFTAPNPEDMNDLPSARALAYDMIYNGVEIGGGSLRIYKSDVQQRIFEIIGISPEQAEEKFGYLLECFDMGAPPHGGIAYGLDRLVMLLAGENSIRDVIAFPKTTTAQCSLTKAPSPVDPQQLKDLGFRT

SEQ ID NO: 16120 - protein, 197 aa, Solanum lycopersicum
MIRHVALISLITKTTTLSFSPNLFKKHKSMASPTLITPSTSTPKSLITPIRSKLITSVTTTTITLRRREFLSLSAGILSPSLLLPATSAFAATDEEYVKEASEVIQKVRSTLNMDKGDPNIADSVAELREASNYWVAKYRREKALLGRASFRDIYSALNAVSGHYVSFGPTTPIPAKRKVRILEEMDTAEKALKRGR

SEQ ID NO: 16121 - protein, 821 aa, Oryza sativa
MAAGTASPPPDAEPPECPVCLSPFDAASAAPRVLPCGHSLCGPCIASLPPASASASASAASLRCPLCSQCVPFSRALGPSSLPKNLALISLLPSPPNPSRSRTAAAAPPPPHVPLHADHSRLLSRFRHAVLPESASPLHSPAPAAGLAIGSFASDLGAPWFCPRGHPVSLLPIETPAAAAKQESPLYYRPSHAARVAAAIDALSAAARDEVIDLVAVSSRLARRVCRVYGFWMGPEAAPLWLLSERHSRGVSCLLEERSRREETVALIRNVGMEVCEAFMGLHGEGLVLGCIGLGCFCLDRFGHCLLDLNQVLALCHGVRVGVCSSKSKAFMAPEVAEVVHDKLQIKDHDFSGLLGPSSDAWLLGCLLVALVTGDEQLAAGWSTEGSYDDWKNEVLTKVDASLVGTHMEPWSATMVSCLNYDPEGRPEIADVWKCINGSLMNSDIEALIPNVDLAARKSFMCLLLGELSSMCSNLDAVESDDTMHLSQDLDDKHSTPDDASSGGIINNEEVGAAGMDGPKCGLYNSSTLLAHRDCITGLAIGGGFLFSSSYDKTINVWSLQDFSHKQSLKGHEHKITAIVVVDNDNQSLCISGDSGSGIFVWCVDPSLSNEPLNKWYESNDWIYRGVHCLAVSGTGYLYTGSRDKSIKAWSLEDYSLRCTMTGHKSTVSCLAVACGILYSGSWDGSIRSWWLTDHSPLSVLEDGTPGSITPVLSISTELDFVVASYENGCLKIWKDDVLVKSEKLQNGAIYAAKLNDKWLYAGGWDKVVNIQELLEDDSEVEIRDVATFTCDSIITSILYWDGRLIVGLSNREIKVFYKAS

SEQ ID NO: 16122 - protein, 1113 aa, Zea mays
MAPSAAAPGISEAEGAPRMAKFLCSFGGSILPRPLDGCLRYVGGETRIVILPRDISYADLAARMRDLYKDADTIKYQQPDEDLDALVSVVNHDDVVNMMEEYDKVTATGEAFTRLRIFLFSQQLDDNAASVAVHYNVDERETERRYVDALNSLGDVRSPSSPVSVEQLFGIGGNDSGIPDFAGLRHLNVPRPSHGQRYGEMDSPWSPAYVSPSQYRVHDPRDFPISPSSARFQVGAEDFDDRIPDDFVRQSPKYHYYEAQSPSHMDNLVWLPPGAVIQQNAGFPGDLSKHNKFLDGNSGCDHCGSLFHKGQGSVTDPIYMNPRWTRPVQQHFDQPSMINDYPGHHANSCPDYCRPGEHYAGGQDVRLENGVYVKEQNGGHTPMLYNESRPHDRVWYAHTNQSHQRYEDPRLHYPTNDRVIEPYIVDASSVNSAFAPNKVYEMHSASLGHSSSSHESPHYFHGSSELINDAYHNQQVGGSGSYVQPAGSEESPGQHYNHFSAYGADSFYQMQQNLPPIQSLRRRANSPVHTASPYDSPHLPIPNGSINMNSVRNTGDASPRIAGLIGYDRMPNPFTPPNGSILYRVGGHDVPAAMENTSAFGPRSNPTAAQYVQPFIAPESIQHQPGVPLREVYPERAYPEPMPSSYADGKVAVSALPLTDQLFRLDINTMKKLEGQDDGNSTRNVNETTLLHAVDEPSTLPHHVGSVHEVDPKQEKLTEKESRQKQHEAGATALQECEDISEDMLNFLPELIASVKKVTLEDAAETQIAQSDANAAVSPVPDDDDNGKKLDEATAGNTNANQDLDLQGSLDRQKSFKIESTTAEAEALSKGLQTIKNDDLEEIRELGSGTYGAVYHGKWRGCDVAIKRIKASCFAGRPSERERLITDFWKEALILSSLHHPNVVAFYGVVRDGPDGSLATVTEFMVNGSLKQFLRKKDRTIDRRKRVILAMDAAFGMEYLHGKNIVHFDLKCENLLVNMRDPQRPICKIGDLGLSKVKQHTLVSGGVRGTLPWMAPELLSGKNNMVSEKIDVYSFGIVMWELLTGEEPYSDMRAAEIIGAIVNDSLRPQIPSWCDPEWKGLMESCWSSDPAERPSFTDISQRLRKMAAAMNVK

SEQ ID NO: 16123 - protein, 330 aa, Oryza sativa
MAEAAAAPPAAAATNYEVDLGNLMAYDPSHHLPAASSSREELREECLRKGTELAQAVADALFALPATEDRDGPMVRLPPPTTRFPREKHLPRPKPPTKWEQFAKMKGITKHKKNKREWDEQTQTWKRTYGYDRVNDDKDIPIIEAKATDEPGVDPFAQRREDKKKHVEKQEKNRLENLKKAAKVGALPSHIQLAATALPITGTKADIPKKSRKKDLEDVAGMASSATASGGKFDEKLPGEKPPKNPGKHRKFLPVVEGKGMGNQEKQQNDKILNALLAKSSEDQMDVGRAITMYKVKKEKQRRKDKEKSSSSNKLKPQKKTLKKSSKKKA

SEQ ID NO: 16124 - protein, 382 aa, Hordeum vulgare
MKPSVAALLVSFVALLLVAAVRGDDDGCGSPESAGQDRARANHLKIAAFFSILVCGALGCSLPVLGRRVPALRPEGDVFFLVKAFAAGVILATGFIHILPDAFEKLTSPCLLPSDGPWHDFPFAGLGAMVGAIGTLVVDTVATGYFTRAQLNKDGAHGHGAITSSAAVVDEEKQAAAAASEEARRHEGGEQEVHVHTHATHGHAHGSAALVAAVGGAEDEKDTIRHRVISQVLELGIVVHSVIIGISLGASQDPDNIKPLVVALSFHQMFEGMGLGGCIVQAKFKASSVVTMILFFCLTTPVGIAVGFGISRVYNENSPTALVVEGSLNSVAAGILVYMALVDLLAEDFMNPKVQSRGKLQLGINISMLVGAGLMSMLAKWA

SEQ ID NO: 16125 - protein, 512 aa, Phaseolus vulgaris
MDPLSLLQVLQSHSFATVLAVGASSLLFLILKLRLTGRHARLPSVPAVPGLPVVGNLLQLKEKKPYKTFARMAEEHGPIYSIRAGSSTIIVVNSAAIAKEAMVTRFNSISTRKLSKALTILTSDKCMVATSDYNDFHKTVKKHILANVLGANAQKRHRLHREDMLENILSSFSEHVKRFSDQAVDFRNVFVSQLFILALKQGLGRNIESIYVEELERTLSRDDIYKILVLDMMEGAIEVDWRDFFPYLKWIPNRSVEKRIQNLNFRRGVVMRALMNEQKKRMASGKVENCFYDYLVTEAKELNEHQISMLLWETIVETSDTTLVTSEWAMYELAKDKTRQARLYKELQNVCGQEKVTEEHLSKLPYLGAVFHETLRKHNPAPIVPIRYAHENTELGGYHIPAGSQIAINIYGCNMDKNKWENPLEWKPERFLDEKYDPSDLYKTMAFGAGKRVCAGSLQAMLIACTAIGRFVQQYEWDLGQGQEENVDTMCLTTHRLQPLQVKLRPRKEYTK

SEQ ID NO: 16126 - protein, 516 aa, Setaria italica
MAIGGGGFAEGPAGAGYSGRVTSFVVLSCIVAGSGGILFGYDLGISGGVTSMESFLSKFFPDVYHQMRGDKKVSNYCRFDSELLTVFTSSLYVAGLVATLFASSVTRRFGRRASILIGGSVFIAGSVFGGAAVNVYMLLLNRILLGIGLGFTNQSIPLYLSEMAPPQYRGAISNGFELCISIGILIANLINYGVEKIADGWGWRISLSLAAVPAAFLTIGAIFLPETPSFIIQRDGNIDEAKILLQRLRGTTRIQKELDDLVSASNISRTIRHPLRNIFKRKYRPQLVIALLIPFFNQVTGINVINFYAPVMFRTIGLKESASLMSAVVTRICATVANIVAMVVVDRFGRRKLFLVGGVQMILSQIMVGAVLAAKFKDHGGMEKEYAYLVLIIMCVFVAGFAWSWGPLTYLVPTEICPLEIRSAGQSIVIAVIFLVTFVIGQTFLAMLCHLKFGTFFLFGGWVCVMTVFVYFFLPETKQLPMEQMEQVWRRHWFWKRIVGEEEEEREAGSIALSTT

SEQ ID NO: 16127 - protein, 611 aa, Oryza sativa
MSESNVDGIEISASNDERRDRGDAEISEDEPRQTRIRSLKKKALHASTRLTHSLKKRGKRKVGCRVPKITIEDVRDAEEEQAVSSFREVLFARDMLPERHDDYHTMLRFLKARKFDVEKAAHMWADMLHWRKDFGTDTILEDFEFHELEEVLQYYPHGYHGVDKEGRPVYIELLGKVEPSKLVQITTVERYIKYHVQEFERAFREKFPACSIAAKKHIDTTTTILDVHGVGWKNFSKIARDLVRCMQKIDGDYYPETLHQMFIVNAGPGFKLIWSTVKGLLDPKTSSKIHVLGTKYQHRLLEAIDSSQLPEFLGGSCTCSSQGGCLRSNKGPWSDPLIMKLVHCMESSALKDIGQVSDIEEAITGSVRLRALKLPERISYTSNAESGSDVDDLGSPIGQEDFEYHSLAPVHEEARESGSTCSGSDDKVVETNTRYNPPGNGSGQYSARQNPSINRVSPEPGHVPNDGEGNADHGILKYISKKVLGVILEVLSFLRIFIRHRQQLENVPQHTTTVHSNQADLQIIKEDRVNPCLERLERLETMFNQLSRKPPEIPQDKDRAIQDSFDRIKCIEFDLEKTKKVLHATVIRQMQMAETLEAVKESDLRRRKFCT

SEQ ID NO: 16128 - protein, 255 aa, Helianthus annuus
MIGPQRPQIVLFGSSIVQLSFSNDGWGAILADVYARKADIVLRGYYGWNSRRAVKVLDQVFPKDAASQPSLIIVYFGGNDSMGPHSSGLGPHVPLPEYIENMRKIATHLQGLSDTTRLIFLTCPPVDEVKLNENTSSIFSELVRTNELCRAYSDACVELCNEMGIKVIDLWTAFQKRDNWLTFFTDGVHLSGEGSKVVVEEILKVLKEAEWKPSLHWKSMPTEFSEDSPYDLVYSDGKTTLNPSDWTFHREIQWE

SEQ ID NO: 16129 - protein, 659 aa, Helianthus annuus
MSLYTVKVEDSRAAAGDVPSAGPVYRCIYAKDGLMELPPGYDSPWDFFSESAKRNPKNPALGRRQIIDGKAGGYSWLSYQDAYNSSIRIASAIRSRSVNPGDRCGIYGPNCPEWIISMEACNSNGITYVPLYDTLGANAVEFIINHAEISLVFVQDNKIPAILSCLPNCSSNLKTIVSFGNISESQKKEAMEHGVDCFSWEEFASMGNLEDELPAKHKNDICTIMYTSGTTGEPKGVILSNAAFMSEVLSMHQLLVETDKPGTEEDTYFSFLPLAHIFDQIIETYCIYSGASIGFWQADIRYLIEDLLVLKPTIFCGVPRVYDRIYTGIMAKILAGGTVKKALFDFAYNYKLRNLEKGIQQDKSAPLLDKLVFDKIKQGFGGRVRLMLSGAAPLPKHVEEFLRVTCCTVLSQGYGLTESCGGCFTSIANVYSMIGTVGVPMTTIEARLESVPEMGYDALSSVPRGEICLRGNTLFSGYHKREDLTKDVLVNGWFHTGDIGEWQADGAMKIIDRKKNIFKLSQGEYVAVENIESAYSRCPLVTAIWVYGNSFESFLVAVVVPDRMAIEEWATKNNESGDYISLCKNPNVRKYVLDELNSEAKNNKLRGFEMLKAVHLEPVPFDFERDLITPTFKLKRQQLLKYYKDCIDKLYAEAKASKK

SEQ ID NO: 16130 - protein, 210 aa, Triticum aestivum
MAAPRALVLGVLLLIAVSNTEAASVVVGMAKCADCTRKNMKAEEAFKGLQVAIKCKSVHGDYESKAVGALDRTGAFSVPLAADLHGADCVAQLHSAASNMPCLGQEPSKIAPVSEGTTFGVVAGAKTNVLASPECASATLLGPIKKHIIEHFHHKKPVPPKPEPKPQPHPDYGPVPKPEPKPQPHPDYHPIPPTPTYGGGGGGGGYHGHH

SEQ ID NO: 16131 - protein, 468 aa, Triticum aestivum
MVISVPSHRRSMRDAMLGGGRQLHKPLRCAFYDGIPGEGLAAALAEATGSVSLSRTPATDGSVSGKAVRNVLILMSDTGGGHRASAEALRDAFRLDFGDAYQVFVRDLGKEYGGWPLNDMERSYKFMIRHVRLWKVAFHGTSPRWVHGMYLTALAYLYANEVVAGMMKYKPDVIISVHPLMQHIPLWVLKWQSLQPKVPFFTVITDLNTCHPTWFHHGVTRCYCPSAEVVKRALTRGLDPSQIRVYGLPIRPSFCRAVLDKDGLRKELGLHPELPAVLLMGGGEGMGPVEETAKALGHELYDHRRRRPVGQVVVICGRNQALRSTLLSLPWKVPVKIRGFEKQMEKWMGACDCIITKAGPGTIAEALIRGLPIILNDFIPGQEVGNVPYVVDNGAGVFCKDAGEAARQVARWFTTETDELRRYSRNALKLAQPEAVFDIVRDIHKLQPQPAALTRIPYSLTSSFSYHI

SEQ ID NO: 16132 - protein, 774 aa, Setaria italica
MDTPDRAAAQPAASRAEDSPVFSFINNLSPIEPLKSAYNANSLQGYQSINITSISSIFTSPHDNAHKEPRLPKSSLGEISESEVCADGKNTNKPTKSSNAVRLFACTSTVTQETHTVTCSDVVDPPTVPCNLAQPAQFDNGSPDHNTTPCHGVRSDLKQDKCRKLDVVQTVKSTVEKRKCLFSTEIQLLDGGQPVNDNNEVLGCEWSDLIATTSGELLAFDSTMDDHHRGMHLAAKNAESCGYLLSKLAGDGEISERAYPNASGQVYYQELVMGEDQTENAQIFQDGQQTISTEEIQDNIYEANGCIPLDYKVESQQQRGVRRRCLVFEAAGFSNSVVQKESVEDLSVSTCKGKGHVQTQPRGLRGIGLHLNALALTPKGKMACQDPMASALLPSSASEKDAHGKLLCAGENFTHSGGELLEFPMDDCSSGGFPLNDHVSSQSVSPQKKRRKTDNGDDGEACKRCSCKKSKCLKLYCECFAAGVYCSEPCSCQGCLNKPIHEEIVLSTRKQIEFRNPLAFAPKVIRMSDASLETGEDPNNTPASARHKRGCNCKKSSCLKKYCECYQGGVGCSSNCRCESCKNTFGRRDAETELTEEMKQEGEQTENSGKEKENDQQKANVQSEDHPLVELVPITPPFDLSSSLLKLPNFSSAKPPRPSKARSGSSRSSASKATTTLQSCKSSKAAGSGIDEEMPDILKEADSPSRVKTTSPNRKRVSPPHNALSISPNRKGGRKLILKSIPSFPSLTGDSNSGSAMNNTDNTFSASPLALGPS

SEQ ID NO: 16133 - protein, 846 aa, Setaria italica
MAPNHRLPLRLAVVLLLLLLLPAASRARDTISPGQPLRGNDTLVSSGTGTFALGFFSPPGSNNTYVGVWYAKLPVRTVVWVANRADPVPGAVSHNADATLSVSAGCALAVADANGTAVWSSPAPPPDTAGRPCTARIRDDGNLVVSDGRGRVAWQGFDHPTDTLLPGMRLGVDFAAGKNMTLTAWVSPSDPSPGPVVAAMDTSGDPEVFVWNGPAKVWRSGPWDGVQFTGVPDTITYKPLGFSFRFVNTPQEVTYSFQVRDASIVTRLALNGTGGAAGLMQRWTWLETAGAWSLYWYAPKDQCDAVSPCGPNGVCDTSSVPPCRCLQGFAPRSPVTWALRDGRDGCARATPLDCGNRTDGFAVLPHAKVPDTTEAVVDYGSSLEQCRQRCLRNCSCTAYASANLTGGPGRRGCVMWTGGLDDLRVYPGYGQDLYFRLAAADLAPTSKSKKKVNIVIAVVVSITALTILLAVAGFFIWKAKKTKARKPGSSTWRAGPRSKEGSEGKDHGDDLELPVYDYETIAKATEDFSTENKLGEGGFGPVYKGKLEDGQEIAVKTLSRTSTQGLEEFKNEILLIAKLQHRNLVRLIGCSISGPEKILIYEYMENKSLDCFLFDTTKSKLLDWQTRYHIIEGIARGLLYLHQDSRYRIIHRDLKTSNILLDEEMTPKISDFGMARMFGNDDTEINTLRVVGTYGYMAPEYAMDGVFSVKSDVFSFGVIVLEIITGIRNRGVYSYSGHLNLLAHAWSLLNEGKGLDLVDENLDGSFDSDEVLKCLKVGLLCVQENPDDRPLMSQVLMMLASTDTASLPTPKQPGFAARTAAAEDRSWSKPDCSIVDSMTITMVEGR

SEQ ID NO: 16134 - protein, 1155 aa, Setaria italica
MQHDMAEVDGDAPIPAFAVSKGGVVLKHIFLNAPPSSPDRGGAVGGGEEQEEEDPPVTVGRHPDCHVLVDHPSVSRFHLQLRARRRQRRITVTDLRSVHGTWVSGRRIPPHTPVDLVNGDTLRLGASKREYRLLWLSLREALEMEDAPYMPPLPEDKEEPHAYQEASSQLVVPEQRESADMEAHQETSSRKKIQETSQQIILEDIDFPAKVIPSAPPLPDFAHSFSVEKSHENIEGVTEDMLVDKNPISESFGSLIIQEMPAALTNAGRPALSDKRDTSNQVSKRSKLKSVKSLRIDTGRSKDRSSALNYSSQKGDQNEILVCSQSCGVECAACIALFGISEFERAEEKEEMIAEDKGHMHPPASITMEGDKKEPNTENYGPQDSVDSKLQKRIGLFDSALPLFGISEFEIAEEKEEMIAEHKGHMHPPASITMEGNKKEPNTENYGTQDSIGSKLQKRIGLFDSAFPLHFKDDAFTDKEIPQWSSATVNTESDPVSENLATPELKHDDLVHLNLEESFSNKENMAPNKIVEGPENYQLDSTVCGNLFDNLDTEEIEGNEEICPLDKENITPSLSGSIIMERSHIGLKPIISQELMDSISPLNLAHDNFSENEKSILNTGNQMKSNEPISENLSPLTPADKKLQKSQIECMPISHLEFKDDILLDRENSVLAPGKYDAISPERQENLSSDKENVTPASKVKPTVRRVLGSRMDNSVSAKKTSNKEKCIVLSAKSEKIHTIDYDVFYSDKENLTPVSSGGMKARKCLPKNLIVDADQDQEAFCSDKENMTPQSSAARKTRDMSENRARVESAITKKRVADRLPFQTLLSNSPLGPASSLDCNCVVPRTADIAAGDLAIKLEDKLNNLALHKQESGRAGQRMKSWTMVANTDSLLDDESRKSIMLLKGIKGTHLFVPRIVIRELDSMKQREGLFRRSTKATSVLQWIEECMATESWWIHVQSSSEMLPVAPTPPATPSAQRIDEEIKVGSAGSFNPMAALFSPRGFELADIVSPKPEDRVLDCALLLNKLRSDHNVVVLTDSVALKIKAMAEGMVCEGAREFRESLMNPCSSRFMWAASAPRGPAWSRLDAAALAEDYYNSHHHQHGARKQQQQQRKPAEAAAKGLKLILRHNSLYAQATTDAARMTPLPLVSLASV

SEQ ID NO: 16135 - protein, 336 aa, Zea mays
MSFFFRAASRQRPLPQEIARSIKDSLVALDTKTGAKALEDAEKNILTLRHTLAGDGEVEPNQEQVLQIALEICKEGVLSLFVQNLPSLGWEARKDLVHCWCILLRQKVDESYCCVQYIENHFDLLDFLVVCYKNLEVALNCGNMLRECIKYPTLAKYILESSSFELFFQYVELSNFDIASDALNTFKDLLTKHEDAVSEFLSSHYEQFFGLYTKLLSSTNYVTRRQSVKFLSEFLLEAPNAQIMKRYILEVHYLNIMMGLLKDSSKNIRICAFHIFKVFVANPNKPREIIQVLVENHREVLKLLHNLPTSKGEDEQLDEERDLIIKEIEKLVRLSV

SEQ ID NO: 16136 - protein, 908 aa, Oryza sativa
MHLSLWKPLSHCAAVLLAKNHRRRGGGGGSNGHRGDDPASFLRQLRDALDAASEDGSLCPPPDAAGAGADADADAAVSRSRSLARLRAQRDFLRATALAAAGGPFRSPSDIPLLPAAIAGFLAMYPDYATTSDVDRLRVEHYSHLDAAAPGGGAGGRVCLDYCGFGLFDSGWDSSSSSFTLSELNANLSNHALYGGAEAGTVENDIKERILEYLNVPASEYALVFTVSRGSAFRLLAECYPFETNRRLLTMFDHESQSVSWMAQSARAKGAKTRTAWFRWPTLKLCSTELRKEIVGKRRGRRRDSAVGLFVFPAQSRVTGAKYSYQWMALAQQNGWHVMLDAGALGPKDMDSLGLSLFRPDFIITSFYRVFGADPTGFGCLLIKKSVIGSLQGRNGCNASGMVRIVPVFPQYLSDSVDGFDAMDGLEDDSGVHKDEKPASDARNGSQLPAFSGVYTSAQVREAFESDPGRDSSSDRDGASTIFEETESISVGEVMRSPAFSEDCSSENSFWVDVGQSPLGSEKGGHFKKGKLGSPLPSSWFAGRKSNKRMSPNLTSRISRSPLYDGQVISFDAAVLSVSHDADCLKEDPEEEIYENGRRNHFRQVSEIQEEPEVEEVVCQHAMNGGGDHKESAIRRETEGEFRLLGGRDGNSRFAGGRLFGVEEIDAGLSMGRRVSFSTEANIIADRLHRASDAAEASGYAFRDDDGCVSDGYDDAQDWGRREPEIICRHIDHVDMMGLNRTTLRLRYLINWLVTSLLQLRLPGSKGGDGDPLVHIYGPKIKYERGAAVAFNVKQSDGTFVNAEVVQKIAEKNGISLGIGFLSHIKVDLNHKQLNGAFDIPEASFYKNGRKDSKKVTIRVEVVTASLGFLTNFEDVYNMWAFVAKFLDPSFLESERLTIAADHSEGQT

SEQ ID NO: 16137 - protein, 528 aa, Oryza sativa
MGSKTKGCCGWLIVALVASLVATAAVVAIMKKKVGGGSGRKLKPLPVPGPPGAIDSKYGDALGVALQFFQVQKAGKLENNQIPWRGDSALDDGKPAGLDLSKGMYDAGDHIKFSFPMAFTATVLSWSILEYGDQMSATKQLDPALDALRWITDFLVNAHPSDNVFYIQVGDPDLDHNCWERPETMSEKRPLTQINTKSPGSDVAAEAAAAMASASIVFKSRDTTYSDSLLQHAQKLFTFADTYKGLASDTYPKLQNYYNSTGYQDELLWAASWLYHATGDQTYLSYVTVENGKAFADWGRPTWFSWDDKLAGTQVLLSRLNFFGSKQTSNAENMGLKMYRDTAEAVICGLLPDSPSATASRTGGGLVWISGWNSLQHATNAAFLAVVYSDYMLTSQTAAVQCSGKYYSPTDIRNFAISQANYILGDNPMKLSYLVGYGSSYPQQVHHRGASIPADAKTGCKGFQYLHSTSPNPNVAMGALVGGPFQNDTFVDSRDNAVQTESSTYNSGTLVGLLSGLVTTSSVAQSFT

SEQ ID NO: 16138 - protein, 454 aa, Oryza sativa
MVRKEMGGGGGRLAAEYQGLEVKVPTFFRCPISLDVMRSPVSLCTGVTYDRASIQRWIDSGNTTCPATMLPLPSTDLVPNLTLRRLIALWASTAAPSSPAAPSAVGPTPAAAAAELLRRVAAPGVDPCPALRKLAAFLSDDDVDEFDKNALARAGGAAETVASVLRRRGKGDDDDGGVEAVEAAVRVLAVLATSDCIEEENRRRVAAALAAGGAAPSVAASLARVMRSGSGLEARVDAARLVESLLRDGARGATAPGVRAAVAESEELVAELIRLVGPTDEKGSLDAQAVDAGLSCLAAIVAATRRARAEMVRLGAVPAAVRVLATDHHGGSHAQALRVLEAAVGCAEGRAAVCEVAEAAIPAVVSRMMRCGGMGGAEAAVSVLWAVCHRYRDRRAVEAAAASEGGLTKLLLLMQSGCSPAARQMASELLKMFKVNAKSCLAGYDSKTTHIMPF

SEQ ID NO: 16139 - protein, 1179 aa, Sorghum bicolor
MASNGGGLRHSNSNRLSRMSYSGTGDDARAQAAVPGDRPMVTFARRTHSGRYVSYSRDDLDSDLGNAGIGDMSPDRDDQPQQYASYHVHIPSTPDNQPMDPAISARVEEQYVSNSLFTGGFNSVTRAHLMDKVIDSEASHPQMAGAKGSSCAVNGCDAKVMSDERGDDILPCECDFKICAECFADAVKNAGAVCPGCKEPYKSTELEDIVGAANAGAGARPTLSLPPPPGAAASRMERRLSIMRSQKAMTRSQTGDWDHNRWLFETKGTYGYGNAIWPKENEVDAGGVGGGGGGADGQPAEFTTKPWRPLTRKLSIPAAILSPYRLLILIRMVVLALFLMWRIKNKNEDAMWLWGMSVVCELWFGFSWLLDQLPKLCPVNRATDLAVLKDKFETPTPSNPTGRSDLPGLDIFVSTADPEKEPPLVTANTILSILAADYPVEKLSCYVSDDGGALLTFEAMAEAASFANMWVPFCRKHNIEPRNPDSYFNLKKDPYKNKVRQDFVKDRRRVKREYDEFKVRINALPDSIRRRSDAYHAREEIKAMKRQRETALDDAVEPVKIAKATWMADGTHWPGTWIQPSAEHTRGDHAGIIQVMLKPPSDDPLYGSTGDEGRPLDFTEVDIRLPMLVYVSREKRPGYDHNKKAGAMNALVRSSAVMSNGPFILNLDCDHYVYNSQAFREGMCFMMDRGGDRIGYVQFPQRFEGIDPSDRYANHNTVFFDVNMRALDGIMGPVYVGTGCLFRRVALYGFDPPRSKEHGGCCSCCFPQRRKIKASAAAPEETRALRMADFDEDEMNMSSFPKKFGNSNFLINSIPIAEFQGRPLADHPGVKNGRPPGALTVPRDLLDASTVAEAISVISCWYEDKTEWGHRVGWIYGSVTEDVVTGYRMHNRGWKSVYCVTKRDAFRGTAPINLTDRLHQVLRWATGSVEIFFSRNNALLASRRMKFLQRIAYLNVGIYPFTSIFLIVYCFLPALSLFSGQFIVKTLNVAFLTYLLVITLTLCLLAVLEIKWSGISLEEWWRNEQFWLIGGTSAHLAAVLQGLLKVVAGIEISFTLTSKSGGDDVDDEFADLYIVKWTSLMIPPIVIMMVNLIGIAVGFSRTIYSEIPQWSKLLGGVFFSFWVLAHLYPFAKGLMGRRGRTPTIVFVWAGLLSITISLLWVAINPPSGNQQIGGSFTFP

SEQ ID NO: 16140 - protein, 353 aa, Triticum aestivum
MTTGGNGEEQQGRRLFGVSLTDRPVWQQFLICSSGFFFGYLVNGICEEYVYNRLQFSYGWYFTFVQGFVYLGLIRLQGFTVKHMVNPWRTYVRLSAVLMGSNGLTKGSLAFLNYPAQIMFKSTKVLPVMIMGAFIPGLRRKYPFHEYVSAVMLVIGLILFTLADAQTSPNFSMIGVAMVSSALIMDAFLGNLQEAIFKMNPDTTQMEMLFCSTVVGLPFLAVPMVLTGELTTAWSACSQHLYVYAVLVFEAMATFVGQVSVLSLIALFGAATTAMVTTARKAVTLLLSYLIFTKPMTEQHVTGLLLITMGIVLRLLPEDKEKKGMAERQQAKAQRGEEKRRGDGVEEETSPLV

SEQ ID NO: 16141 - protein, 219 aa, Triticum aestivum
MSADELRLDLEELLRLEGLAKRPRVVSLLSNEIRSVDAKLASRAAPVPVPTPAPQAVAVAAAAPAGLSYVTLGSFSWDQDNEKIRVYVFLENVDQEKVETTFKPMSADIKFHDVKGKNYRCAIPKLNKEIVPEKCKVVVKPTKIVITLWKASSGNWLDLHYKEDKFKPSMDKEKDPMSGIMDLMKGMYEEGDEDMKRTIAKAWSDARSGKTADPMKGLP

SEQ ID NO: 16142 - protein, 592 aa, Hordeum vulgare
MDAPKDASPAPKLHTRLRVWEFADRYVFEPVDGLADLYLSVSRTNGSMNLVQELPPRGPSANPKVRIVFGVIGVLKLAVGSCCLVITDRDCVGSYMGHAVFKVTGLKVLPCTTASSAEQKKMETEFSDLLDAAERSIGLYFSYEANLTLTLQRLYDLGDTFKALPLWRQAERRFMWNGYLLEPLIENKLDQYLLPVVQGSFQNIHAEVGSDKVLVTMIARRCTRRIGTRCWRRGADPEGYAANFVESEQIMQTKGYTASYVQVRGSMPFLWEQIVDLTYKPSFDVVRVEEAARVLERHFHDLQKKYGAVVAIDLVNTTGGEGRLYERYAKSIEPILSEDIRFIHFDFHKICGHIHFERLSQLYDQIEDYLKKHKYFLLDDQGKKIVGQTGTVRTNCVDCLDRTNVTQSMVGRKTLESQLQQLGVLGGNDTISNYPAFDADYKVLWANHGDAISTQYSGTPALKGDFVRYGKRTTQGIFNDLWNALARYYFNNFADGTKQDAMDLLQGHYVSSVSRDIAVPSKPGVMQSFRVAFALILCAAVFMILSLRQARNDLRHLVVALVWAGLCIGIALYVKKNGRKFCNRPRFYLSRN

SEQ ID NO: 16143 - protein, 1007 aa, Oryza sativa
MATRPASRQRRASSAAAAVAVVRSSPQPQQQQQQQLPIPQSGSPTSTTTTTTSSSRLTPELSLDGPASPLFAGLDEDPAPKENVTVTVRFRPLSPREIRQGEEVAWYADGDTVVRSEQNPSVAYAYDRVFAPTTTTRQVYDVAAQHVVSGAMEGVNGTIFAYGVTSSGKTHTMHGDQRSPGIIPLAVKDAFSIIQETPNREFLLRVSYLEIYNEVVNDLLNPAGQNLRIREDPQGTFVEGIKEEVVLSPAHALSLIAAGEEHRHVGSTNFNLLSSRSHTIFTLTVESSPCGESNEGEAVTFSQLNLIDLAGSESSRAETTGVRRKEGSYINKSLLTLGTVISKLTDGKATHIPFRDSKLTRLLQSSLSGQGRVSLICTVTPASSNSEETHNTLKFAHRAKRIEVQASQNKIIDEKSLIKKYQNEIRRLKEELEQLKMGIITGTPVKDAGEDNIILWKQKLEDGNVKLQSRLEQEEEAKAALLARIQRLTKLILVSTKATQTSRFSPHPGPRRRHSFGEEELAYLPYKRRDIVLDNESNELLSPVEGLGMTLEDSKEEKKNRKGILNWFKLRKREGGASILTSSEGDKSSLTKSTAPSTPIGESVNFPSEPRISNSLVGESASVDLFSIGHGEFATDSLHGEETPLASRKTIDHVDLLREQLKILSGEVALHTSVLKRLTEEAGRSPNNEKIQMEMKKVNDEIKGKKHQIASLERQIPHSISNNQGMADKLELTPSYAELLEQLNEKSFDLEVKAADNRVIQDQLNEKTTECMELQEEVAHLKEQLYQTLQAKDSLSNSIMMQKNAGINHETDNHADQELSVPREVPGETSPKEPQSVEIDELKQKVCELIEVKAQLETRNQKLLEESTYAKGLASAAGVELKALSEEVTKLMNQNEKLASELASVRSPTPRRANSGLRGTRRDSISRRHEPAPRRDNNAGYEREKALEAVLMEKEQKEAELQRRIEESKQKEAFLESELANMWVLVAKLKKSQGHDLEDFDTKYIGS

SEQ ID NO: 16144 - protein, 182 aa, Sorghum bicolor
MMDEEHEQQQPVPVPVAAEAAVEKDNKKTAKRNNKVCVFCGSSPGVERGMDLVYGGGCAALMGLVSRAVHDGGGHVLGVVPKAVLPLELIGETPGELKPVAGMHQRKADALPGGYGIHTKPVGLLNVDGYYDPLLAFVDKAVQEGFVTPLERTIIVHANTNSSTSSSSSSTTNINADADADA

SEQ ID NO: 16145 - protein, 668 aa, Sorghum bicolor
MPATAEDSPAIRKLGQLFRLTEVYLWDDSYGAGPHDGRKNWRSAEAALVDSHTDKTCNEASNGTDKGHLFVEDLELANLMGSLGLPVSFSTSKVNKNTGNKGKKKGRQALLKAAKTQINDAVRICANTEDRESAVESLDVMAHMHSCNLSGTPLGHNEPCHDDTDKMLREDSPCVEEQEESGCSTIYSSDKAPSCDAKNLLTELGTFELSDNLGNPAKEDYSIQENQASDSVLLDSEEMPRHDCVDGESTHSCVDIYQEERVSTREDQTSEETLSVSHDHNDVGQEASLSLAEPSSIDEHAQSSANNFYYDYGEWRVVWDPFYSRYYFYNIQTQESTWCPPEGLEDFASYCSPDTTKELVELGSQCTSIAPQENNLATDDNHLEAQEQDHCIHDLSDIPVEKAIYQSMITTSDKAQHTENKYSDSTTIVLEMNQEVTTTKKKKRVRRSQSYHSCQDMAGNISNDIIKYWTQRYSLFSLFDRGIKMDEEGWFSVTPEPIAKHHASRVGAGVIIDCFTGVGGNAIQFATKCKHVIAVDIDPQKIDCAHHNASIYGVNDHIDFIVGDFIHIAPHLKGETAFMSPPWGGPDYAKVDVYDMKSMLLPCDGYSLFKLGTMIASRVVMFLPRNIDLNQLADMSLSVDPPWSVEVEKNFLNGKLKAITAYFEEQDC

SEQ ID NO: 16146 - protein, 839 aa, Helianthus annuus
MDSFGGAYFTDEKAAKVENIFLEFLKSFRLDQNSRELFYESEIEAMRPNESNTMFIDFSHVMRFNDVLQKAISDEYLRFEPYLKNACKRFVMGQKPTFITDDNPNKDINIAFHNLPIIKRLRELSTSEIGRLVSVTGVVTRTSEVRPELIQGTFKCLECGTIVKNVEQQYKYTEPMICMNATCSKKGRWTLLRQESKFADWQRVRMQETSKEIPAGSLPRSLDVILRHDIVEQARAGDTVIFTGTVVVIPDILALAAPGERAEVRREGGQSQRTGGGSVQEGVKGLRALGVRDLSYKLAFIANSVQICDGRRDADIRNRKRDSEDDDTLRFTSEEVDEVTQMRRTPDFFNKLVDSMAPTVYGHQDIKRAILLMLLGGVHKFTHEGINLRGDINVCIVGDPSCAKSQFLKYTTTLVPRSVYTSGKSSSAAGLTATVAKEPETGEFCIEAGALMLADNGVCCIDEFDKMDVRDQVAIHEAMEQQTISITKAGIQATLNARTSILAAANPTGGRYDKSKPLKYNVALPPAILSRFDLVYVMIDDPDDTTDYHIANHIVRVHQKREAAVDPTFTTAQLKRYIAYAKSKKPKLNAEARQLLVDSYVHLRKNDTAPGSRVAYRMTVRQLEALIRLSEAIARCHLDDEVLPRHVSLATKLLKTSVISVESQEIDLTEFQDENIEHGDNEENGDIGENGEAQPGGADADANNMNPENADGAGGKKLVITDEYFQRVTQALVMRLRQHEEMVQREGSGLAGMRQRDLIQWYVKQRNESEAYENEEEAKAEVTKVKAIIESLVRREGHLIVVNEEEVPPQGEDDGNARRPSRNNRILAVAPNYVLDQLD

SEQ ID NO: 16147 - protein, 663 aa, Solanum lycopersicum
MSMNKFGLKVEEGKEGKNGEPSIGPVYRNPIAKNGFPSADPDLSTAWQLFRSAVEKYPGNRMLGWRDFKDGKWGPYNWKTYKEAYEETLQTGSALRAHGIEPGARIGIYGANCPQWIVAMEACSAHSLICVPLYDTLGSGAVDFIIEHAEIDIVFVQDKKVKELLNAECTHAKRLKLIVCFTLLQQEEKDKAVSMNIKPYSWNEFLNMGKENPSEPSPPQPLDICTIMYTSGTSGEPKGVILTHENMTASVTGVDHFMEEFEDKMTVDDVYISFLPLAHILDRMIEEFFFHRGASVGYFHGNINEIQEDMMELKPTFLAGVPRVYEKVHEGVLKALEELNPFRRHMFHVLYNFKLKWMNLGYKQKYASRLADLLAFRKVKNRLGGRIRLIVSGGAPLSTEVEEFLRVTSCGFVLQGYGLTETCGLATIGHPDEMCMLGTVGPPFVFTEVRLEEVPEMGYDPLADPSRGEICVRGRTTFTGYYKNPELTREAIKDGWFHTGDIGEMMPNGVVKVIDRKKNVIKLSQGEYVALEYLEKVYAIAPIVEDIWVYGDSFKSMLIAVVAPHEGNTKKWADKNGHKGSITELCSLQDLNQYVLLELKSAAERNKLRGFENIKGVILEPQPFEFDKELVTATMKKRRERLLKRYKLEIDDLYKRLNAAAKR

SEQ ID NO: 16148 - protein, 289 aa, Phaseolus vulgaris
MDSPLLFSHLKGADPFFLLAGPNVIESEDHILRMAKHIKSIASEVGIPLVFKSSFDKANRTSSKSFRGPGMVEGLKILEKVKIAYDIPIVTDVHETIQCEAVGRVADIIQIPAFLCRQTDLLVAAAKTGKIINIKKGQFCAPSVMANSAEKVRLAGNPNVMVCERGTMFGYNDLIVDPRNFEWMREANCPIVADITHSLQQPAGKKLDGGGVASGGLRELIPCIARTAVAVGVDGIFMEVHDDPLNAPVDGPTQWPLRHLKELLEELVAIAKVSKGKQQFKIDLTPFRE

SEQ ID NO: 16149 - protein, 87 aa, Setaria italica
MALTKCAIAVFLVLAVMSNTSTCCVRAICSGCPTPKPKPGMPCFHAGSSQHPCTTEKCSRLCEHLNHNGTLAYCRSASPGVCCCPNE

SEQ ID NO: 16150 - protein, 407 aa, Gossypium raimondii
MCTSKAKVTTGTTHVEITPPAVARINGRPVLQPTCNRVPSLDRRNSLKKIPPISPPPPASLPFTPSATSTTTVANGSRAKASLTPPLSPSSKFTTTKRWSDPNALNSSSEKVAIPRNTTKTLDRKKSKSFKEGMGNNGLSSYIEPSLSYSSSLLVEAPGSIAAVRREQVALQQAQRKMKIAHYGRSKSAKFESKVVPLDNTKPAEEKKRCSFITPNSDPIYVAYHDEEWGVPIHDDSMLFELLVLSGAQVGSDWTSILKKRQDFRDAFSGFDAETVANFTEKQMTTISSEYGIDISRVRGVVDNANRILEVKREFGSFDKYIWGFVNHKPMSTQYKFDHKIPVKTSKSESISKDMVRRGFRFVGPTVVHSFMQAAGLTNDHLITCHRHLPCALLAIQRPPVHSLPDL

SEQ ID NO: 16151 - protein, 506 aa, Zea mays
MPAAAAPAPHTRTRTRSSGSPSAAIGPPLPYWGGAAVGAEEQRWRIGMDSAAAALLDSASASASSANAAGKEMPTARHIAHRTAHNMSSSSLRKKSDLALLRKVPCAPLRRLLDNLQEVLLATKLALLFPAVLLAIAARIFHFGQEWVFVLSLIGLVPLAERLSFLTEQVAFYIGPTVGGLLNATFGNVTEVIIAIFALYQGKVVVVKCSLLGSVLSNLLLVLGTSLFFGGLANLGTEQLYDKMQVDVSTGLLILGVLCHSLPLMLRYAVSSGEHAESSWDSGLELSRACSIVMLLAYVAYLFFQLKTHRQLFEPQPQEVEDDGDDSVSQDEAVLGFSSAMIWLGVMTLMTALLSEFVVSTIEAASESWELSVSFISVILIPIVGNAAEHAGAVIFAFKNNLDITLGVSLGSATQISMFVVPLSVLVAWIMGVPMDLDFNLLETGCLFLAILVTAFTLQDGSSHYLKGLLLVFFYIVISLCFFVLRQHGNGSNDDQLGVASKPWRI

SEQ ID NO: 16152 - protein, 172 aa, Zea mays
MAASAPAVRPLARAAIPIPLSARPRTARVSLLPLAPPAPAQRLALGRTGQARLPARSRSVRCLAALSPEMRETLDKVVGSSKVLLFMKGTKDFPQCGFSHTVVQILRSLDVPFETLDVLANEALRQGLKEYSSWPTFPQLYIDGEFFGGCDITVEAYKSGELQETLEKAMCS

SEQ ID NO: 16153 - protein, 539 aa, Zea mays
MDSPLMEPLLVPNNHSPGPVVAATPGEHGGAAVDESSTLVDAASGTDESHRALADADVKMNDDGDVQGDELSASVQRRLDESSAVEGEDEEEEIGDDAEADDMAARMGRRLAALPGNAHESEPFTIFRVAGPMRDRNRHLYEPQMISIGPFHRGAGRHLAAMEEHKWRYLRDILARPGGATLASYARAARSMEASARRRYAEPVLLPAAEFAEMLLLDGCFLVEFFLKGQESAEDALIDASWAMQNVYNDMLLLENQLPFFVLERFYDLATGGLGRDYFVTNVLVNYLTVDMCVGPRDPESTRPPDGEIHHLLHLYYYWFLPPEDRDGSGTGSKDKEDGEALEELMSTSADERMPWQLPPASELKDSGVTFRAKKSPRSMVDVTFDRRSGALEIPAVESYTNHAIFANLLAYEQSRGRWELQRLVSYVLLMASVVDARRDVEVLQRAGVFVRGDEETAAFYAHLGELCPPPEFVNNCYADLFRDVLEYCGRSWNRHRAVLVHDYFSNPWTSMSAAAAVFLLVLTVVQTVYTVLPYYSQN

SEQ ID NO: 16154 - protein, 803 aa, Zea mays
MVKFSREYEASIIPEWKAAFVDYRCLKKLVKRIKIARRDATREAGGGSSSDATSSYGFSVLDPVRALAAHFASATPPAVSPANGDEEEEDDDAESLEPDSGELVVVATAKHEREFLEKAGEELEKVNKFYAAQEADMLARGAALVEQLRILADVKRILADHAVASRRSRPAGDSPPPPPSADGRSNSGRHLLSSSSPFLQASPQSMLDGSAELPQARVAEEVMAALERNGVSFVGSGLGSKAKKDGGGKQLTGRAAALPATVRIDVPPTSPGRAALKVWEELVNVLRKDGADPAAAFVHRKKVQHAEKSIRDAFLALYRGLDLLNKFSSLNVKAFTKILKKFVKVSEQQRKTDLFSEKVKRSPFSSSDKVLQLADEVECIFSRHFAGNDRKVAMKYLKPQQPRNTHMITFLVGLFTGTFVSLFIIYSVLAHVAGIFSSTGNTAYMEIVYHVFSMFALISLHVFLYGCNLLAWKSSRISHNFIFDFSPSTALTHRDAFLLSASIMCTVVAALVVNLFLSNAGATYANALPGALLLLSAAALFCPFNVFYRSTRYCFMRVMRNIMLSPFYKVLMADFFMADQLTSQIALLRHLEFTGCYFMAGTFTTHAYGSCTSSSQYKNLAYVLSFLPYYWRAMQCLRRYLEEGHDIDQLANAGKYISAMVAAAVRFKYAAAPTPFWMWMVIVSSTGATIYQLYWDFVMDWGFLDLRSKNRWLRDQLILKNKPIYYASMMLNLVLRLAWAESVMKLRLGMVESRLLDFSLASLEIIRRGHWNFYRLENEHLNNAGKFRAVKTVPLPFRELETD

SEQ ID NO: 16155 - protein, 280 aa, Oryza sativa
MRGGVAGPTAGEPPGTEAEAEEVEESSAGDDEELELGLSLGSKKQQQQQHAPCRILTARDLQPAAALSPDSSVSSSSPAAAAAAGGKRAEGPTATTSPGTVASGHPHSFGVVGWPPIRQFRMNSLFNQAKENTSETDTKKTATNESDVQKDKEEGEKKGRVAGWVKVNMDGEVIGRKVDLNAHRSYKTLALALELMFTKPSIGLCASHNTNSLKLLDNSAEYQLTYEDRDGDWMLVGDVPWEMFVSSVKRLRIMRTSDANGLGQRYQGIHRTIASTRGRS

SEQ ID NO: 16156 - protein, 826 aa, Oryza sativa
MSASEFRIPYQQVSSSQTTENAGQFKICRCGEGDPNTNTSETGDKSPTSCPNCQVLKSGHLLLSSKGIGWTTWKKRWFILTRASLVFFRSDPNAPPRGNEPIVTLGGIDLNNSGSVVVKEDKKLLTVLFPDGRDGRTFTLKAETTEELNEWRSALENALAQAPVVANTVGQNPIFSTDIAEPAEAPAEQSDNKSIIGRPAEFALVDADGSPAFLEKALKFIEDYGVKVEGILRQSADVEEVKRRVRDYEKGKNEFSPEEDAHVIGDCIKYVLREMPSSPVPAPCCTALVGAYRTDKTRRLDAMNRVIYEVFPEPNRQLLQRTLKMMQIVESHKAVNRMSQSALAACMAPLLLRPLLLGECEIDSDFSMAGDGSFQLLQAAAAANHAQAIVIIMLEEYDQIFDDLEDGSYSSDAYTESEDGDFDKEYSTDNDGPEEDDSYDSGEDNIEEDMDDDTEHSSGGSECDNNIKTSVSDDKVKSNNSGTASNGNDQGLQPPKKAARTGHGAVREDTCQIESNDTSNRKQELYESNGSTDQIEKLNVRSSSARAKFMEKSSSSRNKSKKTLWGRTSARKDLSAEEIDYCSDDETLIEKLENSKTDLQSKITKEAKENSILQASLERRKVELHKRRLALEKEVENLRDQLQKERNLRVSLESGLMNLRRGQASFPSTIDNKGSDLRGQLNNQVQMSSASLCDSCNKRLLNTDKLTEGEQSTTSSNVGPNSISDMVSATHMAQRMLISKGEIVKDGQDPLASKWNLAQKQYSNNPLLGRLGSRTEDSGAPSALAKLTNRLNFLKERRAILASEMQNLDLARPPGPPAPAPKRDST

SEQ ID NO: 16157 - protein, 405 aa, Glycine max
MEGSKENCVPRIPLIPSSNLQGPRMKPLLHHRLPLGNISQNVNMPHSQVNKLDLSRKCTAHTIQHHFPQETKKQNLLAPNPSCKLDCDIVDIDDDDGDGSDDAVPVFVKHTEAMLDEIDKIEEVEMEDVEEEPVLDIDACDRKDPLAVVEYIDDIYSFYKDIENSSCVSPNYMTSQLDINERMRAILIDWLIEVHYKFELLEETLFLTVNLIDRFLERQAVIRNKLQLVGVTAMLIACKYEEVTVPTVEDFILITDKAYTRNEVLDMEKLMMNILQFKLSMPTPYMFMRRFLKAAHSDKKLELLSFFLVELCLVECKMLKFSPSLLAAAAIYTAQCSLYQFKQWTKTTKWYTDYSEEKLLECSRLMVTFHQKAGSGKLTGVYRKYNTWKYGCAAKIEPALFLLDN

SEQ ID NO: 16158 - protein, 525 aa, Helianthus annuus
MCDREMCRVEDRDKKRRRFAIGTMGLRKLGEIRVEKLKNSMVNVRSGKMKMMLIRAMTTVLLWICLVQLTALGGSLGPRVLKGWPSCFTQDSHSAAALDVKLLPVHARVLPHKRVYKNNGYLVVSCNGGLNQMRSAICDMVAIARYLNVTLIVPELDKTSFWADPSEFANIFDVDHFITSLRDEVRILKQLPPRLKKRVEMGIVHTMPPVSWSDISYYHNQILPLIQKYKVVHLNRTDARLANNGQPLELQKLRCRVNFRALRFTNQIEELGRRVVKLLRQNGPFLVLHLRYEMDMLAFSGCTQGCNAEEVEDLTRMRYAYPWWKEKIINSDLKRKDGLCPLTPEETALTLRALDIDRDIQIYIAAGEIYGGKRRMDSLAAAYPKLVRKETLLGAADLQYFQNHSSQMAALDYLVSLESDIFVPTYDGNMAKVVEGHRRFLGFKKTILLDRRVLVELIDKYTSGLLGWDEFSSAVKDTHAQRMGNPRKRLVITDRPKEEDYFYANPEECLQPSDDDDEEEAVNIL

SEQ ID NO: 16159 - protein, 757 aa, Helianthus annuus
MTVGAGISVTDRKLNVFGNPVLKDVHDNVFVTSSTGDGMINGAFIGVRSEQTGSRMVFPVGKLEGLRFMCVFRFKLWWMTQRMGNCGQDIPTETQFLIVETSEGSHFGENNEIDDGSHQSALYTVFLPILEGDFRAVIQGNSNNELEICLESGDPAVKEFEGSHLVFVAAGPDPFDVITNAVKSVERHLQTFSHRERKKMPNMLDWFGWCTWDAFYTDVTSEGVKQGLESFQKGGISPKFIIIDDGWQSVGMDPTSVEAKADNTANYANRLTHIKENHKFQKDGKEGHRVEDPSMGLRYVVTDIKDHHNVKYVYVWHALTGYWGGVRPGTGQYDSKLSFPIPSPGIESIENCDAFIAIAKNGLGLVDPEKVFNFYNELHSYLASAGVDGVKVDVQNILETLGAGHGGRVKLTRKYHQALEASVAKNFPDNGIISCMSHNTDGLYSAKRTAVMRASDDFWPHITASHTVHIASVAYNTVFLGEFMQPDWDMFHSLHPMADYHGAARAVGGCAIYVSDKPGHHDFNLLKKLVLPDGSILRAKLPGRPTRDCLFTDPTRDGKSLLKIWNVNNYTGVVGVFNCQGAGWCKDGKKILTHDEQPSTITGVIRAKDVNYLPKVADSTWDGDAVAYSHVGGGLVYLPKNASIPVTLKPREYEVFTVVPISKLSCGVGFAPIGLTEMFNSGGAISEFRYETEKEGNVELKVRGCGVFGAYSTRKPTRVIIDSKETEFGYEERSGLVSIKLSVPEKEMYLWDIIIQV

SEQ ID NO: 16160 - protein, 772 aa, Solanum lycopersicum
MAASSDTVTPSSLRLAFGNVFSLFILILIGVLAFSIRIFSVIKYESVIHEFDPYFNYRVTQFLTKNGIYDFWNWFDDRTWYPLGRVIGGTVYPGLTLTAGTLWWIINSLNIPLSVETVCVFTAPTFSAFAAWATYLLTKEVKGVGAGLTAAALLAMVPSYISRSVAGSYDNEAVAIFALIFTFYLYIKTLNTGSLFYATLNALSYFYMVCSWGGYTFIINLIPMHALLCIVTGRYSSRLYIAYAPLVILGTLLAALVPVVGFNAVMTSEHFASFLVFLILNVVGLVYYIKGMLTPKMFKVAVTLVVSAGLIVCCAVVAVLVALVASSPTKGWSGRSLSLLDPTYASKYIPIIASVSEHQPPTWPSYFMDINVLAFLVPAGIIACFLPLTDASSFVILYLVTSVYFSGVMVRLMLVLAPAACIMSGIALSSAFGVFTRSIKFASTGKQADAGDNGDGVTQNDVVKSDRNEELPKEKASRKKKKEKENVEKVPIANKKSEKRLLMLPMEASFVAILLLVLLGAFYVVHCVWAAAEAYSAPSIVLTSQSHDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSMATPTMLNSLMYKLSYYRFVETDGKGYDRVRRTEIGKKHFKLTHFEEVFTTHHWMVRLYKLKPPKNRIRGKTKKSKSKATSSSSRRSATQKKNPWQ

SEQ ID NO: 16161 - protein, 630 aa, Solanum lycopersicum
MRKHGWQLPYHPLQVVAVAVFLALGFAFYVFFAPFVGKKLFQYIVMGLYTPLIISAFGLYIWCAAADPADPGVFRSKKYIKKLDHEKQVQLKESKLGCETNSSIQDANAASIGENASGKSNKGAEPAADHNETEQKITATRERSFSSGLLALLPCALISNCTGRHEESSQQQLSEDGMFYCSLCEVEVFKYSKHCRVCDKCVDQFDHHCRWINNCIGKRNYRKFFALMVSALLLLILQWSTGILVLICCFIEKKKFSAEITSKLGSSFSIVPFVIVVAVCTILAMIATLPLAQLFFFHILLIKKGISTYDYIIALRDQEQQGVAGQQSPQMSTVSSLTGLSSASSFNTFHRAAWCTPPRLFVEDQYDVVPPDTVSVSSLGKRSMADEPIKKKNPAAVKISPWTLARLNAEDVSKAAAEARKKSKILQSVVRNKEPYILETNSSLGSSGRRMVPRLDNNRRRASKRVRLPAELPFETMSKIPNDIAQNSRRPMLTESSSSLAPLQLEARSDFRTTRGLSTSGVVVASSPESSLDSPDIHPLRMSSSGVEDAARLVGHLSSGMTLQKDTPLSRSTSDGYEASGGEDSDRVPTRIVQRSTRWSSILFGSDQQDDRVRRLMVPSSSTQANIRKH

SEQ ID NO: 16162 - protein, 432 aa, Triticum aestivum
MARDNGDGLAAIAGRIGVLGSVALNIVALAIYLRGRAAAEKQASKKVKKAAAVAPSSGKPPVACDSVINLDHGDPTMFEPFWRGPIGESATLVIPGWQTMSYFSDVGNLCWFLEPSFEREVRRLHRLVGNAAVEGYHVLVGTGSSQLFQAALYALAPPTADTPLSVVSTTPFYSMYPPLTDFLSSGLYRWAGDANTFDGDDYIEVVCSPSNPDGSIREAVLKSKSGKDIHDLAYYWPQYTPITQMLAHDIMLFTVSKCTGHAGTRIGWALVKDKEVAQKMSKFMEQSTIGVSKDAQLRAAKVLGAVTDGYEHQLATAAGGDANLLFHYARRKMAHRWCALRAAVAASGIFSLPNEVAGFCTFTKDTVTSNPAFAWLRCEKQEVEDLESFLRENKIITRSGTKFGADQKVVRISMVDTDEAFGIFVNRLAAIK

SEQ ID NO: 16163 - protein, 532 aa, Triticum aestivum
MAAMMGISALRSHHPLPLSTARPATALPRATSPTSHQPSSLTPLRCRCRCRRSLPHSCCSSSPRASLSPGAPDSAAAFMALAPNNAALRHRLIAPNSTAGSGDAAATGGLPSVVGIAHLAVSLGIVLATDKYLKQAFVAASIKFPSALFGMFCIFSVLLVLDTVAPALAKAFMDFFEPATLFIQRWLPLFYVPSLVVLPLAVRDVPAASGLKICLITFGGWFASLAVAGYTALTVRKIVKTELIAAEPMGKPSTFATLEFWAWGAVFVASFATAFVNPTALGTTARTCLPFMLASTVLGYMVGSGLPPGIKKLLHPIICCALSANLSAVAYGYLSGSGIDAALGDYLTKVPSNPGAGDVLMGFLGSVILSFAFSMFKQRKLVKRHAAEIFTSIAIASTFSLYSTAILGRLIGLEPTLTISILPRCITVALALSIVSFFEGANTSLTAAVVVLTGLIGANFVQAAMDKLGLNDPIARGIGTASSAHGLGTAALSAKEPEALPFCAIAYALTGIFGSLICSSAAVRQSLVFIAG

SEQ ID NO: 16164 - protein, 339 aa, Brassica juncea
MGSTFRDRTAEFRSLYQTLKKIGAIPSVHQPESDPTTSSKRSPPGSSRSEFNKKASQIGLRIHETSQKTARLAKLAKESSIFNDRTLEIQELTVLIRNDITGLNMALSDLQTLQNMEIADGSYSHDKVGHYTAVCDDLKTRFMGATKQFQDVLTARSENMKAHENRKQLFSAKNAGVDKQNNAKAVPEPPPWSSSSTPSGNLQQPLLPPVNSGAPSGSQLRRRSAIENAPSQQMEMSMLQQTVPRQENYSQNRAVALHSVESTITELSGIFTHLATMVTQQGELAIRIDDNMDESLVNVEGARSALLQHLTRISSNRWLMIKIFAVIILFLIVFLFFVA

SEQ ID NO: 16165 - protein, 750 aa, Medicago truncatula
MDPKNNVKNDDPPAESPTSVLEEEEVEVKSEEEVIADDGSSLVPKTMAEEEEKLLKVRVKEEEEKIEVAPNLNDSQFNKLDELLTQTKLYSEFLLEKMDDITMAAGEQEKQDEEESKPVAKKKGRGSKRKAASQCNTGKAKKAVEAMITRSKENVKTEDVDLTEEERTEKEQRELMPLLTGGKLKSYQLKGVKWLISLWQNGLNGILADQMGLGKTIQTIGFLSHLKSKGLDGPYMIIAPLSTLSNWMNEINRFTPTLPAVIYHGNKDQREEIRRKHMPRTVGPKFPLVITSYEIAMNDAKKCLRSYSWKYLAVDEGHRLKNANCKLVRMLKYISVENKLLLTGTPLQNNLAELWSLLHFILPDIFSSLEEFESWFNLSGKCTTGATMEELEEKRRTQVVAKLHSILRPFLLRRMKSDVELMLPRKKEIIIYANMTEHQKNLQDHLINETLGKYLDKKRSIGRAPTSLNNLVIQLRKVCNHPDLLESVFDGSYFYPPVNEIIEKCGKFQLLDRLLERLFARNHKVLIFSQWTKVLDIMDYYFSEKGFEVCRIDGSVKLDDRKRQIQDFNDTTSNCRIFLLSTRAGGLGINLTAADTCILYDSDWNPQMDLQAMDRCHRIGQTKPVHVYRLATAQSVEGRMLKRAFSKLKLEHVVIEKGKFHQERTKPSIMDEMEEEDVLALLRDEETAEDKMIQKDISDEDLEKLLDRSDLVINSSTDDKAAVSTFSLKGPGWEVVMPTAAGGMLSTLNS

SEQ ID NO: 16166 - protein, 1056 aa, Oryza sativa
MAAAIAAAADDSIVYKLSALLEEVRPSAAALRAASEAADAVAGLVKRIPTQQATHEAVAGFVRDLGLAGEKLAFTFRPPEVVRVAGSHAAGGAVARPDVSADLLVRLPKECFHEKDFLNHRYHAKRCLYLHVIEKSLRSSPLIQKISWSTFLDEARKPILHVYPAKEIAELPGFYVRIIPTASFLFNVSKMNLSTRNNVRAYTKDGINLPTPKYNCSILEDMFLEENVEFISSSVADWKALQEALVLLKVWARQRTSIYTHDCLNGYLISAILVFLTVDSAGSMINRSMTSRQIFRVVMKFLATSKMWTKGLVIQPTKKRTITKEDMVCFLKTFDVVICDVSGHVNLASRMTKSAFIELQDEAACALNCLDKCKDGGFEELFMTKVDLGAKFDSCLRINLKGNLKITTSSFCLDDLAWRKLEKDVQSLLQQGLTDRTKMIRVLWRSTPSEWNIMDGFSEFGSSPLLVGIMLSSLEKSFRLVDIGPNPENRDEAIKFRKFWGEKAELRRFKDGTIAESTVWESESWEKHTIIKKIADHVLTKHLSLQKEDLIHVVDQLDFCLLVGGQDPVSSSGALFEAFDSLAKKLRLLGDVPLKISTVQPLDPAFRHTSVFPPEPHPLAYEKRSSQRLPNFTATCMRSLEVMIQLEGSGNWPLDPIAMEKTKSAFLLKMGESLEDQGMFVTASEDEVNVLTSGYSFLLKIFHERGLLLQKRDGDGKAQNVPSEDKELFLRSQHSSMINGLHGRYQVYGPVVRLAKRWISAHLFSSFISEEAVELLVAYLFLKPYPFNVPSSRVAGFLRFLRLLSSFDWTFSPMIIDINNDFNLKDEKEINENFMLCRKSYEQNPHDIEPAMFLATSYDKASEAWTRHSPSKPVLKRMASYAKSSAELLTNLIIQGQSGQYTWECVFRTPLSNYDAVVLLHQEKLCRPHQVLFPAETPNGKLVICGKPCKDFHPYMPLNKGVVKSLHDSREKILVNFDPTTYFLRDLKSAFPKTFKLWYDSIGGDAIGLTWENSKKRGRDEADETMLDPASILKEVGNVGKGLVRGVYLLKAPKLQ

SEQ ID NO: 16167 - protein, 846 aa, Oryza sativa
MGKSSSKKKKDKVILPPQLPPEVDDDDVVVSDEDVEFFRGNEGHARALATLDRKSIDSYVTRVAHHDEDEVERLYEERERRRKAVEALRPKNHDDDDFEVDRVDALPVKTLQGELVYNNAKKARFDDSSNNVESKSEDKVGNSKQTIQKGERKEKSKSKKGDGKLQNVQAQTEASNGKLQSKVLEEVKEELSAEELFEKKKAQLAEIGMSMLEDPESHIRSLNDMLNICNDKDQKVVKLSLMSLLAVFRDIIPSYRIRQLTEKELTVEVSKDVKKMRYYEYTLLRSYKAYLQKLISLEKQPNFSALAVRCMCTLLDTAPHFNFRESILASVARNLSSPDDAVRKMCCETIRSLFVDEGKHRGEATVEAVRLIADHVKLNDCQLHPDSIEVFLSLRFDDDLGKDDTEEEKGKPKKNKRRQNQEVPKQLPVSDNKKAKQELISKAREEVDAELRSVSFTLDPKERRRIQKEALSALFETYFRILKHSMSISNSRGKVINVSPDGSHPLLAPCLEGLGKFSHLIDLDFMGELVACLKKLSGYTDHHSGTVHDNTLSVSERLQCCIVAFKVWRSNLEALNVDLQDFFVQLFNLILEYRPDRDRGEVLADALKTLLWEGKQQDMIRAAAFIKRLATFALSFGSAEAMAALITLKHLLQKNSKCRNMLENDSGGGSLSCLVAKYDPEAKDPYLSGALASVLWELSLLQKHYDSSVSSMASNILSMANLNPTQNPVPISNASPLEAYRDLSMERKLSKPANKLLPLNCRKKRRGKEFVALSPAALEGSDCVAGGDELKEKLKNHFAVLRGISENERLRAELNHTLSSINLYKEYKKQKKSRKSKAVKKKVSRA

SEQ ID NO: 16168 - protein, 1174 aa, Oryza sativa
MIKPRVNWSDHANAVQSSCIKDEFLSSSFLFSLPTQRPNQEADCTGMLPLRSAACRIQGLERLQAPSIEKAWRSLRNTQVARKNYLRPGLSGKVKDCDSDHAHTYGTSSSYNVNKMDSVSRNRNPTQESMHQTTESGTMEKNSSHLPAGTKSCTRTYLNNHVVQADTITTTNQSLARTGPELFKTAPFIDNMCDDAKLDAMDEDELLASIDVDRIVMEHYQATNTPRGSSKSPLEKCNFNGFDENNLPQELSIMCDHGSKLAFCPEAKSHLLEMKDNLLAISHELIDGQLSPQQSDDLHQKRALLKKQIELLGEYTARLTQDEERQQSHSMASTTAHQGHHPTSILSSSFVKDTNIFQSPIYTRNEPGESGLCFSSAPYSYMDGLSMPLPSVQRDYTPRAIDISYTEGSGDKQWSSTHFAWTKELEANNKRVFGNRSFRPNQREIINATMSGNDVFVLMPTGGGKSLTYQLPALICNGVTLVVSPLVSLIQDQIMHLLQANISAAYLSASMEWSEQQEILRELMSPTCTYKLLYVTPEKIAKSDALLRQLENLYSRGHLSRIVIDEAHCVSQWGHDFRPDYQHLGILKQKFPQTPVLALTATATASVKEDVVQVLGLANCIIFRQSFNRPNLRYFVWPKTKKCLEDIHNFIHANHNKECGIIYCLSRMDCEKVAAKLREYGHTASHYHGSMDPEDRANIQKQWSKDRINIICATVAFGMGINKPDVRFVIHHSLPKSIEGYHQECGRAGRDSQLSTCVLFYNYSDYIRLKHMVTQGFAEQGTSAPRGGSSQEQALETHKENLLRMVSYCENDVDCRRLLQLIHFGEMFNPSCCAKTCDNCLKELRWVEKDVTNIARQLVDLVMMTKQTYSTTHILEVYRGSVNQNVKKHRHDTLSLHGAGKHLAKGEAARILRHLVIEEILIEDVKKSENYGSVSSVLKTNHKKSGDLLSGKHNVVLKFPTPEKAPKMGVLDESSVPRINKTNQQSQVDGSLAAELYEALQCLRTQIMDENPQLLAYHIFKNETLKEISNRMPRTKEELVEINGIGKNKLNKYGDRVLATIEDFLARYPNATRKTSSGGSNEHSEAVKKRRGFSVTNTSTNCDDFEERTVQSKKRAAKTRTRQEISDAASIVQDVRYIDLELDGCEQVNEVPYSVQKPVASGRVLPAWQSARIA

SEQ ID NO: 16169 - protein, 1001 aa, Glycine max
MSNPQDQKPWKAEYAKSGRSSCRTCKSPIASETLRLGKMVQSTKFDGLMPMWNHAACILKKANQIKLLEDVENLESLRWEDQQKIRKYIESGGGGGGGGGGSSSSGSAAKSDSKTVKDTKCGIEVSQNSRATCKDCGQKIIKGEVRISTKPGGQGAKGLAWHHAKCLMELSPSIDVYKLSGWNNLSSSDQSAVSDFAKKGGSDTKIETEEGKESTQQQTSKGGIKRGKDVDSERKSKVAKAKGDVSVGSAMLVKSGEACDLEKKMETQSKELWDLKDDLKKHVTTTELREMLEANGQDSSGSEIDLRDRCADGMMFGALGLCPICSGFLRYSGGMYRCHGYISEWSKCSYSTCEPNRIEGKWKIPEETNNQYLKKWFKSQKGKKPVRILPLPSPRKSAESQMIASQHHHSSNSENLRDLKVAICGLPNDSIAEWKRKIDGIGGVFHAKVNKDTNCLVVVGSLNDEAEMRKARRMKKPIVREDYLIDCIERKKRLPFDMYKVEMIGETSSMVTIKVKGRSAVHEASGLQDSGHILEEGKSIYNTTLNMSDLSTGTNSYYILQIIEEDKGSDCFVFRKWGRVGNDKIGGTKLEEMSKSDAICEFKRLFYEKTGNPWEAWEQKTIQKQPGRFFPLDIDYGVNKQVPKNKKNDADSKLPPPLIELMKMLFNVETYRAAMMEFEINMSEMPLGKLSKSNIQKGFEALTEIQNLLKISNPDPSVKESLLINASNRFFTMIPSIHPHIIRDEDDFKSKVKMLEALQDIEIASRLVGFDANNDDSIDDNYKKLHCDISPLPHDSEEFCLIEKFLQNTHAPTHTDWSLELEEVFSLEREGESDKFAPYRDKLGNRMLLWHGSRLTNFVGILNQGLRIAPPEAPATGYMFGKGVYFADLVSKSAQYCFTDKKNPVGLMLLSEVALGNVYELKKAKYMDKPPEGKHSTKGLGKKMPQESEYVKWRGNVTVPCGKPVPSNVKSSELMYNEYIVYNTAQVKMQFLLKVRFHHKR

SEQ ID NO: 16170 - protein, 635 aa, Solanum lycopersicum
MAAKVAAAGMVHQSDALNFGGGSSKVTTTTLKRKTPSELRGEQLKKKNIVELVDESTVPNGGPMSGLFPGPKRCDVSKNPRYVDTRVDELFPARKSSIRLKLVSIKENGKENFQAENSDNTKNCSIPSAFPTENQQRSKCPKFSLASSVTGKDHATETCSTSERCSENTFRSVTELSLGSVDVHGLSTVDMDKALRGLATHEHLGAAAKIAESFETDGGIRSKNFCPEFHVPCKMTPLDLTMKTNIRVVSSSSINWFHRLINCGANNVVARSSVNCFTKLKMTSLSEVTSVSQAINPMSLHSWMYPQSPLPPSVISALTLSASVGGQLDFLSERQLAWQDSFRSLYYMLRKNVCSIFYVCTAQFVIMFTSSYSEENKYVCNAYISQSTRGLRSLLKEHDVSYSMPLCHSKLEELNTEELVELSEIEKQNLGQTRRRSAMCDVDNRPDSLLAFTGNKNVHSLYDFLLNYRYFLTSLTGVDVPELYSPIPFENAALTAPEVKCKEVRRIDQAAFQGMESNVTCEPNQQPSSGMCYSVEIKGRYLAPWVTSAICDAFCSNSTSFEASFITEPASVNLNASLGITGKRSDPQVSATEAMDKDNLCFGIPNTKSCSQMNSGFLKGLKYNGGSYTAFLSPV

SEQ ID NO: 16171 - protein, 930 aa, Solanum lycopersicum
MGSVEEKNKPGSLVSGAHTLLEEMKLLKEMQDHTGGGRKLISSELWHACAGPLVTLPQVGSLVYYFPQGHSEQVAVSTNRTATSQIPNYPNLASQLLCQVHNVTLHADKETDEIYAQMSLQPVNSEKDVFPIPDFGLKPNKHPTEFFCKTLTASDTSTHGGFSVPRRAAEKLFPPLDYSMQPPTQELVVRDLHDNTWTFRHIYRGQPKRHLLTTGWSMFVGAKRLRAGDSVLFIRDEKSQLLLGVRRANRQQTSLPSSVLSADSMHIGVLAAAAHAAANRSTFTIFYNPRACPSEFVIPLAKYRKSIYNTQLSVGMRFGMMFETEESGKRRYMGTISGISDLDPLRWPSSKWRCLQVEWDEPGCGDKQNRVSPWEVETPESLFIFPSLTAGLKRPYQSTFLGAQTEWDSLMQHRPFMRVPENVYGDLQSSSISNLWSEQLMKMLIRPPPGLTGLQCGVPTVQDIKVALPQEARNVVQPAGNQKPELITVEATPAQSETNSEVVLNQPVGVVNSISSQQATLQAKSKPPEKVETDIIGKNSEPRKETSNSSVKLDQFQCNEDKVAIKPASPHDLPTDASVTASHHNSFSQLQASPWLIPHNPQIDSAASNNILQCPTNNEWNMSSLQSAAGLLKYPVSTSTLTKHDNSFMLPDTIGHGLAPIGQDLWDHQLNDVKCFSQTNLQVPLDITNMQFLPDSYGFKDLSEESHNQSDIYSCLNFDSNSGSTVIDNSVSSTVLDEFCNLKHTDFQNPSDFLLGNISSSQDVQSQITSASLADSQNFSVQEFADNSGGASSSNVNFDECNLLQNSSWQQVAPRVRTYTKIQKTGSVGRSIDVSGFKNYEELRSEIERMFGLEGLLNDTRGSSWKLVYVDFENDVLLVGDDPWEEFVGCVRCIRILSPTEVQQMGEEGMQLLNSAGLQSINGSTSEFPN

SEQ ID NO: 16172 - protein, 1012 aa, Solanum lycopersicum
MSDIRKWFMKQHDKGTGNGSMSKNSAAEKPSPTSPKPENLVQEGQETANRRKTSKYFATDKVKAKEEKVEEVSAKRKAPNAAGISSAPAAKRIHKAEDEDDFVPVVSAMGSRDVTPSKKSVSGSGRGSAQKNVISDDSDDDLKNKNSDLKSAGRGRGGRAAKTSGKGVPLDESEDDASAVKDNKSGGRGRGGKGPSAAPSGGRGRGGGGRGGFMNFGERKDPPHKGEKEVPEGAPDCLAGLTFVISGTLDSLEREEAEDLIKRHGGRVTGSVSKKTTYLLCDEDVEGRKSSKAKELGTAFLTEDGLFELIRSSKKSKSATQPESKKSVDTIVSSGKRNSQKTSDGTGSTATKILAAKQLAPSASPAKISGSPAKSSASPAKKKTQAKESLLPWTEKYRPKAIVDIIGNKSLVEQIQRWLESWDEHFLKASSKGKGKKQADSGAKKAVLLSGMPGIGKTTSAKVVSQLLGFQTIEVNASDSRGKADSKIEKGIGGSTANSIKELVSNESLSANVGRSHHQKTVLIMDEVDGMSAGDRGGVADLIASIKISKIPIICICNDRYSQKLKSLVNYCLPIVFRKPTKQQMAKRLNQVANAEGIQVNEIALEELAERVGGDMRMALNQLQYMSLSKSVIQYDDIRRRLLSSSKDEDISPFKAVEKLFDFNSKNLKIDQRIDLSMSDPDLVPLLVQENYLNYKPSSAGKDDNDLKRMSLIAHAADSIANSDLINVQIRRYQQWQLSPAGCLSSCIIPASLLHGQRQTLEQGERNFNRFGGWLGKNSTMGKNYRILEELHVHLLASRESYLGRANLRLDYFSLLGKKLTDPLKVLPKDEAVENVVAFMDSYSISQEDFDNIVEISKFKGQPNLLDGVQPAVKAALTKAYNKGSKSRVIRTADLITLPGIKKAPKKRVAAMLEPLDEGVAEENDETLAEDEENSSDTEDIDVGKKLQSDLQSLSSRGIEVNMDLKGAGSSGSKKTSAGRGRGRGSSNSSATAESSGKRGGRGSGAAAKRKR

SEQ ID NO: 16173 - protein, 980 aa, Phaseolus vulgaris
MASATSFPGISLRPSVPFRSHISHTRFAQFQVSFGFPANPTSLKSLNSVPSKKREAFSNGSSRTRRNLSQFSVRCTVSSSGKITQQEFTEMAWQAIVSAPEVAKENKHQIVETEHLMKALLEQKNGLARRIFSKVGVDNTRLLEATDKHIKRQPKVLGESAGTMLGRDLEALVQRARDFKKEYGDSFVSVEHFVLGFSQDKRFGKILFRDFQISEQALKSAIESIRGRQSVIDQDPEGKYEALEKYGKDLTAMAKAGKLDPVIGRDAEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVFVDQPSVEDTISILRGLRERYELHHGVRISDSALVDAAILSDRYISGRFLPDKAIDLVDEAAAKLKMEITSKPTALDEINRSVLKLEMERLSLVNDTGKDSKDRLNRLETELSLLKEKQDEMTGQWEHEKSVMTRLQSIKEEIDRVNLEIQQAEREYDLNRAAELKYGSLNSLQRQLESVEKELHEYMNSGKSMLREEVTGNDIADIVSKWTGIPISKLQQSEREKLLYLEEELHKRVVGQDPAVKAVAEAIQRSRAGLSDPHRPIASFMFMGPTGVGKTELAKALASYLFNTEDALVRIDMSEYMEKHTVSRLIGAPPGYVGYEEGGQLTETVRRRPYAVILFDEIEKAHSDVFNVFLQILDDGRVTDSQGRTVSFTNTVIIMTSNVGSQYILNTDNDTVPKESAYETIKQRVMDAARSIFRPEFMNRVDEYIVFQPLDRDQISSIVRLQLERVQKRIADRKMKIQVTEAAIQLLGSLGYDPNYGARPVKRVIQQNVENELAKGILRGELKEEDTILVDTEVTAFSNGQLPQQKLVFRRVGTDSESSSTVKDSREGFPQIL

SEQ ID NO: 16174 - protein, 940 aa, Oryza sativa
MVKAYLRYEPAISFGVVASPESNVAYDPSGRLLLAAALDRFAAWDLKRGLPSLSFATAAPSPSLAVSCLATFPSAASASASSIASGHADGSIRLWDTETGSCEATLHGHRSAASALVFGPSGAIIASGSKDCDIILWDVVGQAGLYRLRGHRDQVTGLVFLDSGKKLVSCSKDKLIRVWDLDTQHCLQIVGGHRSEIWSIDVDPSERFLVSGSADQELRVFTVRKSAEEGEDWSKWDMLKLFGEIPRQSKERVATVKFNKNGNLVACQVAGKTVDIYRVLDETEAARKAKRRMHRKKEKALAKSMAAEGNGTVIDPLSAQDLQNPTPVVTDIFKLLHVLRVNKKICSVAFSPNNPPKGCLATLSLSLNNNMLETYSVDNENVSNMYSIEMHGHRSDIRSLALNSEDNLLMSTSHNAVKIWNPSTGDCLRTIDSDYGLCSAFVPGNRYALVGTKSGTLEIIDINSGSSIEVIEAHAGSIRSIVLIPNEDGTAGAWGFVTGSADHDVKFWEYQLMQKSDNDSKQLSVTNVKTLKMNDDVLAVTISPTGNHIAVALLDGAVKVFTMDSLKFALTLYGHKLPVLCMDISSDGVLIVTGSADKNLKIWGMDFGDCHKSIFAHTDSVMDVKFVSKTHYMFSVGKDRTVKYWDADKFELLLTLEGHHAEVWCLAISSRGDFIVTGSHDRSIRRWDRTEEQLFIEEEQEKRLEETFEADLDSAMDHKYGQKDGAPDEGSVGVPGRKTKETVTAADAIIDALDTAEEEVKRLDQHQEGQNNGNGTTFQPNVIMQGQSPSDYVLNVVSNVRPNDLEQALLSLPFSDALKIMSYLKEWSMVPLKVELVCRVCLVLLQTHHSQLTTTPSARSILTELKGILYSRVKECKDAIGFNLAAMDHIKELLAMRSDAPFRDARAKLMEIRQEQSRRSDRSDGAEKRKKKKRRTSGES

SEQ ID NO: 16175 - protein, 442 aa, Solanum lycopersicum
MEAINAVRLTPLSVRSDRKNEAKKIPSHPISFPFKNLCSVENLSRNVQGGLVLVSSVLNTGLAKALTYEETIEQSETIPGAEFDATAVVETVTTFASENPIIIAGGFAALALPIVLFQVLGKPPKSWGVESAKTAYAKLADDAGAQLLDIRATAELREVGTPDIRGLKKKPVTVVYKAEDKTGFLKKLSLKFKEPENTTLFILDKFDGNSELVAELVTENGFKAAYAIKDGAEGPRGWLNSSLPWILPKKTLGLDLSNLSDALDGVLGEGSDAVTVGLGVAAATGLGILAFSEVETILQLLGSAALVQLVSKKLLFAEDRKKTLQQVDEFLTTKVAPKELVDEIKQIGKALLPDSVSSNALPAPVEASPAAATSTVEETESVPKEDIAPPKVEAISPPTPEVSSVPNAEVKADALPESSRPLSPYPNYPDLKPPTSPMPSQP

SEQ ID NO: 16176 - protein, 664 aa, Solanum lycopersicum
MEGVDYLADERKKAGFDVDEMKIVWAGSRHDFELTDRISKLVASDPGFSKEGRTMLPRKELFKNTLRKAAYAWKRIIELRLSQEEATMLRRYVDEPAFTDLHWGMFIPAIKGQGTDKQQEKWLPLAYKMQIIGCYAQTELGHGSNVQGLETTATFDPQTDEFVIHSPTLTSSKWWPGGLGKVSTHAVVYARLITDGKDYGVNGFIVQLRSLEDHKPLPGVTVGDIGMKFGNGAYNSMDNGVLSFDHVRIPRDQMLMRVSQVTKEGKYVQSDIPRQLLYGTMVYVRQSIVADASLAMSRAVCIATRYSAVRRQFGSQNGGQETQVIDYKTQQNRLFPLLASAYAFRFVGEWLKWLYTDVTQRLAANDFSTLPEAHACTAGLKSLTTSATADGIEECRKLCGGHGYLCSSGLPELFAVYVPACTYEGDNVVLQLQVARFLMKTISQLGTGKKPVGTVSYMGRIEHLMQCRSDVKQAEDWLKPSAVLEAFEARSARMSVACAKNLSKFENQEEGFAELAADLVEAAVAHCQLIVVSKYIEKLQQNIPGKGVKQQLEVLCGIYSLFILHKHQGDFLGTGYITSKQGSLANDQLRALYSQLRPNAVSLVDAFNYTDHYLGSILGRYDGNVYPKLYEAAWKDPLNKSDIADGFHEYIRPLLKQQLRTAKL

SEQ ID NO: 16177 - protein, 500 aa, Sorghum bicolor
MAAAILAPKPPPSLPTSAFPSSFPSPSRLCLSPRHPLTRLLLRPIPCASSPSSSVLMPDPDPDLEPEPAHDRDRAQDEAPESRPRRIALFVEPSPFAYVSGYKNRFQNFIKYLREMGDEVIVVTTHEGVPQEFHGAKLIGSWSFPCPWYQKVPLSLALSPRIIGEVARFKPDIIHASSPGIMVFGALIIAKLLCVPLVMSYHTHVPIYIPRYTFSWLVKPMWLIIKFLHRAADLTLVPSVAIGRDLQAAHVTAANKIRLWNKGVDSESFHPRFRDMEMRSRLTNGEPEKPLIFYVGRLGVEKSLDFLKRVMDRLPGARIAFIGDGPFRAELEQMFSGMPAVFTGTLQGEELSQAYASGDVFVMPSESETLGFVVLEAMSSGIPVVGARAGGIPDIIPEDQEGKTSFLYTPGDVDDCVGKIGQLLSSEELREAMGRAARKEMEKFDWRAATRKIRNEQYSAAIWFWRKKRAQLLRPLQWALRLLRPTTSGAAIADAMAKQS

SEQ ID NO: 16178 - protein, 925 aa, Helianthus annuus
MVSSHLTPILYLTLLLVTFSCVCSKTSKPPVAPTKIGNGYRLVSLQESPDGGLVGHLQVNKQNKIYGPDIPHLQLYIKHETDDRLRVHITDAQNQRWEVPYNLLPRTQPPTPSQQPFTRTLKNPITVSESSGNELIFSYISNPFSFAVRRKSNGQTIFNSSSDGSNSLVFKDQYIEISTTLPKTASLYGLGENSQPHGIKLYPNDPYTLWTTDQSAINLNMDLYGSHPVYMDMRNVGGDPYAHGVLLLNSNGMDVFYRGDSLTYKVIGGVLDFYFFAGPTPLAVVDQYTQLIGRPAAMPYWSLGFHQCRWGYHNLSVVEDVVENYKKANIPLDVIWNDDDHMDGHKDFTLNPNAYPRPKLLDFLQRIHARGMKYIVIIDPGIGVNTSYGTYQRGLAKDVFIKYEGKPYLAQVWPGAVNFPDFLNPATVAWWGDEVRRFHELVPVDGLWIDMNEASNFCSGLCTLPEGKQCPTGTGPGWICCLDCKNITKTRWDDPPYKINASGTHVPIGYKTIATSAVHYNGVREYDAHSIYGFSHAIATHKALQGLEGKRPFILSRSTFVGSGHYTAHWTGDNQGTWNDIKYSIYTMLNFGIFGIPMVGSDICGFYPQPTEELCNRWIELGAFYPFSRDHANYYSPRQELYQWETVATSARNALGMRYKLLPYLYTLTYEAHTTGAPIARPLFFSFPTIQELYGLSTQFLLGESLMVSPVLDQGRTNVSAVFPPGTWYSLFDPSQAIVSKDTQTFTLDAPLHVINVHLYQNTILPMQRGGMISKEARMTPFTLIVTFPAGATDAKAKGKLFLDNDELPEMQLGNGQSTYVEFSASTSKEMVKVWSDVQESKFALDKGWVIEKICVLGLSGVGSAFSIEVEGNSDILDVSNVELAQTEHKFIYGAEDMKSVMVEVGGLDLPVGKKFTMSWKMGIS

SEQ ID NO: 16179 - protein, 269 aa, Setaria italica
MVADTESSDSLPGSSNAAAETPVHGSLDQRSQEKTPKKTHKAEREKLKRDQLNELFLELGSMLDLDRQNTGKATVLGDAARVLRDLVTQVESLRKEQSALLSEQQYISSEKNELQEENATLKSQISELANDLCARMGSSSLSLSSPGMSHPVANATSPDLATHPMPHHMWGNIPNLSSVAMAHQTTTVSPVHSQHHSANDVEVYAPPPQELQLFPGTSSSPEHECSGIRSAATNSSSLTDSLPGQLCLSLTQSSQEESSSGVLGRRKER

SEQ ID NO: 16180 - protein, 503 aa, Setaria italica
MVAAVRAAPALADKPPGLAMLEVAAAAGEDRLSDAETASSTAAPNSSLSSASSAGSLPRCSSLSRLSFDCSPSAALAAAACSPPPAPTASRPHRSGDAAWAAIRAASTSSAAPLGPRDFKLLRRVGGGDIGTVYLCRLRSPAAAAGRESPCHLYAMKVVDRRVVARKKKLERAAAEKRILRALDHPFLPTLFADFDAAPHFSCVVMEFCPGGDLHSLRHRMPSRRFPLPSARFYAAEVLLALEYLHMMGIVYRDLKPENVLIRADGHIMLTDFDLSLESTSSPSLESAAGNDAAAAGDASTSASCFPDHLFRLKRRRRRAAARQTTTFVAEPVEARSCSFVGTHEYVAPEVARGGPHGAAVDWWAYGVFLYELLHGRTPFAGADNESTLRNIARRPLAFPPGSGSCGPADAAARDLIARLLDKDPAHRLGSRRGAADVKAHPFFKGLNFALLRASRPPVVPGSSPLHRSQSCHAAPPPTTTTPGSTLPRKKPMPTADARFDLF

SEQ ID NO: 16181 - protein, 464 aa, Sorghum bicolor
MGVAGGGGRLRASSAKKQRQRTLNNIKITLLCGFITVLVLRGTAGFNLLISGGDLDGAAAAAADAKVVEDVERILAEIRSDSEADDVVFVVEDDGSSLPSSPRRNETAASFGNFSASATVVKVREYSLGPKLTDWDAQRREWMSRHPEFPALDPRRGGRPRVLLVSGSPPGPCDNPVGDHYLLKSTKNKIDYCRLHGIDVVHNMAHLDPELTGYWSKLPLVRRLMLAHPEVEWIWWMDSDAIFTDMAFELPLSRYDGANLVIHGYPDLLFEKRSWIALNAGIFLLRNCQWSLDLLDAWVPMGPRGPSRVEAGKLLTASLTGRPAFEADDQSALIHLLLMQKERWMDKVHVETEFYLHGFWTGLVDRYEEMMEEHHPGLGDDRWPFITHFVGCKTCGRYEDYPLDRCVRGMERAFNFADNQVLRLYGFRHRSLTTAKVRRVTDPATNPLMAKEAALKMDAKFSSN

SEQ ID NO: 16182 - protein, 753 aa, Glycine max
MTRVVQMSVDGDSKELKELNQRLRDGKKIAGGEHGLCEEVKCNGIAEEVKVEQGGTVESSSVQQHIPQPQGAIICWERFLHIRSLKVLLVEIDDSTRHVVTALLRNCSYEVIEAANGLQAWKILEDLTNHIDLVLTEVAMPGLSGIGLLYKIMGHKTRKNIPVVMMSSHDSMGLVFKCLSKGAVDFLVKPIRKNELKNLWQHVWRRCHSSSGSGSESGTQTQKSIKSKSLEKSDNNSGSNDEDDNESIGLNNVDGSDNGSGTQSSWTKRAVEVDSHKPVSQWDQIAECPDSTCAQVVHSNAEMGGNKVVPLAAKDCAEQNEQLVKTAGSQHSNAPDVGPSKFSEQINRGQLDLNCENQSSKLRCKGLSLSDAITSTCDSQMHSGEFEALNKKPKSSDIENKGTNNDEELPSLELSLKRLRGVEDADITIQDDRNVLRRSDQSAFSRYNAASNTKKSPTGCVGSNSPYNNSLEVTKKDSSRDIQSHSCGNPPNQNSNGASNNIDMGSTTNNAYAKSAVMSEPAGASTTKCLYQTSAFQPVKNSLVCTSQQVVLNNTEDMSATILAPPKLDRHKDSAALDFHLHCENHNCIADNMKHQLPPDHDAESIKKMATAAPHCGSSNVEEVLVEGNVGNHSINRSVSGSNNGSNGQNGSSTAVNAGGTNTESNNGLTGNSGSGDASGSGSANRVDQNKTSQREVALTKFRQKRKERRERCFHKKVRYQSRKRLAEQRPRFRGQFVRQTSNENASEATTDS

SEQ ID NO: 16183 - protein, 280 aa, Glycine max
MEKASLCHRNTPLPLLNRPSNFLQFKHQNSFLKFPNPNLHRLRRLNCSVSDGTVSSSLGATDSSLAVKKKAAEVSSELKGTSIFLVGLKSSLKTSLGKLLADALRYYYFDSDSLVEEAVGGALAAKSFRESDEKGFYESETEVLKQLSSMGRLVVCAGNGTVTSSTNLALLRHGISLWIDVPLDFVARDVIEDKSQFAPSEISISGSYPEVQDELGALYDKYRVGYATADAIISVQKVVSRLGCDNLDEITREDMALEALREIEKLTRVKKMQEEAARPF

SEQ ID NO: 16184 - protein, 479 aa, Populus trichocarpa
MGLGSEEGKVKSSWDVCKSKERRKKKKDGTEAGCWVKLRFIGSCISSRSKVDSSVSGTSTHFESKSTNDTSIDQPAAPVVSTSTTSNTESNSSTSKLEEELKVASRLRKFTFNDLKFATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLAFLHEETERPVIYRDFKTSNILLDADYNAKLSDFGLAKDGPEGDKTHVSTRVMGTYGYAAPEYVMTGHLTSRSDVYSFGVVLLEMITGRRSMDKNRPNGEHNLVEWARPHLGERRRFYRLIDPRLEGHFSIKGAQKAAQLAAHCLSRDPKARPLMSEVVNALKPLPNLKDMASTSYYFQTMQAERVGSSPNARNGVHSQAGLLSRNGHQQRSLSIPHGSHASPYHYQYLHKSPKPNGKP

SEQ ID NO: 16185 - protein, 527 aa, Gossypium raimondii
MALLHSYFLSAGEYVSGSTVLAVAMSIASYFLIPMVFGGRHKNWKNAPPGPVGWPILGSLPHLSNRLHEDFFDMAKIYGPLFSLNLGIKPAIVVSSPEMAAQVLKEKEGMFSSRTITETIRVISYDAHSIIFSPYGPRWKVLRRILITELLSPKAFEQFEPLRTSQVHGLLKYLYLVSKSNTQVNIAEYAFTALANLVSNFVCSKDLFDNSMPEGRKMKERFWELIKVIGTPNFSDLIPIVKPFDPQGLKRKINKIFGQLDAFYEKLIEERLAEKGKAQLDGTIPYKRKMDMLDVLLSYESNDKENGLDRLPKSIVKGMLSEMFIAGTETTSSTVEWGMAEILRKPSVLKKLLLELDQVVGKDRFVVESDIPKLAYLQAVVKEVFRLHPGVPLIIPRRTNEACEVAGYHIPKHCIVYVNVWGMARDPNVWEDPLEFKPERFIGSSVDVKGQDFNLLPFGTGRRSCVGWPLAHRMVHYYLAALLHAFQWESPPDVLNDLGERVGLTIQKGKSLLSTPKPRLPASVYER

SEQ ID NO: 16186 - protein, 527 aa, Gossypium hirsutum
MALLHSYFLSAGECVSGSMVLAVAMSIASYFLIPMVFGGRHKNWKNAPPGPVGWPILGSLPHLSNRLHEDFFHMAKIYGPLFSLNLGIKPAIVVSSPEMAAQVLKEKEGMFSSRTITETIRVISYDAHSIIFSPYGPRWKVLRRILITELLSPKAFEQFEPLRTSQVHGLLKYLYLVSKSNTQVNIAEYAFTALANLVSNFVCSKDLFDNSMPEGRKMKERFWELIKVIGTPNFSDLIPIVKPFDPQGLKRKINKIFGQLDAFYEKLIEERLTEKGKAQLDGTIPYKRKMDMLDVLLSYESNDKENGLDRLPKSIVKGMLSEMFIAGTETTSSTVEWGMAEILRKPSVLKKLLLELDQVVGKDRFVVESDIPKLAYLQAVVKEVFRLHPGVPLIIPRRTNEACEVAGYHIPKHCIVYVNVWGMARDPNVWEDPLEFKPERFIGSSVDVKGQDFNLLPFGTGRRSCVGWPLAHRMVHYYLAALLHAFQWESPPDVLNDLGERVGLTIQKGKSLLSTPKPRLPASVYER

SEQ ID NO: 16187 - protein, 530 aa, Theobroma cacao
MDLLHSSILSVIAHFSSLVSGSMMILAVTMSIASYFLIPILLGGRSKNWKNAPPGPVGWPILGSLPHLSHRLHEDFFHLAKIHGPLFCLKMGIKPAIVISSPEMASEILKEKEGMFSSRTITEAIRVVSYDAHSIIFSPYGPRWKALRRILITELLSPKAFEQFEPVRTTQVHGLLKYLYILSKSSTQVNIAESAFTALANLVSNILCSKSLFDNSKPEGRKMKEMFWEMIKVLGTPNFSDLIPIVKPFDLQGLKRKISGIFDQLDAFYEKLIEERLAEKGTAELQRGNNETMDMLDVLLSYKSNDKENGLDRFSRAIIKGMLSEMFIAGTETTSSTVEWGMTEILRKPSVHKKLLLELDQVVGKNRFVVESDIPNLPYLQATVKEVFRLHPGVPLIIPRRTNEACEVAGYHIPKHCIVYVNIWGIARDPKVWEDPLEFKPERFIGSSVDVKGQDFNLLPFGTGRRSCVGWPLAHRMVHYYLAALLHAFEWDSPPEILRDMNERVGLTLQKDKSLLGTPKPRLQASVYEH

SEQ ID NO: 16188 - protein, 710 aa, Brachypodium distachyon
MPALLRPLVPLLLLLLAAVTTTAAPATSHSQPTLPRPGAGASHSEPAPAQTLPPPAATLASTPPPAATQASLLAAFLAKADPSSHLRPPLTSSPCTRPGVTCAGAGGSNQITHLVLESAGLNGTFPPGTLSALAELRVLSLKSNALHGPIPDLSALSNLKALFLAGNRFSGPFPSSLASLRRLRSIDLSGNRLSGELPPGIEAAFPHLTALRLDANRFDGSVPAWNQSSLKLLNVSYNNFSGPVPVTAAMALMGAAAFAGNPGLCGEVVRRECRGSHLLFFHGGGNNGSAADPPVQSSDATPQGEGISLPDSPAGPRTLRVKRRTAMAVAVGLSAFLAVLLVCAVIAARRGKKRRRPSSAAYPSPKKSAAASQVSRELDNADVGYVECVPDEETAAMMMPEEKARRLGRSGCLTFCAGEATSYTLEQLMRASAEVLGRGSVGTTYKAVLDGRLVVIVKRLDAAKIGPAASEAEAFEQNMDVVGRLRHPNLVPLRAFFQAKEERLLVYDYQPNGSLHSLIHGSRSSQAKPLHWTSCLKIAEDVAQGLAYIHQASRLVHGNIKSSNVLLGSDFEACLTDNCLSFLLESSEIKDDAAYRSPENMNSNRRLTPKSDVYAFGVLLLELLSGKAPLEHSVLVATNLQTYALSAREDEGMDSERLSMIVDIASACVRSSPESRPTAWQVLKMIQEVKEADTTGGNDDSHDSDLTSNS

SEQ ID NO: 16189 - protein, 843 aa, Brachypodium distachyon
MGGGPRTFPGGLSKWQYKRMHEKLARQKQRGLLRHEKQLYLARLRSEIRASHLPGAADAAAASPDLGGGPTSSRAHIRALADRFLRPGAEDLWNEDDGPLRRAKTLPRTQPARSLPSGARIVDWKQMDSGKKPSQGGSGDWKDWEELHVEQPRVRRGTGVGGSEPRLAAFNTRREYGTVAPWWWQWSSGSGTPSQRKEASFGFFGLKRCYSVMHPCSPHRESSPTLMPLGASQSTGARNGKETSLAMFNQERLYSVAARRFGQKWRPDSSDEDDDGISTAKRDLRFGKFGAPREEESEDDEPREASTIRRKWSTAALRNCDMKKDRRALKSYEEESNDLTGRIQELREEIRNREVLGAERRRYESRGESLFTSKRFDECGISPLTVKALTDAGYVQTTVVQEAALPICLEGKDVLVKAKTGTGKSAAFLLPAIESVLNAMKSHTNHRVSPIFALVLCPTRELAVQVTAEANVLLKNHQGVGVQSLIGGTRFKLDQRRLESDPCQILVATPGRLLDHIENRSSFSVRLMGLKLLVLDEADHLLDLGFRKDIEKIADSLPRQRQTLLFSATVPKEVRRVSQLVLNRDHVFVDTVGLGAVETPIKVQQQYLVVPHELHFHMVHRLLREHIDQEVNYKVIVFCSTAMVTEFMYIMLRDLKLNVREIHSRKPQLYRTRISEEFRDSSRLILVTSDVSARGLNYPDVTLVIQVGVPPGREHYIHRLGRTGREGKSGKGILLIAPWEEYFLNEITDLPIEKAQVPHIDQETKQKVDDSIKIVDMSIKEAAYHAWLGYYNSIADVGRDKSMLADLASRFCVSIGVEKPPALYRKTALKMGLKDVPGIRIRK

SEQ ID NO: 16190 - protein, 726 aa, Triticum aestivum
RMVDWKQVESGEKLKPPRGGGDWKDWEELDSGEPTAGRGAGNEQRLPAAFNQRRGYGTAAPWWWQWSPGSGTPSQRKEASFGFFGPKRCYSVMPPCSPCRESGAALMPLVARQLAEAGDGRNATPLALFYTQERLYSVAAPRRFGQKWRPDSSDEDEEVMPAARDLRLAKFVASREDESEDDEPGETSAIRRKWSTAALRNCDMKRDRRPLKSYEEESDDDITGRIQELREEIRNREVLGAERRRYESRGESVFTNKRFDECGISPLTVKALTDAGYIQTTVVQEAALPVCLEGKDVLVKAKTGTGKSVAFLLPAIESVLNAMKSHTNHRVSPIFALVLCPTRELAVQVTAEANVLVKYHHGVGVQSLIGGTRFKLDQRRLESDPCQILVATPGRLLDHIENRSSFSVRLMGLKLLVLDEADHLLDLGFRKDIEKIADSLPRQRQTLLFSATVPKEVRRVSQMVLNKDHVFVDTVGLGAVETPTKVQQQYLVVPHELHFHMVHRLLREHIDQEVDYKVIVFCTTAMVTEFMYIMLRDLKLNVREIHSRKPQLYRTRISEEFRDSNRLILVTSDVSTRGVNYPDVTLVIQAGVPPGREHYIHRLGRTGREGKSGKGILLIAPWEEYFLKEIHDLPIQKAPVPQIDQEMKQKVDDSIKIVDMSIKEAAYHAWLGYYNSIADISRDKVMLADLASRFGVSIGMEKPPMLFRKTALKMGLKGVPGIRIRK

SEQ ID NO: 16191 - protein, 384 aa, Hordeum vulgare
MGREKSRRLSGSRDFRQRLVLATLTSTPIVIKDIRAGEGGLRPHEMSLLHLLDKVSDQHAIDVNDTGKGAPTPPPRTKVGYKPGVIVGGKDLEHDCGVHRGIGYFIEPLVLLGLFARSPLSIRLKGITNDAKDPSVDTFRMVTLHMLKHFGVPLEGLELKIECRGTPPCGGGEVLLRVPNINSTLKAVNWVDEGMVKRIRGVTFATKVSPQIGTRIVYAARGLFNKFIPDVHIFTDHRVGLSGGLSTGYGLSVVAETTTGCLISADSSVSYPNVDKMSEQSKKPELMSPEDLGEQVASMLLEEVAQGGVVDSTHQGLLFMLCALCPPDVSKVRVGQLTPHAIESLRNIKEFLDVKFIIKPDPNSNTVILKCVGAGVKNLARKIS

SEQ ID NO: 16192 - protein, 375 aa, Triticum aestivum
MGREKSRRLSGSRDFRQRLVLATLTSTPIIIKDIRAGEGGLRPHEMSLLHLLDKVSDQHVIDVNDTGTKVGYKPGVVLGGKDLEHDCGVHRGIGYFIEPLILLGLFARSPLSIRLKGITNDTKDPSVDTFRMVTLHMLKHFGVPLEGLELKIENRGAPPRGGGEVLLRVPNINSTLKAVNWIDEGMVKRIRGVTFSTNVSPQIENRILYAARGLFNKFIPDVHIFTDHRAGLSGGLSAGYGVSVVAETTTGCLISADATVSYPNVDEMSEQSKKPELMSPEDLGEQVASMLLEEVAQGGVVDSTHQGLLFMLCALCPPDVSKVRVGQLTPHAIESLRNIKEFLDVKFIIKPDPNSNTVTLKCVGAGVKNLARKIS

SEQ ID NO: 16193 - protein, 367 aa, Secale cereale
GRDKPRRLSGSRDFRQRLVLATLTSTPITIKDIRAGEGGLRPHEMSLLRLLDKVSDRHVIDVNDTGTKVGYRPGVVVGGKGLEHDCGAHRGIGYFIEPLLLLGLFARSPLSVRLKGITNDSKDPSVDTFRMVTLHMLKHFGVPLEGLELKIESRGAPPHGGGEVLLRVPNINSTLKAVNWVDEGMVKRIRGVTFSTNVSPQIVTRIFYAARGLFNKFIPDVHIFTDHRAVSSGGCGLSAGYGLSVVAETTTGCLISADATVSYPNVDEMSEQSEKPEVMSPEDLGEQVASMLLEEVAQGGVVDSTHQGLLFMLCALCPPDVSKVRVGQLTPRAIESLRNIKEFLDVKFIIKPDPNSNTVTLNVLVRE

SEQ ID NO: 16194 - protein, 376 aa, Avena sativa
MGRDKTRRLSGSRHFRQRLVLATLTSTPVTIVDIRADGTPGLRDHEVSLLRLLDKISDHSDVEINETGTKLRYKPGVIIGGKDLEHDCGLQRGIGYFLEPLILLGLFARSPISIRLKGITNDTKDPSVDTFRMVTLHMLKHFGVPLEGLELKIESRGAPPLGGGEVLLRVPNINSTLTAVNWVDEGMVKRIRGVTFSTRVSPQIENRILYAARGLFNKFIPDVHIFTDHRSGSSGGRSPGYGVSVVAETTTGCLISADATVSYTNVDEMSKESEKPELMSPEDLGEQVASMLLEEVAQGGVVDSTHQGLLFLLCALCPPDVSKVRVGQLTPYAIETLRNIRDFLDVKFIIKPDPNSNTVTLKCVGAGVKNLARKIS

SEQ ID NO: 16195 - protein, 376 aa, Lolium multiflorum
MGREKTRRLSGSRHFRQRMVLATLTSAPVTIVDIRADGTPGLREHEVSLLRLIDKISDHSDIEINETGTKLRYKPGVIIGGKDLEHDCGLQRGIGYFLEPLILLGLFGRSPLSIRLKGITNDTKDPSVDTFRMVTLHMLKHFGVPLEGLELKIESRGASPLGGGEVLLRVSNINSTLTAVNWVDEGMVKRIRGVTFSTRVSPQIENRILYAARGLFNKFIPDVHIFTDHRSGASGGRSAGYGVSVVAETTTGCLISADATVSHTNVDELSTESEKPELMSPEDLGEQVASMLLEEVAQGGVVDSTHQGLLFMLCALCPPDVSKVRVGQLTPYAIETLRNIRDFLDVKFIIKPDPNSNTVTLKCVGAGVKNLARKIS

SEQ ID NO: 16196 - protein, 375 aa, Brachypodium distachyon
MGRDKARRLTGSRHFRQRMVLATLTSTPIAIEDIRAGDAGLRAHEVSLLRLIDKISDHHSFELNETGTKLRYKPGVIVGGRDLEHDCGVHRGIGYFLEPLILLGLFSRSPISIRLKGITNDTKDPSVDTFRMVTLHMLKHFGVPLEGLELKIENRGAPPLGGGEVHLRVPNINSTLTAANWIDEGMVKRIRGVTFSTRVSPQIENRILYAARGIFNKFIPDVHIFTDHRSGSSGGRSAGYGVSVVAETTTGCLISADATVSYPNIDEMSKESEKPELMSPEDLGEQVAKMLLDEVAQGGVVDSTHQGLLFILCALCPPDVSRVRVGQLTPHAIETLRNIRDFLDVKFIIKPDPNSNTVTLKCVGAGVKNLARKIS

SEQ ID NO: 16197 - protein, 377 aa, Oryza sativa
MGRDKARRLSGSRHFRQRVVLATLTSTAITIDDIRSGGAAPGLRPHEVSLLHLLHKISDHHSLDLNETGTKLRYKPGVIVGGRDLEHDCGVHRGIGYFLEPLILLGLFARAPISIRLKGITNDTKDPSVDTFRMVTLHMLKQFGVPLEGLELKIESRGAPPLGGGEVFLRVPNIKSTLKAANWADEGMVKRIRGVSFSTRVSPQIENRIIYAARGIFNRFIPDVHIFTDHRSGSAGGRSAGYGVSVVAETTTGCLLSADATVSYPNVDEMNEESENLELTSPEDLGVQVASMLLEEVAQGGVVDSAHQGLLFILCALSPPDVSKVRVGQLTPYAIETLRNIRDFLDVKFIIKPDPNSNTVTLKCVGAGVKNLARKTS

SEQ ID NO: 16198 - protein, 375 aa, Brachypodium distachyon
MGRNKARRLSGSRHFRQRLVLATLTSSPIAIEGIRAGGGGLRPHEVSLIRLVDMISDHHSIELEVTGTKLTYKPGVIVGGRGLEHDCGVDRGIGYFLEPLVLLGLFARSPVSIRLKGITNDTKDPSVDTFRMVTLHMFKHFGVPLEGFELKIESRGAPPLGGGEVHLRVPNISSTLTASNWIDEGKVKRIRGVTFSTRVSPQIENRILYAARGVFNKFILDVHIFTDHRSGSSGGRSAGYGVYLVAETTTGCLISADATVCYPNVDEMSEESENPELMSPEDLGDQVAKMLLDEVAQGGVVDSTHQGLLFIMCALCPPDVSRVRVGQLTPHAIETHQNIKDFLDVKFIIKYDPNSYTVTLKCVGAGVKNLAWKIS

SEQ ID NO: 16199 - protein, 161 aa, Secale cereale
MAEQTEKAFLKQPKVFLCSKKTTKGNNKPGKEGNRFWKSVGLGFKTPKEAIEGTYIDKKCPFTGTVSIRGRIIAGTCHSAKMNRTIIVRRNYLHYVKKYQRYEKRHSNIPAHISPCFRVREGDHVIIGQCRPLSKTVRFNVLKVVPAGSKSGAVKKAFTGA

SEQ ID NO: 16200 - protein, 161 aa, Triticum aestivum
MAEQTEKAFLKQPKVFLCSKKTTKGNNKPGKEGSRFWKSVGLGFKTPKEAIEGTYIDKKCPFTGTVSVRGRIIAGTCHSAKMNRTIIVRRNYLHYVKKYQRYEKRHSNIPAHISPCFRVREGDHVIIGQCRPLSKTVRFNVLKVVPAGSKSGAVKKAFTGA

SEQ ID NO: 16201 - protein, 161 aa, Brachypodium distachyon
MAEQTEKSFLKQPKVFLCPKKITKGNNKPGKQGNRFWKSVGLGFKTPKEAIEGTYIDKKCPFTGTVSIRGRIIAGTCHSAKMNRTIIVRRNYLHFVKKYQRYEKRHSNIPAHISPCFRVREGDHVIIGQCRPLSKTVRFNVLKVIPAGSKSGAVKKAFTGA

SEQ ID NO: 16202 - protein, 160 aa, Sorghum bicolor
  Sequence also found in Organisms: Cenchrus ciliaris, Setaria italica, Saccharum officinarum
MAEQTEKAFLKQPKVFLCSKKAAKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 16203 - protein, 160 aa, Echinochloa colona
MAEQTEKAFLKQPKVFLCPKKVTKGNKPGKGGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 16204 - protein, 160 aa, Echinochloa colona
  Sequence also found in Organisms: Setaria italica
MAEQTEKAFLKQPKVFLCPKKAAKGNKPGKGGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 16205 - protein, 160 aa, Panicum virgatum
MAEQTEKAFLKQPKVFLCPKKATKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 16206 - protein, 160 aa, Pennisetum glaucum
  Sequence also found in Organisms: Panicum virgatum
MAEQTEKAFLKQPKVFLCPKKAAKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 16207 - protein, 160 aa, Saccharum officinarum
MAEQTERAFLKQPKVFLCSKKAAKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 16208 - protein, 161 aa, Pennisetum glaucum
MAEQTEKAFLKQPKVFLCPKKAAKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGGAVKKAFTAA

SEQ ID NO: 16209 - protein, 160 aa, Zea mays
MAEQTERAFLKQPKVFLCSKKATKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPVSKTVRFNVVKVIPAGSKSGAVKKAFTAA

SEQ ID NO: 16210 - protein, 160 aa, Oryza sativa
MAEQTERAFLKQPKVFLCPKKTTKGKKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAGKKVFTAA

SEQ ID NO: 16211 - protein, 159 aa, Gerbera hybrid cultivar
MAEQTEKAFLKQPKVFLCSKKSGKGKRPGKGGNRFWKSVGLGFKTPREAIEGTYIDKKCPFTGDVSIRGRILAGTCHSAKMVRTIIVRRNYLHYVKKYQRYEKRHSNIPAHISPCFRVKEGDHVIIGQCRPLSKTVRFNVLKVIPAGSSGGGKKAFTGI

SEQ ID NO: 16212 - protein, 158 aa, Bupleurum chinense
MAEQTEKAFLKQPKVFLCSKKSGKGKRPGKGGNRFYKSVGLGFKTPREAIEGTYIDKKCPFTGDVSIRGRILAGTCHSAKMMRTIIVRRNYLHYVKKYQRYEKRHSNIPAHISPCFRVKEGDHVIIGQCRPLSKTVRFNVLKVIPAGSSGGGKKAFTG

SEQ ID NO: 16213 - protein, 159 aa, Cannabis sativa
MAEQTEKAFLKQPKVFLSSKKSSKGKRPGKGGNRFWKSVGLGFKTPREAIEGTYIDKKCPFTGTVSVRGRILAGTCHSAKMVRTIIVRRNYLHFVKKYQRYEKRHSNIPAHISPCFRVKEGDHVIIGQCRPLSKTVRFNVLKVVPAGSSGGGKKAFTGL

SEQ ID NO: 16214 - protein, 159 aa, Cannabis sativa
MAEQTEKAFLKQPKVFLCSKKSSKGKRPGKGGNRFFKSVGLGFKTPREAIEGTYIDKKCPFTGTVSVRGRILAGTCHSAKMVRTIIVRRNYLHFVKKYQRYEKRHSNIPAHISPCFRVKEGDHVIIGQCRPLSKTVRFNVLKVVPAGSSGGGKKAFTGI

SEQ ID NO: 16215 - protein, 159 aa, Daucus carota
MAEQTEKAFLKQPKVFLCSKKSGKGKRPGKGGNRFYKSVGLGFKTPREAIEGTYIDKKCPFTGDVSIRGRILAGTCHSAKMMRTIIVRRNYLHYVKKYQRYEKRHSNIPAHISPCFRVKEGDHVIIGQCRPLSKTVRFNVLKVIPAGSSGGGKKAFTGI

SEQ ID NO: 16216 - protein, 159 aa, Citrus clementina
  Sequence also found in Organisms: Citrus sinensis
MAEQTEKAFLKQPKVFLSSKKAGKGKRPGKGGNRFWKSIGLGFKTPREAIEGTYIDKKCPFTGTVSIRGRILAGTCHSAKMNRTIIVRRNYLHFVKKYQRYEKRHSNIPAHISPCFRVKEGDHVIIGQCRPLSKTVRFNVLKVIPAGSSGGAKKAFTAM

SEQ ID NO: 16217 - protein, 159 aa, Linum usitatissimum
MAEQTEKAFLKQPKVFLSSKKSSKGKRPGKGGNRFWKSVGLGFKTPREAIEGTYIDKKCPFTGTVSIRGRIIAGTCHSAKMMRTIVVRRNYLHYIKKYQRYEKRHSNIPAHVSPCFRVKEGDHVIIGQCRPLSKTVRFNVLKVVPAGSSGGGKKAFTGM

SEQ ID NO: 16218 - protein, 159 aa, Petroselinum crispum
MAEQTEKAFLKQPKVFLCSKKSGKGKRPGKGGNRFYKSVGLGFKTPREAIEGTYIDKKCPFTGDVSIRGRILAGTCHSAKMVRTIIVRRNYLHYVKKYQRYEKRHSNIPAHISPCFRVKEGDHVIIGQCRPLSKTVRFNVLKVIPAGSSGGGKKAFTGI

SEQ ID NO: 16219 - protein, 159 aa, Ananas comosus
MAEQTEKAFLKQPKVFLCSKKSGKGKRPGKGGNRFWKSIGLGFKTPREAIEGTYIDKKCPFTGTVSIRGRILAGTCHSAKMNRTIIVRRNYLHYVKKYQRYEKRHSNIPAHISPCFRVKEGDHVIIGQCRPLSKTVRFNVLKVIPAGSTGGGKKAFTAA

SEQ ID NO: 16220 - protein, 161 aa, Eragrostis curvula
MAEQTEKAFLKQPNVFLSSKKSGKGKKPGKGGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVVPAGSTGGSGGKKAFTAA

SEQ ID NO: 16221 - protein, 159 aa, Acacia harpophylla
MAEQTEKAFLKQPKVFLCSNKSGKGKRPGKGGNRFWKSIGLGFKTPREAIEGTYIDKKCPFAGTVSIRGRIIAGTCHSAKMTRTIIVRRNYLHFVKKYQRYEKRHSNIAAHISPCFRVKEGDHVIIGQCRPLSKTVRFNVLKVIPAGSSGGVKKAFTGA

SEQ ID NO: 16222 - protein, 159 aa, Theobroma cacao
MAEQTEKAFLKQPKVFLSSKKSGKGKRPGKGGNRFWKSIGLGFKTPREAIEGTYIDKKCPFTGTVSIRGRILAGTCHSAKMMRTIIVRRNYLHYIKKYQRYEKRHSNIPAHISPCFRVKEGDHVIIGQCRPLSKTVRFNVLKVIPAGSSGGGKKAFTGI

SEQ ID NO: 16223 - protein, 159 aa, Centaurea maculosa
MAEQTEKAFLKQPKVFLCSKKSGKGKRPGKGGNRFWKSVGLGFKTPREAIEGTYIDKKCPFTGDVSIRGRILAGTCHSAKMVRTIIVRRNYLHFVKKYQRYEKRHSNIPAHISPCFRVREGDHVTVGQCRPLSKTVRFNVLKVIPAGSSGGGKKAFTGI

SEQ ID NO: 16224 - protein, 159 aa, Gossypium hirsutum
  Sequence also found in Organisms: Gossypium raimondii
MAEQTEKAFLKQPKVFLSSKKGGKGKRPGKGGNRFWKSIGLGFKTPREAIEGTYIDKKCPFTGTVSIRGRILAGTCHSAKMVRTIIVRRNYLHYIKKYQRYEKRHSNIPAHISPCFRVKEGDHVIIGQCRPLSKTVRFNVLKVIPAGSSGGGKKAFTGM

SEQ ID NO: 16225 - protein, 159 aa, Vigna unguiculata
MAEQTEKAFLKQPKVFLCSKKSGKGKRPGKGGNRFWKSIGLGFKTPRDAIEGTYIDKKCPFTGNVSIRGRILAGTCHSAKMNRTIIVRRNYLHFIKKYQRYEKRHSNIPAHISPCFRVKEGDHVIIGQCRPLSKTVRFNVLKVIPAGSSSGAKKAFTGM

SEQ ID NO: 16226 - protein, 159 aa, Cucurbita pepo
MAEQTEKAFLKQPKVFLCSKKGGKGKRPGKGGNRFWKSIGLGFKTPREAVEGTYIDKKCPFTGTVSIRGRILAGTCHSAKMVRTIIVRRNYLHYVKKYQRYEKRHSNIPAHISPCFRVKEGDHVIIGQCRPLSKTVRFNVLKVIPAGSSSSGKKAFTGI

SEQ ID NO: 16227 - protein, 159 aa, Cucurbita pepo
  Sequence also found in Organisms: Momordica charantia
MAEQTEKAFLKQPKVFLSSKKSGKGKRPGKGGNRFWKSIGLGFKTPREAIEGTYIDKKCPFTGTVSIRGRILAGTCHSAKMVRTIIVRRNYLHYVKKYQRYEKRHSNIPAHIAPCFRVKEGDHVIIGQCRPLSKTVRFNVLKVIPAGSSTAGKKAFTGI

SEQ ID NO: 16228 - protein, 159 aa, Curcuma longa
MAEQTEKAFLKQPKVFLSSKKTGKGKKPGKGGNRFWKNIGLGFKTPREAIEGTYIDKKCPFTGTVSIRGRILAGTCHSAKMNRTIIVRRNYLHFVKKYQRYEKRHSNIPAHISPCFRVKEGDHVIIGQCRPLSKTVRFNVLKVIPAGSTSGGKKAFAAV

SEQ ID NO: 16229 - protein, 159 aa, Curcuma longa
MAEQTEKAFLKQPKVFLSSKKSGKGKKPGKGGNRFWKNIGLGFKTPREAIEGTYIDKKCPFTGTVSIRGRILAGTCHSAKMNRTIIVRRNYLHYVKKYQRYEKRHSNIPAHISPCFRVKEGDHVIIGQCRPLSKTVRFNVLKVIPAGSTSGGKKAFVAA

SEQ ID NO: 16230 - protein, 159 aa, Flaveria ramosissima
MAEQTEKAFLKQPKVFLCSKKSGKGKRPGKGGNRFWKSIGLGFKTPREAIEGTYIDKKCPFTGDVSIRGRILAGTCHSAKMVRTIIVRRDYLHYVKKYQRYEKRHSNIPAHISPCFRVKEGDHVIIGQCRPLSKTVRFNVLKVIPAGSASGGKKAFTGI

SEQ ID NO: 16231 - protein, 159 aa, Flaveria ramosissima
MAEQTEKAFLKQPKVFLCSKKSGKGKRPGKGGNRFWKSIGLGFKTPREAIEGTYIDKKCPFTGDVSIRGRILAGTCHSAKMVRTIIVRRDYLHYVKKYQRYEKRHSNIPAHISPCFRVKEGDHVTIGQCRPLSKTVRFNVLKVIPAGSSSGGKKAFTGV

SEQ ID NO: 16232 - protein, 160 aa, Zingiber officinale
MAEQTERAFLKQPKVFLSSKTSGKGKKPGKGGNRFWKNVGLGFKTPREAIEGTYIDKKCPFTGTVSIRGRIIAGTCHSAKMNRTIIVRRNYLHYVKKYQRYEKRHSNIPAHISPCFRVKEGDHVIIGQCRPLSKTVRFNVLKVIPAGSTSSRGKKGFTAV

SEQ ID NO: 16233 - protein, 159 aa, Panax ginseng
MAEQTEKAFLKQPKVFLCSKKAGKGKRPGKGGNRFHKSVGLGFKTPREAIEGTYIDKKCPFTGDVSIRGRILAGTCHSAKMIRTIIVRRNYLHYVKKYQRYEKRHSNIPAHVSPCFRVKEGDHVIVGQCRPLSKTVRFNVLKVIPAGSSGGGKKAFTGI

SEQ ID NO: 16234 - protein, 159 aa, Humulus lupulus
MAEQTEKAFLKQPKVFLSSKKSSKGKRPGKGGNRFWKSVGLGFKTPREAIDGTYIDKKCPFTGTVSVRGRILAGTCHSAKMVRTIIVRRNYLHFVKKYQRYEKRHSNIPAHISPCFRVKEGDHVIIGQCRPLSKTVRFNVLKVVPAGSSGGGKKAFTGL

SEQ ID NO: 16235 - protein, 159 aa, Zea mays
  Sequence also found in Organisms: Sorghum bicolor, Saccharum officinarum
MAEQTEKAFLKQPKVFLSSKKSGKGKKPGKGGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVVKVIPAGSAAAGKKAFTAA

SEQ ID NO: 16236 - protein, 160 aa, Medicago truncatula
MAEQTEKAFLKQPKVFLCSKKSGKGKRPGKGGNRFWKSVGLGFKTPREATEGTYIDKKCPFTGNVSIRGRILAGTCHSAKMNRTIIVRRNYLHFIKKYQRYEKRHSNIPAHVSPCFRVKEGDHVIIGQCRPLSKTVRFNVLKVIPAGSSSGAGKKAFTGM

SEQ ID NO: 16237 - protein, 160 aa, Elaeis guineensis
MAEQTERAFLKQPKVFLCSKKAGKGKRPGKGGNRFWKSIGLGFKTPREAIEGTYIDKKCPFTGTVSIRGRILAGTCHSAKMNRTIIVRRNYLHYVKKYQRYEKRHSNIAAHISPCFRVKEGDHVIIGQCRPLAKTVRFNVLKVIPAGSKSGGGKKAFSAI

SEQ ID NO: 16238 - protein, 159 aa, Arachis hypogaea
MAEQTEKAFLKQPKVFLCSKKSGKGKRPGKGGNRFWKSIGLGFKTPRDAIEGTYIDKKCPFTGTVSIRGRILAGTCHSAKMNRTIIVRRNYLHFIKKYQRYEKRHSNIPAHISPCFRVKEGDHVIIGQCRPLSKTVRFNVLKVIPAGSSSGAKKAFAGI

SEQ ID NO: 16239 - protein, 159 aa, Cajanus cajan
MAEQTEKAFLKQPKVFLCSKKTGKGKRPGKGGNRFWKSIGLGFKTPREAIEGTYIDKKCPFTGNVSIRGRILAGTCHSAKMNRTIIVRRNYLHFIKKYQRYEKRHSNIPAHISPAFRVKEGDHVIIGQCRPLSKTVRFNVLKVIPAGSSSGAKKAFTGI

SEQ ID NO: 16240 - protein, 159 aa, Cajanus cajan
MAEQTEKAFLKQPKVFLCSKKGGKGKRPGKGGNRFWKSIGLGFKTPRDAIEGTYIDKKCPFTGNVSIRGRILAGTCHSAKMNRTIIVRRNYLHFIKKYQRYEKRHSNIPAHISPCFRVKEGDHVIIGQCRPLSKTVRFNVLKVIPAGSSSGAKKAFTGL

SEQ ID NO: 16241 - protein, 159 aa, Vicia sativa
MAEQTEKAYLKQPKVFLCSKKSGKGKRPGKGGNRFWKSVGLGFKTPKEATEGTYIDKKCPFTGNVSIRGRIIAGTCHSAKMNRTIIVRRNYLHFIKKYQRYEKRHSNIPAHVSPCFRVKEGDHVIIGQCRPLSKTVRFNVLKVIPAGSSSGAKKAFGGI

SEQ ID NO: 16242 - protein, 161 aa, Oryza sativa
MAEQTEKAFLKQPKVFLSSKKSGKGKKPGKGGNRFWKSIGLGFKTPREAIEGTYIDKKCPFTGTVSIRGRIIAGTCHSAKMNRTIIVRRNYLHFVKKYQRYEKRHSNIPAHVSPCFRVKEGDHVIIGQCRPLSKTVRFNVLKVIPAGSTGGSGGKKAFTAA

SEQ ID NO: 16243 - protein, 161 aa, Pennisetum glaucum
  Sequence also found in Organisms: Cenchrus ciliaris
MAEQTEKAFLKQPKVFLSTKKADKSKKPGKAGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVVKVIPAGSTGGAGGKKAFTAA

SEQ ID NO: 16244 - protein, 159 aa, Glycine max
MAEQTEKAFLKQPKVFLSSKKTGKGKRPGKGGNRFWKSIGLGFKTPREAIEGTYIDKKCPFTGNVSIRGRILAGTCHSAKMNRTIIVRRNYLHFIKKYQRYEKRHSNIPAHISPAFRVKEGDHVIIGQCRPLSKTVRFNVLKVIPAGSSSGAKKAFTGM

SEQ ID NO: 16245 - protein, 159 aa, Ambrosia trifida
MAEQTEKAFLKQPKVFLCSKKSGKGKRPGKGGNRFWKSIGLGFKTPREAIDGTYIDKKCPFTGDVSIRGRIIAGTCHSAKMVRTIIVRRDYLHYVKKYQRYEKRHSNIPAHISPCFRVKEGDHVTIGQCRPLSKTVRFNVLKVIPAGSSSAGKKAFTGI

SEQ ID NO: 16246 - protein, 160 aa, Aristolochia fimbriata
MAEQTEKAFLKQPKVFLSSKKSGKGKRPGKGGNRFWKSIGLGFKTPREAIEGTYIDKKCPFTGTVSVRGRILAGTCHSAKMMRTIIVRRNYLHWVKKYQRYEKRHSNIPAHISPCFRVKEGDHVIIGQCRPLSKTVRFNVLKVIPAGSSAGAGKKAFTGM

SEQ ID NO: 16247 - protein, 159 aa, Arnica chamissonis
MAEQTEKAFLKQPKVFLCSKKSGKGKRPGKGGNRFWKSVGLGFKTPREAIEGTYIDKKCPFTGDVSIRGRILAGTCNSAKMVRTIIVRRDYLHYVKKYQRYEKRHSNIPAHISPCFRVKEGDHVTIGQCRPLSKTVRFNVLKVIPAGSSGGGKKAFTGI

SEQ ID NO: 16248 - protein, 159 aa, Artemisia annua
  Sequence also found in Organisms: Chrysanthemum coronarium
MAEQTEKAFLKQPKVFLCSKKSGKGKRPGKGGNRFWKSVGLGFKTPREAIEGTYIDKKCPFTGDVSIRGRILAGTCHSAKMVRTIIVRRDYLHYVKKYQRYEKRHSNIPAHISPCFRVKEGDHVTVGQCRPLSKTVRFNVLKVIPAGSSGGGKKAFTGI

SEQ ID NO: 16249 - protein, 160 aa, Musa acuminata
MAEQTEKAFLKQPKVFLCSKKSGKGKRPGKGGNRFWKSIGLGFKTPREAIEGTYIDKKCPFTGNVSIRGRILAGTCHSAKMNRTIIVRRNYLHYVKKYQRYEKRHSNIPAHISPCFRVKEGDHVIIGQCRPLAKTVTFNVLKVIPAGSTSGGGKKAFAAV

SEQ ID NO: 16250 - protein, 160 aa, Musa acuminata
MAEQTEKAFLKQPKVFLCSKKSGKGKRPGKGGNRFWKSIGLGFKTPREAIEGTYIDKKCPFTGNVSIRGRILAGTCHSAKMNRTIIVRRNYLHYVKKYQRYEKRHSNIPAHISPCFRVKEGDHVIIGQCRPLAKTVGFNVLKVIPAGSTSGGGKKAFAAV

SEQ ID NO: 16251 - protein, 159 aa, Theobroma cacao
MAEQTEKAFLKQPKVFLSSKKSGKGKRPGKGGNRFWKSIGLGFKTPREAIEGTYIDKKCPFTGTVSIRGRILAGTCHSAKMMRTIIVRRNYLHYIKKYQRYEKRHSNIPAHISPCFRVKEGDHVIIGQCRPLSKTVRFNVLKVIPAGSSGGGKKAFAGM

SEQ ID NO: 16252 - protein, 159 aa, Ricinus communis
MAEQTEKAFLKQPKVFLSSKKTGKGKRPGKGGNRFWKSVGLGFKTPREAIEGTYIDKKCPFTGTVSIRGRILAGTCHSAKMMRSIIVRRNYLHFIKKYQRYEKRHSNIPAHISPCFRVKEGDHVIIGQCRPLSKTVRFNVLKVIPAGSSGGGKKAFTGM

SEQ ID NO: 16253 - protein, 159 aa, Ricinus communis
MAEQTEKAFLKQPKVFLSSKKTGKGKRPGKGGNRFWKSIGLGFKTPREAIEGTYIDKKCPFTGTVSIRGRILAGTCHSAKMNRTIIVRRNYLHFIKKYQRYEKRHSNIPAHISPCFRVKEGDHVIIGQCRPLSKTVRFNVLKVIPAGSSGGAKKAFTAM

SEQ ID NO: 16254 - protein, 159 aa, Centaurea maculosa
  Sequence also found in Organisms: Cirsium arvense, Cynara scolymus, Carthamus tinctorius
MAEQTEKAFLKQPKVFLCSKKSGKGKRPGKGGNRFWKSVGLGFKTPREAIEGTYIDKKCPFTGDVSIRGRILAGTCHSAKMVRTIIVRRNYLHFVKKYQRYEKRHSNIPAHISPCFRVKEGDHVTVGQCRPLSKTVRFNVLKVIPAGSSGGGKKAFTGI

SEQ ID NO: 16255 - protein, 159 aa, Gossypium hirsutum
  Sequence also found in Organisms: Gossypium raimondii
MAEQTEKAFLKQPKVFLSSKKSSKGKRPGKGGNRFWKSIGLGFKTPREAIEGTYIDKKCPFAGTVSIRGRILAGTCHSAKMIRTIIVRRNYLHYIKKYQRYEKRHSNIPAHISPCFRVKEGDHVIIGQCRPLSKTVRFNVLKVIPAGSSGGGKKAFTGM

SEQ ID NO: 16256 - protein, 159 aa, Gossypium hirsutum
MAEQTEKAFLKQPKVFLSSKKTGKGKRPGKGGNRFWKSIGLGFKTPREAIEGTYIDKKCPFTGTVSIRGRILAGTCHSAKMVRTIIVRRNYLHYIKKYQRYEKRHSNIPAHISPCFRVKEGDHVIIGQCRPLSKTVRFNVLKVIPAGSSGGGKKAFTAM

SEQ ID NO: 16257 - protein, 159 aa, Gossypium hirsutum
MAEQTEKAFLKQPKVFLSSKKSGKGKRPGKGGNRFWKSIGLGFKTPREATEGTYIDKKCPFTGTVSIRGRILAGTCHSAKMIRTIIVRRNYLHYIKKYQRYEKRHSNIPAHISPCFRVKEGDHVIIGQCRPLSKTVRFNVLKVIPAGSSGGGKKAFTGM

SEQ ID NO: 16258 - protein, 159 aa, Vigna unguiculata
MAEQTEKAFLKQPKVFLSSKKTGKGKRPGKGGNRFWKSIGLGFKTPREAVEGTYIDKKCPFTGNVSIRGRILAGTCHSAKMNRTIIVRRNYLHFIKKYQRYEKRHSNIPAHISPCFRVKEGDHVIIGQCRPLSKTVRFNVLKVIPAGSSSGAKKAFTGM

SEQ ID NO: 16259 - protein, 159 aa, Cucumis sativus
MAEQTEKAFLKQPKVFLCSKKTAKGNKPGKGGNRFWKNIGLGFKTPRDAIEGTYIDKKCPFAGTVSIRGRILAGTCHSAKMVRTIIVRRNYLHYVKKYQRYEKRHSNIPAHISPCFRVKEGDHVIIGQCRPLSKTVRFNVLKVIPAGSSSRGKKAFAGI

SEQ ID NO: 16260 - protein, 158 aa, Cucurbita pepo
MAEQTEKAFLKQPKVFLCSKKIGKGKRPGKGGNRFYKSIGLGFKTPREAIEGTYIDKKCPFTGTVSIRGRILAGTCHSAKMVRTIIVRRNYLHYVKKYQRYEKRHSNIPAHISPCFRVKEGDHVIIGQCRPLSKTVRFNVLKVIPAGSSTGKKAFAGI

SEQ ID NO: 16261 - protein, 159 aa, Cyamopsis tetragonoloba
MAEQTEKAFLKQPKVFLSSKKSGKGKRPGKGGNRFWKSIGLGFKTPRDAIEGTYIDKKCPFTGNVSIRGRILAGTCHSAKMNRTIIVRRNYLHFIKKYQRYEKRHSNIPAHISPCFRVKEGDHVIIGQCRPLSKTVRFNVLKVIPAGSSGTVKKAFTGA

SEQ ID NO: 16262 - protein, 159 aa, Cynara scolymus
MAEQTEKAFLKQPKVFLCSKKNGKGKRPGKGGNRFWKSVGLGFKTPREAIEGTYIDKKCPFTGDVSIRGRILAGTCHSAKMVRTIIVRRNYLHFVKKYQRYEKRHSNIPAHISPCFRVKEGDHVTVGQCRPLSKTVRFNVLKVIPAGSSGGGKKAFTGI

SEQ ID NO: 16263 - protein, 159 aa, Euphorbia peplus
  Sequence also found in Organisms: Euphorbia esula
MAEQTEKAFLKQPKVFLCSKKSGKGKRPGKGGNRFWKSIGLGFKTPRDAIEGTYIDKKCPFTGTVSIRGRILAGTCHSAKMVRTIIVRRNYLHYVKKYQRYEKRHSNIPAHIAPCFRVKEGDHVIIGQCRPLSKTVRFNVLKVIPAGSSTGGKKAFTGI

SEQ ID NO: 16264 - protein, 160 aa, Fagopyrum esculentum
MAEQTEKAFLKQPKVFLSSKKSGKGKRPGKGGNRFWKSIGLGFKTPREAIEGTYIDKKCPFTGTVSIRGRILTGTCHSAKMNRTIIVRRNYLHFVKKYQRYEKRHSNIPAHVSPCFRVKEGDHTIIGQCRPLSKTVRFNVLKVIPAGSSSGAGKKAFTGM

SEQ ID NO: 16265 - protein, 159 aa, Flaveria ramosissima
MAEQTEKAFLKQPKVFLCSKKSGKGKRPGKGGNRFWKSIGLGFKTPREAIEGTYIDKKCPFTGDVSIRGRILAGTCHSAKMVRTIIVRRDYLHYVKKYQRYEKRHSNIPAHISPCFRVKEGDHVTIGQCRPLSKTVRFNVLKVIPAGSSSGGKKAFTGI

SEQ ID NO: 16266 - protein, 159 aa, Flaveria ramosissima
MAEQTEKAFLKQPKVFLCSKKSGKGKRPGKAGNRFWKSIGLGFKTPREAIEGTYIDKKCPFTGDVSIRGRILAGTCHSAKMVRTIIVRRDYLHYVKKYQRYEKRHSNIPAHISPCFRVKEGDHVTIGQCRPLSKTVRFNVLKVIPAGSSSAGKKAFTGI

SEQ ID NO: 16267 - protein, 159 aa, Linum usitatissimum
MAEQTEKAFLKQPKVFLSSKKSSKGKRPGKGGNRFWKSIGLGFKTPREAIEGTYIDKKCPFTGTVSIRGRIIAGTCHSAKMMRTIVVRRNYLHYIKKYQRYEKRHSNIPAHVSPCFRVKEGDHVIIGQCRPLSKTVRFNVLKVIPAGSSGGGKKAFTGM

SEQ ID NO: 16268 - protein, 159 aa, Panax ginseng
MAEQTEKAFLKQPKVFLCSKKTGKGKRPGKGGNRFHKSVGLGFKTPREAIEGTYIDKKCPFTGDVSIRGRILAGTCHSAKMIRTIIVRRNYLHYVKKYQRYEKRHSNIPAHVSPCFRVKEGDHVIVGQCRPLSKTVRFNVLKVIPAGSSGGGKKAFTGI

SEQ ID NO: 16269 - protein, 159 aa, Panax ginseng
MAEQTEKAFLKQPKVFLCSKKTGKGKRPGKGGNRFHKSVGLGFKTPREAIEGTYIDKKCPFTGDVSIRGRILAGTCHSAKMMRTIIVRRNYLHYVKKYQRYEKRHSNIPAHVSPCFRVKEGDHVIVGQCRPLSKTVRFNVLKVIPAGSSGGGKKAFTGI

SEQ ID NO: 16270 - protein, 159 aa, Gossypium raimondii
MAEQTEKAFLKQPKVFLSSKKTGKGKRPGKGGNRFWKSIGLGFKTPREAIEGTYIDKKCPFTGTVSIRGRILAGTCHSAKMVRTIIVRRNYLHYIKKYQRYEKRHSNIPAHISPCFRVKEGDHVIIGQCRPLSKTVRFNVLKVNPAGSSGGGKKAFTAM

SEQ ID NO: 16271 - protein, 159 aa, Heritiera littoralis
MAEQTEKAFLKQPKVFLSSKKSGKGKRPGKGGNRFWKSIGLGFKTPREAIEGTYIDKKCPFTGTVSIRGRILAGTCHSAKMMRTIIVRRNYLHYIKKYQRYEKRHSNIPAHISPCFRVKEGDHVIIGQCRPLSKTVRFNVLKVIPAGSSGGGKKAFTAM

SEQ ID NO: 16272 - protein, 159 aa, Momordica charantia
MAEQTEKAFLKQPKVFLCSKKTGKGKRPGKGGNRFWKSIGLGFKTPREATEGTYIDKKCPFTGTVSIRGRILAGTCHSAKMVRTIIVRRNYLHYVKKYQRYEKRHSNIPAHISPCFRVKEGDHVIIGQCRPLSKTVRFNVLKVIPAGSSSRGKKAFAGI

SEQ ID NO: 16273 - protein, 160 aa, Elaeis guineensis
MAEQTERAFLKQPKVFLCSKKAAKGKKPGKGGNRFWKSIGLGFKTPREAIEGTYIDKKCPFTGTVSIRGRILAGTCHSAKMNRTIIVRRNYLHYVRKYQRYEKRHSNIAAHVSPCFRVKEGDHVIIGQCRPLAKTVRFNVLKVIPAGSKSGGGKKAFAAI

SEQ ID NO: 16274 - protein, 159 aa, Carica papaya
MAEQTEKAFLKQPKVFLSSKKPGKGKRPGKGGNRFWKSIGLGFKTPREAIEGTYIDKKCPFTGTVSIRGRILAGTCHSAKMGRTITVRRNYLHFVKKYQRYEKRHSNIPAHISPCFRVKEGDHVIIGQCRPLSKTVRFNVLKVIPAGSSSGGKKAFTGM

SEQ ID NO: 16275 - protein, 160 aa, Scabiosa columbaria
MAEQTEKAFLKQPKVFLCSKKSGKGKRPGKGGNRFYKSVGLGFKTPREAIEGTYIDKKCPFTGDVSIRGRIIAGTCHSAKMVRTIIVRRNYLHYVKKYQRYEKRHSNIPAHVSPCFRVKEGDHVIIGQCRPLSKTVRFNVLKVIPAGSSGGGGKKGFTGM

SEQ ID NO: 16276 - protein, 161 aa, Echinochloa colona
MAEQTEKAFLKQPKVFLSTKKSGKGKKPGKGGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVVKVIPAGSTGGSGGKKAFTAA

SEQ ID NO: 16277 - protein, 161 aa, Setaria italica
MAEQTEKAFLKQPKVFLSTKKSGKGKKPGKGGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVVKVIPAGTTGGAGGKKAFTAA

SEQ ID NO: 16278 - protein, 159 aa, Chrysanthemum coronarium
  Sequence also found in Organisms: Conyza canadensis
MAEQTEKAFLKQPKVFLCSKKSGKGKRPGKGGNRFWKSIGLGFKTPREAIEGTYIDKKCPFTGDVSIRGRILAGTCHSAKMVRTIIVRRDYLHYVKKYQRYEKRHSNIPAHISPCFRVKEGDHVTVGQCRPLSKTVRFNVLKVIPAGSSGGGKKAFTGI

SEQ ID NO: 16279 - protein, 159 aa, Rosmarinus officinalis
MAEQTEKAFLKQPKVFLCSKKTGKGKRPGKGGNRFWKSIGLGFKTPREATEGTYIDKKCPFTGDVSIRGRILAGTCHSAKMMRTIIVRRNYLHWVKKYQRYEKRHSNIPAHISPCFRVKEGDHVTIGQCRPLSKTVRFNVLKVIPAGSSGLGKKAFTGM

SEQ ID NO: 16280 - protein, 159 aa, Glycine max
MAEQTEKAFLKQPKVFLSTKKTGKGKRPGKGGNRFWKSIGLGFKTPREAIEGTYIDKKCPFTGNVSIRGRILAGTCHSAKMNRTIIVRRNYLHFIKKYQRYEKRHSNIPAHISPAFRVKEGDHVIIGQCRPLSKTVRFNVLKVIPAGSSSGAKKAFTGM

SEQ ID NO: 16281 - protein, 159 aa, Ambrosia trifida
MAEQTEKAFLKQPKVFLCSKKSGKGKRPGKGGNRFWKNIGLGFKTPREAIEGTYIDKKCPFTGDVSIRGRIIAGTCHSAKMVRTIIVRRDYLHYVKKYQRYEKRHSNIPAHISPCFRVKEGDHVTVGQCRPLSKTVRFNVLKVIPAGSSSAGKKAFTGI

SEQ ID NO: 16282 - protein, 159 aa, Arnica chamissonis
MAEQTEKAFLKQPKVFLCSKKSGKGKRPGKGGNRFWKSVGLGFKTPREAIDGTYIDKKCPFTGDVSIRGRILAGTCNSAKMVRTIIVRRDYLHYVKKYQRYEKRHSNIPAHISPCFRVKEGDHVTIGQCRPLSKTVRFNVLKVIPAGSSGGGKKAFTGI

SEQ ID NO: 16283 - protein, 160 aa, Musa acuminata
MAEQTEKAFLKQPKVFLCSKKSGKGKRPGKGGNRFWKSIGLGFKTPREAIEGTYIDKKCPFTGNVSIRGRILAGTCHSAKMNRTIIVRRNYLHYVKKYQRYEKRHSNIAAHISPCFRVKEGDHVIIGQCRPLAKTVSFNVLKVIPAGSTSGGGKKAFAAV

SEQ ID NO: 16284 - protein, 160 aa, Musa acuminata
MAEQTEKAFLKQSKVFLCSKKTGKGKRPGKGGNRFWKSIGLGFKTPKEAIEGTYIDKKCPFTGNVSIRGRILAGTCHSAKMNRTIIVRRNYLHYVKKYQRYEKRHSNIAAHISPCFRVKEGDHVIIGQCRPLAKTVTFNVLKVIPAGSTSGGGKKAFAAV

SEQ ID NO: 16285 - protein, 159 aa, Phaseolus vulgaris
MAEQTEKAFLKQPKVFLSSKKTGKGKRPGKGGNRFWKSIGLSFKTPREAIEGTYIDKKCPFTGNVSIRGRILAGTCHSAKMNRTIVVRRNYLHFIKKYQRYEKRHSNIPAHISPCFRVKEGDHVIIGQCRPLSKTVRFNVLKVIPAGSSSGAKKAFTGI

SEQ ID NO: 16286 - protein, 159 aa, Phaseolus vulgaris
MAEQTEKAFLKQPKVFLSSKKTGKGKRPGKGGNRFWKSIGLGFKTPRDAIEGTYIDKKCPFTGNVSIRGRILAGTCHSAKMNRTIVVRRNYLHFIKKYQRYEKRHSNIPAHISPCFRVKEGDHVIIGQCRPLSKTVRFNVLKVIPAGSSSGAKKAFTGM

SEQ ID NO: 16287 - protein, 159 aa, Manihot esculenta
MAEQTEKAFLKQPKIFLSSKKSGKGKRPGKGGNRFWKSIGLGFKTPREAIEGTYIDKKCPFTGTVSIRGRILAGTCHSAKMNRTIIVRRNYLHFIKKYQRYEKRHSNIPAHISPCFRVKEGDHVIIGQCRPLSKTVRFNVLKVIPAGSSTGAKKAFTAI

SEQ ID NO: 16288 - protein, 159 aa, Manihot esculenta
MAEQTEKAFLKQPKVFLSSKKSGKGKRPGKGGNRFWKSIGLGFKTPREAIEGTYIDKKCPFTGTVSIRGRILAGTCHSAKMMRTIIVRRNYLHFIKKYQRYEKRHSNIPAHISPCFRVKEGDHVIIGQCRPLSKTVRFNVLKVIPAGSSGGGKKAFTAI

SEQ ID NO: 16289 - protein, 160 aa, Catharanthus roseus
MAEQTEKAFLKQPKVFLSSKKAAKGKRPGKGGNRYWKSIGLGFKTPREAIEGTYIDKKCPFTGNVSIRGRIIAGTCHSAKMVRTIIVRRNYLHFVKKYQRYEKRHSNIPAHISPCFRVKEGDHITIGQCRPLSKTVRFNVLKVIPAGSSSGVAKKAFTGM

SEQ ID NO: 16290 - protein, 158 aa, Centaurea maculosa
AEQTEKAFLKQPKVFLCSKKSGKGKRPGKGGNRFWKSVGLGFKTPREAIEGTYIDKKCPFTGDVSIRGRILAGTCHSAKMVRTIIARRNYLHFVKKYQRYEKRHSNIPAHISPCFRVKEGDHVIVGQCRPLSKTVRFNVLKVIPAGSSGGGKKAFTGF

SEQ ID NO: 16291 - protein, 159 aa, Chrysanthemum coronarium
MAEQTEKAFLKQPKVFLCSKKSGKGKRPGKGGNRFWKSVGLGFKTPREAIEGTYIDKKCPFTGDVSIRGRILAGTCHSAKMVRTIIVRRDYLHYVKKYQRYEKRHSNIPAHISPCFRVKEGDHVTVGQCRPLSKTVRFNVLKVIPAGSSGGGKKAFSGI

SEQ ID NO: 16292 - protein, 160 aa, Trifolium pratense
MAEQTEKAFLKQPKVFLSSKKSGKGKRPGKGGNRFWKSVGLGFKTPRDAIEGAYIDKKCPFTGNVSIRGRILAGTCHSAKMNRTIIVRRNYLHFIKKYQRYEKRHSNIPAHVSPCFRVKEGDHVIIGQCRPLSKTVRFNVLKVIPAGSSSGAGKKAFTGI

SEQ ID NO: 16293 - protein, 159 aa, Coffea canephora
MAEQTEKAFLKQPKVFLSSKKTGKGKRPGKGGNRYWKSIGLGFKTPREAIEGTYIDKKCPFTGSVSIRGRIIAGTCHSAKMDKTIIVRRNYLHFVKKYQRYEKRHSNIPAHISPCFRVKEGDHVIIGQCRPLSKTVRFNVLKVVPAGASGGGKKAFTGL

SEQ ID NO: 16294 - protein, 159 aa, Gossypium hirsutum
  Sequence also found in Organisms: Gossypium raimondii
MAEQTEKAFLKQPKVFLSSKKTGKGKRPGKGGNRFWKSIGLGFKTPREAIEGTYIDKKCPFTGPVSVRGRILAGTCHSAKMMRTIIVRRNYLHYIKKYQRYEKRHSNIPAHISPCFRVKEGDHVIIGQCRPLSKTVRFNVLKVIPAGSSGGGKKAFTGM

SEQ ID NO: 16295 - protein, 159 aa, Vigna unguiculata
MAEQTEKAFLKQPKVFLCSKKGGKGKRPGKGGNRFWKSIGLGFKTPRDAIEGTYIDKKCPFTGNVSIRGRILAGTCHSAKMTRTIIVRRNYLHFIKKYQRYEKRHSNIPAHISPCFRVKEGDHVIIGQCRPISKTVRFNVLKVIPAGSSSGAKKAFTGM

SEQ ID NO: 16296 - protein, 159 aa, Cyamopsis tetragonoloba
MAEQTEKAFLKQPKVFLCSKKSGKGKRPGKGGNRFWKSIGLGFKTPREAIDGTYIDKKCPFTGNVSIRGRILAGTCHSAKMTRTIIVRRNYLHFIKKYQRYEKRHSNIPAHISPCFRVKEGDHVIIGQCRPISKTVRFNVLKVIPAGSSSGAKKAFTGM

SEQ ID NO: 16297 - protein, 159 aa, Echinacea purpurea
MAEQTEKAFLKQPKVFLCSKKSGKGKRPGKGGNRFWKSIGLGFKTPREAIDGTYIDKKCPFTGDVSIRGRILAGTCHSAKMVRTIIVRRDYLHYVKKYQRYEKRHSNIPAHISPCFRVKEGDHVTIGQCRPLSKTVRFNVLKVIPAGSSSGGKKAFTGI

SEQ ID NO: 16298 - protein, 159 aa, Echinochloa colona
MAEQTEKAFLKQPKVFLCPKKVTKGTSPARGQQVLESIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 16299 - protein, 159 aa, Euphorbia peplus
  Sequence also found in Organisms: Euphorbia esula
MAEQTEKAFLKQPKVFLASKKTGKGKRPGKGGNRFWKSIGLGFKTPREAIDGTYIDKKCPFTGTVSIRGRILAGTCHSAKMNRTIIVRRNYLHFIKKYQRYEKRHSNIPAHVSPCFRVKEGDHVIIGQCRPLSKTVRFNVLKVIPAGSSGGVKKAFTAI

SEQ ID NO: 16300 - protein, 159 aa, Euphorbia peplus
MAEQTEKAFLKQPKVFLSSKTTGKGKRPGKGGNRFWKSVGLGFKTPREAIEGTYIDKKCPFTGSVSIRGRILAGTCHSAKMNRTIIVRRNYLHFIKKYQRYEKRHSNIPAHVSPCFRVKEGDHVIIGQCRPLSKTVRFNVLKVIPAGSSGGVKKAFTAI

SEQ ID NO: 16301 - protein, 159 aa, Fagopyrum esculentum
MAEQTEKAFLKQPKVFLSSKKSGKGKRPGKGGNRFWKSIGLGFKTPREAIEGTYIDKKCPFTGTVSVRGRILAGTCHSAKMMRTIIVRRNYLHWVKKYQRYEKRHSNIPAHISPCFRVKEGDHVIIGQCRPLSKTVRFNVLKVIPAGSAAGGKKAFTGM

SEQ ID NO: 16302 - protein, 160 aa, Fagopyrum esculentum
MAEQTEKAFLKQSKVFLSSKKSGKGKRPGKGGNRFWKSIGLGFKTPREAIEGTYIDKKCPFTGTVSIRGRILTGTCHSAKMNRTIIVRRNYLHFVKKYQRYEKRHSNIPAHVSPCFRVKEGDHIIIGQCRPLSKTVRFNVLKVIPAGSSSGAGKKAFTGM

SEQ ID NO: 16303 - protein, 159 aa, Fagopyrum esculentum
MAEQTEKAFLKQPKVFLSSKKTGKGKRPGKGGNRFWKSIGLGFKTPREAIEGTYIDKKCPFTGTVSVRGRILAGTCHSAKMMRTIIVRRNYLHWVKKYQRYEKRHSNIPAHISPCFRVKEGDHVIIGQCRPLSKTVRFNVLKVIPAGSAAGGKKAFTGM

SEQ ID NO: 16304 - protein, 160 aa, Fagopyrum esculentum
MAEQTEKAFLKQPKVFLSSKKSGKGKRPGKGGNRFWKSIGLGFKTPRDAIEGTYIDKKCPFTGTVSIRGRILTGTCHSAKMNRTIIVRRNYLHFVKKYQRYEKRHSNIPAHVSPCFRVKEGDHTIIGQCRPLSKTVRFNVLKVIPAGSSSGAGKKAFTGM

SEQ ID NO: 16305 - protein, 159 aa, Flaveria ramosissima
MAEQTEKAFLKQPKVFLCSKKSGKGKRPGKGGNRFWKSIGLGFKTPREAIEGTYIDKKCPFTGDVSIRGRILAGTCHSAKMVRTIIVRRDYLHYVKKYQRYEKRHSNIPAHISPCFRVKEGDHVTIGLCRPLSKTVRFNVLKVIPAGSSSGGKKAFTGI

SEQ ID NO: 16306 - protein, 159 aa, Linum usitatissimum
MAEQTEKAFLKQPKVFLSSKKTGKGKRPGKGGNRFWKSIGLGFKTPREATEGTYIDKKCPFTGTVSIRGRILAGTCHSAKMMRTIIVRRNYLHFVKKYQRYEKRHSNIPAHVSPCFRVKEGDHVIIGQCRPLSKTVRFNVLKVIPAGSSGGGKKAFTGM

SEQ ID NO: 16307 - protein, 159 aa, Linum usitatissimum
MAEQTEKAFLKQPKVFLSSKKTGKGKRPGKGGNRFWKSIGLGFKTPREAIEGTYIDKKCPFTGTVSIRGRILAGTCHSAKMMRSIIVRRNYLHYVKKYQRYEKRHSNIPAHVSPCFRVKEGDHVIIGQCRPLFKTVRFNVLKVIPAGSSGGGKKAFTGM

SEQ ID NO: 16308 - protein, 159 aa, Fraxinus spp
MAEQTEKAFLKQPKVFLCSKKTGKGKRPGKGGNRYFKSVGLGFKTPREAIEGTYIDKKCPFTGDVSIRGRILAGTCHSAKMMRTIIVRRNYLHWVKKYRRYEKRHSNIPAHISPCFRVREGDHVTIGQCRPLSKTVRFNVLKVIPAGSSGLGKKAFTGM

SEQ ID NO: 16309 - protein, 159 aa, Fraxinus spp
MAEQTEKAFLKQPKVFLCSKKTGKGKRPGKGGNRYFKSVGLGFKTPREAIEGTYIDKKCPFTGDVSIRGRILAGTCHSAKMMRTIIVRRNYLHWVKKYRRYEKRHSNIPAHISPCFRVREGDYVIIGQCRPLSKTVRFNVLKVIPAGSSGLGKKAFTGM

SEQ ID NO: 16310 - protein, 159 aa, Fraxinus spp
MAEQTEKAFLKQPKVFLCSKKTGKGKRPGKGGNRYWKSVGLGFKTPREAIEGTYIDKKCPFTGDVSIRGRILAGTCHSAKMMRTIIVRRNYLHWVKKYRRYEKRHSNIPAHISPCFRVREGDHVTVGQCRPLSKTVRFNVLKVIPAGSSGLGKKAFTGM

SEQ ID NO: 16311 - protein, 160 aa, Zingiber officinale
MAEQTEKPFLKQPKVFLSSKKSGKGKKPGKGGNRFWKNIGLGFKTPREAIEGTYIDKKCPFTGTVSIRGRILAGTCHSAKMNRTIIVRRNYLHYVKKYQRYEKRHSNIPAHISPCFRVKEGDHVIIGQCRPLSKTVRFNVLKVIPAGSTGGGGKKAFVAA

SEQ ID NO: 16312 - protein, 159 aa, Gossypium raimondii
MAEQTEKAFLKQPKVFLSSKKSGKGKRPGKGGNRFWKSIGLGFKTPREATEGIYIDKKCPFTGTVSIRGRILAGTCHSAKMIRTIIVRRNYLHYIKKYQRYEKRHSNIPAHISPCFRVKEGDHVIIGQCRPLSKTVRFNVLKVIPAGSSGGGKKAFTGM

SEQ ID NO: 16313 - protein, 160 aa, Vitis vinifera
MAEQTEKAFLKQPKVFLCSKKSAKGKRPGKGGNRFWKSIGLGFKTPRDAIEGTYIDKKCPFTGTVSIRGRILAGTCHSAKMMRTIIVRRNYLHYVKKYQRYEKRHSNIPAHTSPCFRVKEGDHVIIGQCRPLSKTVRFNVLKVIPAGSSGGGGKKAFTAM

SEQ ID NO: 16314 - protein, 159 aa, Glycyrrhiza uralensis
MAEQTEKAFLKQPKVFLSSKKSGKGKRPGKGGNRFWKSIGLGFKTPRDAIEGTYIDKKCPFTGNVSIRGRILAGTCHSAKMNRTIIVRRNYLHFIKKYQRYEKRHSNIAAHISPCFRVKEGDHVIIGQCRPLSKTVRFNVLKVIPAGSSSGAKKAFTGI

SEQ ID NO: 16315 - protein, 159 aa, Lotus japonicus
MAEQTEKAFLKQPKVFLSSKKSGKGKRPGKGGNRFWKSIGLGFKTPRDAIEGTYIDKKCPFTGNVSIRGRILAGTCHSAKMTRTIIVRRNYLHFIKKYQRYEKRHSNIPAHISPCFRVKEGDHVIIGQCRPISKTVRFNVLKVIPAGSSSGVKKAFTGV

SEQ ID NO: 16316 - protein, 160 aa, Medicago truncatula
MAEQTEKAFLKQPKVFLCSKKSGKGKRPGKGGNRFFKSVGLGFKTPREAIDGTYIDKKCPFTGNVSIRGRILAGTCHSAKMNRTIVVRRNYLHFIKKYQRYEKRHSNIPAHVSPCFRVKEGDHVIIGQCRPLSKTVRFNVLKVIPAGSSSGAGKKAFTGM

SEQ ID NO: 16317 - protein, 159 aa, Cucumis melo
MAEQTEKAFLKQPKVFLCSKKTAKGKRPGKGGNRFWKSIGLGFKTPRDAIEGTYIDKKCPFAGTVSIRGRILAGTCHSAKMVRTIIVRRNYLHYVKKYQRYEKRHSNIPAHISPCFRVKEGDHVIIGQCRPLSKTVRFNVLKVIPAGSSSRGKKAFAGI

SEQ ID NO: 16318 - protein, 159 aa, Olea europaea
MAEQTEKAFLKQPKVFLCSKKTGKGKRPGKGGNRYWKSIGLGFKTPRDAIEGSYIDKKCPFTGDVSIRGRILAGTCHSAKMMRTIIVRRNYLHWVKKYQRYEKRHSNIPAHISPCFRVREGDHVIIGQCRPLSKTVRFNVLKVIPAGSSGLGKKAFTGM

SEQ ID NO: 16319 - protein, 159 aa, Orobanche aegyptiaca
MAEQTEKAFLKQPKVFLCSKKTGKGKAPGKGGNRYFKSVGLGFKTPREAIEGTYIDKKCPFTGNVSIRGRIIAGTCHSAKMMRTIIVRRNYLHWVKKYQRYEKRHSNIAAHISPCFRVKEGDHVIIGQCRPLSKTVRFNVLKVIPAGSSGLGKKAFAGM

SEQ ID NO: 16320 - protein, 159 aa, Carica papaya
MAEQTEKAFLKQPKVFLASKKSGKGKRPGKGGNRFWKSIGLGFKTPREAIEGAYIDKKCPFTGTVSIRGRILAGTCHSAKMGRTITVRRNYLHFVKKYQRYEKRHSNIPAHISPCFRVKEGDHVIIGQCRPLSKTVRFNVLKVIPAGSSSGGKKAFTGM

SEQ ID NO: 16321 - protein, 160 aa, Arachis hypogaea
MAEQTEKAFLKQPKVFLCSKKSGKGKRPGKGGNRFWKSIGLGFKTPREAIQGTYIDKKCPFTGTVSIRGRILAGTCHSAKMTRTIIVRRNYLHFIKKYQRYEKRHSNIAAHISPCFRVKEGDHVIIGQCRPLSKTVRFNVLKVIPAGSSSGVAKKAFTGM

SEQ ID NO: 16322 - protein, 159 aa, Lippia dulcis
MAEQTEKAFLKQPKVFLCSKKSGKGKAPGKGGNRYFKSIGLGFKTPRDAIEGTYIDKKCPFTGSVSIRGRIIAGTCHSAKMVRTIIVRRNYLHWVKKYQRYEKRHSNIPAHISPCFRVKEGDHVIIGQCRPLSKTVRFNVLKVIPAGSSGRGKKAFTGM

SEQ ID NO: 16323 - protein, 159 aa, Platanus occidentalis
MAEQTEKAFLKQPKVFLCSKKSGKGKRPGKGGNRFWKSVGLGFKTPRDATEGTYIDKKCPFTGNVSIRGRILAGTCHSAKMMRTIIVRRNYLHYVKKYQRYEKRHSNIPAHVSPCFRVKEGDHVIIGQCRPLSKTVRFNVLKVIPAGSSGGGKKAFTAM

SEQ ID NO: 16324 - protein, 159 aa, Populus trichocarpa
MAEQTEKAFLKQPKVFLSSKKTGKGKRPGKGGNRFWKSIGLGFKTPRDAIEGTYIDKKCPFTGTVSIRGRILSGTCHSAKMNRTIIVRRNYLHWVKKYQRYEKRHSNIPAHISPCFRVREGDYVIIGQCRPLSKTVRFNVLKVIPAGSSGGAKKVFTGM

SEQ ID NO: 16325 - protein, 159 aa, Salvia sclarea
MAEQTEKAFLKQPKVFLCSKKTGKGKAPGKGGNRYFKSIGLGFKTPREASEGTYIDKKCPFTGDVSIRGRILAGTCHSAKMMRTIIVRRNYLHWVKKYQRYEKRHSNIPAHISPCFRVREGDHVIIGQCRPLSKTVRFNVLKVIPAGSSGLGKKAFTGM

SEQ ID NO: 16326 - protein, 159 aa, Senecio madagascariensis
MAEQTEKAFLKQPKVFLCSKKSGKGKRPGKGGNRFWKSIGLGFKTPREAIEGTYIDKKCPFTGDVSIRGRILAGTCHSAKMVRTIIVRRDYLHYVKKYQRYEKRHSNIPAHISPCFRVKEGDHVTVGQCRPLSKTVRFNVLKVIPAGSSGGGKKAFTGF

SEQ ID NO: 16327 - protein, 159 aa, Sesamum indicum
MAEQTEKAFLKQPKVFLCSKKSGKGKAPGKGGNRYWKSIGLGFKTPREAIEGTYIDKKCPFTGSVSIRGRILAGTCHSAKMMRTIVVRRNYLHWVKKYQRYEKRHSNIPAHISPCFRVKEGDHVIIGQCRPLSKTVRFNVLKVIPAGSSGRGKKAFTGM

SEQ ID NO: 16328 - protein, 159 aa, Helianthus annuus
MAEQTEKAFLKQPKVFLCSKKSGKGKRPGKGGNRFWKNIGLGFKTPREAIEGTYIDKKCPFTGDVSIRGRILAGTCHSAKMVRTIIVRRDYLHYVKKYQRYEKRHSNIPAHISPCFRVKEGDHVTIGQCRPLSKTVRFNVLKVIPAGSASGGKKAFTGI

SEQ ID NO: 16329 - protein, 160 aa, Trigonella foenum-graecum
MAEQTEKAFLKQPKVFLCSKKSGKGKRPGKGGNRFWKSVGLGFKTPREATEGTYIDKKCPFTGNVSIRGRILAGTCHSAKMNRTIIVRRNYLHFIKKYQRYEKRHSNIPAHVSPCFRVKEGDHVIIGQCRPLSKTVRFNVLKVIPAGSSGGVGKKAFTGM

SEQ ID NO: 16330 - protein, 158 aa, Utricularia gibba
AEQTEKAFLKQPKVFLCSKKSGKGKAPGKGGNRFWKSIGLGFKTPREAIEGTYIDKKCPFTGTISIRGRILAGTCHSAKMTRTIIVRRNYLHWVKKYQRYEKRHSNIPAHVSPCFRVKEGDHVIIGQCRPLSKTVRFNVLKVIPAGSSGQGKKAFTGM

SEQ ID NO: 16331 - protein, 159 aa, Utricularia gibba
MAEQTEKAFLKQPKVFLSSKKSGKGKAPGKGGNRFWKSIGLGFKTPREAIEGTYIDKKCPFTGTISIRGRILAGTCHSAKMTRTIIVRRNYLHWVKKYQRYEKRHSNIPAHVSPCFRVKEGDHVIIGQCRPLSKTVRFNVLKVIPAGSSGQGKKAFTGM

SEQ ID NO: 16332 - protein, 159 aa, Vicia sativa
MAEQTEKAYLKQPKVFLCSKKSGKGKRPGKGGNRFWKSIGLGFKTPKEAIEGAYIDKKCPFTGNVSIRGRIIAGTCHSAKMNRTIIVRRNYLHFIKKYQRYEKRHSNIPAHVSPAFRVKEGDHVIIGQCRPLSKTVRFNVLKVIPAGSSSGAKKAFGGI

SEQ ID NO: 16333 - protein, 159 aa, Juglans hindsii x Juglans regia
MAEQTEKAFLKQPKVFLCSKKSGKGKRPGKGGNRFWKSVGLGFKTPREAIEGTYIDKKCPFTGNVSIRGRILAGTCHSAKMMRTIIVRRNYLHFVKKYQRYEKRHSNIAAHISPCFRVKEGDYVTIGQCRPLSKTVRFNVLKVIPAGSSGGGKKAFTGI

SEQ ID NO: 16334 - protein, 161 aa, Lotus japonicus
MAEQTEKAFLKQPKVFLCSKKSGKGKRPGKGGNRFWKSIGLGFKTPRDAIEGSYIDKKCPFTGNVSVRGRILAGTCHSAKMTRTIIVRRNYLHFIKKYQRQVYEKRHSNIPAHISPCFRVKEGDHVIIGQCRPLSKTVRFNVLKVIPAGSSGAVKKAFTGV

SEQ ID NO: 16335 - protein, 159 aa, Oryza sativa
MAEQTERAFLKQPKVFLCPKKSGKGKKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVIKVIPAGSTGGGKKAFIAA

SEQ ID NO: 16336 - protein, 159 aa, Rosmarinus officinalis
MAEQTEKAFLKQPKVFLCSKKTGKGKAPGKGGNRYFKSIGLGFKTPREATEGTYIDKKCPFTGDVSIRGRILAGTCHSAKMMRTIIVRRNYLHWVKKYQRYEKRHSNIPAHISPCFRVREGDHVTIGQCRPLSKTVRFNVLKVIPAGSSGLGKKAFTGM

SEQ ID NO: 16337 - protein, 159 aa, Rosmarinus officinalis
MAEQTEKAFLKQPKVFLCSKKTGKGKAPGKGGNRYFKSIGLGFKTPREASEGTYIDKKCPFTGDVSIRGRILAGTCHSAKMMRTIIVRRNYLHWVKKYQRYEKRHSNIPAHISPCFRVREGDHVTIGQCRPLSKTVRFNVLKVIPAGSSGLGKKAFTGM

SEQ ID NO: 16338 - protein, 159 aa, Glycine max
MAEQTEKAFLKQPKVFLCSKKGGKGKRPGKGGNRFWKSIGLGFKTPRDAIEGTYIDKKCPFTGNVSIRGRILAGTCHSAKMTRTIIVRRNYLHFIKKYQRYEKRHSNIPAHTSPCFRVKEGDHVIIGQCRPISKTVRFNVLKVIPAGSSSGAKKAFTGM

SEQ ID NO: 16339 - protein, 159 aa, Glycine max
MAEQTEKAFLKQPKVFLCSKKGGKGKRPGKGGNRFWKSIGLGFKTPRDAIEGTYIDKKCPFTGNVSIRGRILAGTCHSAKMTRTIIVRRNYLHFIKKYQRYEKRHSNIPSHISPCFRVKEGDHVIIGQCRPISKTVRFNVLKVIPAGSSSGAKKAFTGM

SEQ ID NO: 16340 - protein, 159 aa, Ambrosia trifida
MAEQTEKAFLKQPKVFLCSKKSGKGKRPGKGGNRFWKSIGLGFKTPREAIEGTYIDKKCPFTGDVSIRGRILAGTCHSAKMVRTIIVRRDYLHFVKKYQRYEKRHSNIPAHISPCFRVKEGDHVTVGQCRPLSKTVRFNVLKVIPAGSSSAGKKAFTGI

SEQ ID NO: 16341 - protein, 160 aa, Aquilegia formosa
MAEQTEKAFLKQPKVFLCSKKSGKGKRPGKGGNRFFKSIGLGFKTPREAIEGTYIDKKCPFTGDVSVRGRILAGTCHSAKMVRTIIVRRNYLHYVKKYQRYEKRHSNIPAHVSPCFRVKEGDHVIIGQCRPLSKTVRFNVLKVIPAGSSGGSGKKAFLGV

SEQ ID NO: 16342 - protein, 160 aa, Aristolochia fimbriata
MAEQTEKAFLKQPKVFLSSKKSGKGKRPGKGGNRFWKSIGLGFKTPREAIEGTYIDKKCPFTGTVSVRGRILAGTCHSAKMMRTIIVRRNYLHWVKKYQRYEKRHSNIPAHISPCFRVKEGDHIIIGQCRPLSKTVRFNVLKVIPAGSSTGGGKKAFTGM

SEQ ID NO: 16343 - protein, 159 aa, Hordeum vulgare
  Sequence also found in Organisms: Pseudoroegneria spicata
MAEQTEKSFLKQPKVFLSTKKADKAKRPGKAGNRFWKSVGLGFKTPREAIEGTYIDKKCPFTGTVAIRGRIIAGTCHSAKMNRTIIVRRNYLHFVKKYQRYEKRHSNIPAHISPCFRVKEGDHVIIGQCRPLSKTVRFNVLKVVPAGTTGGGKKAFIAA

SEQ ID NO: 16344 - protein, 159 aa, Phaseolus vulgaris
MAEQTEKAFLKQPKVFLSSKKTGKGKRPGKGGNRFWKSIGLSFKTPRDAIEGTYIDKKCPFTGNVSIRGRILAGTCHSAKMNRTIVVRRNYLHFIKKYQRYEKRHSNIPAHISPCFRVKEGDHVIIGQCRPLSKTVRFNVLKVIPAGSSSGAKKAFTGM

SEQ ID NO: 16345 - protein, 158 aa, Brachypodium distachyon
MAEQTEKAFLKQPKVFLSTKKADKAKRPGKAGNRFWKSVGLGFKTPREAIEGTYIDKKCPFTGTVAIRGRIIAGTCHSAKMNRTIIVRRDYLHFVKKYQRYEKRHSNIPAHISPCFRIREGDHVIIGQCRPLSKTVRFNVLKVIPAGSTGGKKAFVAA

SEQ ID NO: 16346 - protein, 160 aa, Chelidonium majus
MAEQTEKAFLKQPKVFLCSKKSGKGKRPGKGGNRFYKSIGLGFKTPREAIEGTYIDKKCPFTGNVSIRGRIIAGTCHSAKMVRTIIVRRNYLHYVKKYQRYEKRHSNIPAHISPCFRVKEGDHVTIGQCRPLSKTVRFNVLKVIPAGSSGGGGKKAFVAM

SEQ ID NO: 16347 - protein, 160 aa, Cicer arietinum
MAEQTEKAFLKQPKVFLCSKKSGKGKRPGKGGNRFWKSIGLGFKTPREATEGTYIDKKCPFTGNVSIRGRILAGTCHSAKMNRTIIVRRNYLHFIKKYQRYEKRHSNIPAHVSPCFRVKEGDHVTIGQCRPLSKTVRFNVLKVIPAGSSSGVAKKAFTGI

SEQ ID NO: 16348 - protein, 160 aa, Trifolium pratense
MAEQTEKAFLKQPKVFLSSKKSGKGKRPGKGGNRFWKSIGLGFKTPRDAIEGAYIDKKCPFTGNVSIRGRILAGTCHSAKMNRTIIVRRNYLHFIKKYQRYEKRHSNIPAHVSPCFRVKEGDHVIIGQCRPLSKTVRFNVLKVIPAGSSSGAGKKAFTGI

SEQ ID NO: 16349 - protein, 160 aa, Cryptomeria japonica
MAEQTEKAFLKQPKVFLCSKKSGKGKRPGKGGNRFWKNVGLGFKTPKEAIQGTYIDKKCPFTGNVSIRGRILTGTCHSAKMNRTIIVRRNYLHFVKKYQRYEKRHSNIPAHISPCFRVKEGDHVIIGQCRPLSKTVRFNVLKVIPAGSSSGTAKKGFAAI

SEQ ID NO: 16350 - protein, 159 aa, Cucumis sativus
MAEQTEKAFLKQPKVFLSSKKSGKGKRPGKGGNRFWKSIGLGFKTPRDAIEGTYIDKKCPFTGTVSIRGRILAGTCHSAKMVRTIIVRRNYLHYVKKYQRYEKRHSNIPAHIAPCFRVKEGDHVIIGQCRPLSKTVRFNVLKVIPAGSSAGGKKAFAGI

SEQ ID NO: 16351 - protein, 159 aa, Solanum melongena
MAEQTEKAFLKQPGVFLSSKKTGKGKRPGKGGNRYFKSIGLGFKTPREAIEGTYIDKKCPFTGNVSIRGRILAGTCHSAKMNRTIIVRRNYLHYVKKYQRYEKRHSNIPAHISPCFRVKEGDHVIIGQCRPLSKTVRFNVLKVIPAGSGAGGKKAFTGM

SEQ ID NO: 16352 - protein, 159 aa, Euphorbia peplus
  Sequence also found in Organisms: Euphorbia esula
MAEQTEKAFLKQPKVFLSSKKTGKGKRPGKGGNRFWKSVGLGFKTPREAIEGTFIDKKCPFTGTVSIRGRILAGTCHSAKMTRTIIVRRNYLHFIKKYQRYEKRHANIPAHVSPCFRVKEGDHVIIGQCRPLSKTVRFNVLRVIPAGSSGGVKKAFTAV

SEQ ID NO: 16353 - protein, 159 aa, Fagopyrum esculentum
MAEQTEKAFLKQPKVFLSSKKSGKGKRPGKGGNRFWKSIGLGFKTPREATEGTYIDKKCPFTGTVSVRGRILAGTCHSAKMMRTIIVRRNYLHWVKKYQRYEKRHSNIPAHISPCFRVKEGDHVIIGQCRPLSKTVRFNVLKVIPAGSAAGGKKAFTGM

SEQ ID NO: 16354 - protein, 157 aa, Flaveria ramosissima
EQTEKAFLKQPKVFLCSKKSGKGKRPGKGGNRFWKSIGLGFKTPREAIEGTYIDKKCPFTGDVSIRGRILAGTCHSAKMVRTIIVRRDYLHYVKKYQRYEKRHSNIPAHISPCFRVKEGDHVTIGQCRPLSKTVRFNVLKVIPAGSSSGGKKAFTGI

SEQ ID NO: 16355 - protein, 159 aa, Linum usitatissimum
MAEQTEKAFLKQPKVFLSSKKTGKGKRPGKGGNRFWKSIGLGFKTPREAIEGTFIDKKCPFTGTVSIRGRILAGTCHSAKMMRSIIVRRNYLHFVKKYQRYEKRHSNIPAHVSPCFRVKEGDHVIIGQCRPLSKTVRFNVLKVIPAGSSGGGKKAFTGM

SEQ ID NO: 16356 - protein, 159 aa, Fraxinus spp
MAEQTEKAFLKQPKVFLCSKKTGKGKRPGKGGNRYFKSVGLGFKTPREAIEGTYIDKKCPFTGDVSIRGRILSGTCHSAKMMRTIIVRRNYLHWVKKYRRYEKRHSNIPAHISPCFRVREGDHVTIGQCRPLSKTVRFNVLKVIPAGSSGLGKKAFTGM

SEQ ID NO: 16357 - protein, 159 aa, Fraxinus spp
MAEQTEKAFLKQPKVFLCSKKTGKGKRPGKGGNRYWKSIGLGFKTPREAVEGTYIDKKCPFTGDVSIRGRILAGTCHSAKMMRTIIVRRNYLHWVKKYQRYEKRHSNIPAHISPCFRVKEGDHVTIGQCRPLSKTVRFNVLKVIPAGSSGLGKKAFTGM

SEQ ID NO: 16358 - protein, 160 aa, Panax ginseng
MAEQTEKAFLKQPKVFLCSKKSGKGKRPGKGGNRFHKSIGLGFKTPREAIEGTYIDKKCPFTGDVSIRGRILAGTCHSAKMMRTIIVRRNYLHYVKKYQRYEKRHSNIPAHVSPCFRVKEGDHVIVGQCRPLSKTVRFNVLKVIPAGSSGGGGKKAFTGI

SEQ ID NO: 16359 - protein, 160 aa, Vitis vinifera
MAEQTEKAFLKQPKVFLCSKKGGKGKRPGKGGNRFWKSIGLGFKTPRDAIEGTYIDKKCPFTGGVSIRGRILAGTCHSAKMMRTIIVRRNYLHYVKKYQRYEKRHSNIPAHISPCFRVKEGDHVIIGQCRPLSKTVRFNVLKVIPAGSSGGGGKKAFVAM

SEQ ID NO: 16360 - protein, 159 aa, Guizotia abyssinica
MAEQTEKAFLKQPKVFLCSKKSGKGKRPGKGGNRFWKSIGLGFKTPREAIEGTYIDKKCPFTGDVSIRGRILAGTCHSAKMVRTIIVRRDYLHYVKKYQRYEKRHSNIPAHISPCFRVKEGDHVTVGQCRPLSKTVRFNVLKAIPAGSSGGGKKAFTGI

SEQ ID NO: 16361 - protein, 159 aa, Carpinus betulus
MAEQTEKAFLKQPNVFLCSKKSGKGKRPGKGGNRFWKSVGLGFKTPREAIDGTYIDKKCPFTGNVSIRGRIISGTCHSAKMVRTIIVRRNYLHFVKKYQRYEKRHSNIPAHISPCFRVKEGDYVIIGQCRPLSKTVRFNVLKVIPAGSSAGGKKAFTGM

SEQ ID NO: 16362 - protein, 160 aa, Liriodendron tulipifera
MAEQTEKAFLKQPKVFLSSKKPGKGKRPGKGGNRYWKSIGLGFKTPRDAIEGTYIDKKCPFTGTVSIRGRILAGTCHSAKMMRTIIVRRNYLHYVKKYQRYEKRHSNIPAHISPCFRVKEGDHVIIGQCRPLSKTVRFNVLKVVPAGSSGGGGKKAFAAI

SEQ ID NO: 16363 - protein, 159 aa, Cucumis melo
MAEQTEKAFLKQPKVFLSSKKSGKGKRPGKGGNRFWKSIGLGFKTPRDAIEGTYIDKKCPFTGTVSIRGRILAGTCHSAKMVRTIIVRRNYLHYVKKYQRYEKRHSNIPAHIAPCFRVKEGDHVIIGQCRPLSKTVRFNVLKVIPAGSSTGGKKAFAGI

SEQ ID NO: 16364 - protein, 159 aa, Nicotiana benthamiana
  Sequence also found in Organisms: Capsicum annuum
MAEQTEKAFLKQPGVFLSSKKTGKGKRPGKGGNRYFKSIGLGFKTPREAIEGTYIDKKCPFTGNVSIRGRILAGTCHSAKMNRTIIVRRNYLHYVKKYQRYEKRHSNIPAHISPCFRVKEGDHVIIGQCRPLSKTVRFNVLKVIPAGSAGGGKKAFTGM

SEQ ID NO: 16365 - protein, 159 aa, Elaeis guineensis
MAEQTERAFLKQPKVFLCSKKSGKGKRPGKGGNRFWKNIGLGFKTPREAIEGTYIDKKCPFTGNVSIRGRILAGTCHSAKMNRTIIVRRNYLHYVRKYQRYEKRHSNIAAHISPCFRVKEGDHVIIGQCRPLSKTVRFNVLKVIPAGSKGGGKKAFAAV

SEQ ID NO: 16366 - protein, 160 aa, Arachis hypogaea
MAEQTEKAFLKQPKVFLCSKKSGKGKRPGKGGNRFWKGIGLGFKTPREAIQGTYIDKKCPFTGTVSIRGRILAGTCHSAKMTRTIIVRRNYLHFIKKYQRYEKRHSNIAAHISPCFRVKEGDHVIIGQCRPLSKTVRFNVLKVIPAGSSSGVAKKAFTGM

SEQ ID NO: 16367 - protein, 159 aa, Lippia dulcis
MAEQTEKAFLKQPKVFLCSKKSGKGKAPGKGGNRYFKSIGLGFKTPRDAIEGTYIDKKCPFTGSVSIRGRILAGTCHSAKMVRTIIVRRNYLHWVKKYQRYEKRHSNIPAHISPCFRVKEGDHVIIGQCRPLSKTVRFNVLKVIPAGSSGRGKKAFTGM

SEQ ID NO: 16368 - protein, 159 aa, Lippia dulcis
MAEQTEKAFLKQPKVFLCSKKSGKGKAPGKGGNRYFKSIGLGFKTPRDAIEGTYIDKKCPFTGNVSIRGRIIAGTCHSAKMVRTIIVRRNYLHWVKKYQRYEKRHSNIPAHISPCFRVKEGDHVIIGQCRSLSKTVRFNVLKVIPAGSSGRGKKAFTGM

SEQ ID NO: 16369 - protein, 159 aa, Populus trichocarpa
MAEQTEKAFLKQPKVFLSSKKSGKGKRPGKGGNRFWKSIGLSFKTPREATEGTYIDKKCPFTGTVSIRGRILAGTCHSAKMVRTIIVRRNYLHWVKKYQRYEKRHSNIPAHVSPCFRVREGDHVIIGQCRPLSKTVRFNVLKVIPAGSAAGGKKAFTGM

SEQ ID NO: 16370 - protein, 159 aa, Senecio madagascariensis
MAEQTEKAFLKQPKVFLCSKKSGKGKRPGKGGNRFWKSIGLGFKTPREAIEGSYIDKKCPFTGDVSIRGRILAGTCHSAKMVRTIIVRRDYLHYVSKYQRYEKRHSNIPAHISPCFRVKEGDHVTVGQCRPLSKTVRFNVLKVIPAGSSGAGKKAFTGF

SEQ ID NO: 16371 - protein, 159 aa, Sesamum indicum
MAEQTEKAFLKQPKVFLCSKKSGKGKAPGKGGNRYWKSIGLGFKTPREAVEGTYIDKKCPFTGNVSIRGRILAGTCHSAKMMRTIIVRRNYLHWVKKYQRYEKRHSNIPAHISPCFRVKEGDHVIIGQCRPLSKTVRFNVLKVIPAGSSSRGKKAFTGM

SEQ ID NO: 16372 - protein, 160 aa, Fragaria vesca
MAEQTEKAFLKQPKVFLSSKKTGKGKRPGKGGNRFWKSVGLGFKTPRDAIEGTYIDKKCPFTGNVSIRGRILAGTCHSAKMSRTIIVRRNYLHYIKKYQRYEKRHSNIPAHVSPCFRVKEGDHVIIGQCRPLSKTVRFNVLKVIPAGSSSAFGKKAFTGA

SEQ ID NO: 16373 - protein, 159 aa, Helianthus annuus
MAEQTEKAFLKQPKVFLCSKKSGKGKRPGKGGNRFWKNIGLGFKTPREAIEGTYIDKKCPFTGDVSIRGRILAGTCHSAKMVRTIIVRRDYLHYVKKYQRYEKRHSNIPAHISPCFRVKEGDHVTVGQCRPLSKTVRFNVLKVIPAGSASGGKKAFTGI

SEQ ID NO: 16374 - protein, 159 aa, Helianthus annuus
MAEQTEKAFLKQPKVFLCSKKSGKGKRPGKGGNRFWKNIGLGFKTPREAIEGTYIDKKCPFTGDVSIRGRILAGTCHSAKMVRTIIVRRDYLHYVKKYQRYEKRHSNIPAHISPCFRVKEGDHVTVGQCRPLSKTVRFNVLKVIPAGSSSGGKKAFTGI

SEQ ID NO: 16375 - protein, 159 aa, Triphysaria pusilla
MAEQTEKAFLKQPKVFLSSKKTGKGKAPGKGGNRYWKSIGLGFKTPREAIEATYIDKKCPFTGNVSIRGRILAGTCHSAKMVRTIIVRRNYLHWVKKYQRYEKRHSNIAAHISPCFRVKEGDHVIIGQCRPLSKTVRFNVLKVVPAGSSGLGKKAFTGM

SEQ ID NO: 16376 - protein, 159 aa, Tripterygium wilfordii
MAEQTEKAFLKQPKVFLSSKKTGKGKRPGKGGNRFWKSIGLGFKTPREAIEGTYIDKKCPFTGTVSIRGRILAGTCHSSKMMRSIIVRRNYLHFVKKYQRYEKRHSNIPAHVSPCFRVREGDHVIIGQCRPLSKTVRFNVLKVIPAGSSAGGKKAFTGM

SEQ ID NO: 16377 - protein, 159 aa, Vicia sativa
MAEQTEKAYLKQPKVFLCSKVSGKGKRPGKGGNRFWKSVGLGFKTPRDAIEGTYIDKKCPFTGNVSIRGRIIAGTCHSAKMNRTIIVRRNYLHFIKKYQRYEKRHSNIPAHVSPCFRVKEGDHVIIGQCRPLSKTVRFNVLKVIPAGSSNLAKKAFTGI

SEQ ID NO: 16378 - protein, 161 aa, Phalaenopsis aphrodite
MAEQTERAFLKQPKVFLSSKKSAKGNRPGKGGNRFWKNVGLGFKTPREAIEGTYIDKKCPFTGTVSIRGRILAGTCHSAKMNRTIIVRRDYLHYVKKYQRYEKRHSNIAAHISPCFRVKEGDHVIIGQCRPLAKTVRFNVLKVIPAGSTGGSKGKKAFAAV

SEQ ID NO: 16379 - protein, 159 aa, Amaranthus tuberculatus
MAEQTEKAFLKQPKVFLSSKKSGKGKRPGKGGNRFWKSIGLGFKTPRDAIEGTYIDKKCPFTGNVSIRGRILAGTCHSAKMQRTIIVRRNYLHYIKKYQRYEKRHSNISAHISPCFRVKEGDHVIIGQCRPLSKTVRFNVLKVIPAGSAAGGKKAFTGM

SEQ ID NO: 16380 - protein, 159 aa, Antirrhinum majus
MAEQTEKAFLKQPKVFLCSKKTGKGKAPGKGGNRYFKSIGLGFKTPREAVEGTYIDKKCPFVGNVSIRGRIIAGTCHSAKMVRTIIVRRSYLHWIKKYQRYEKRHSNIPAHISPCFRVKEGDHVIIGQCRPLSKTVRFNVLKVVPAGSSGRGKKAFTGM

SEQ ID NO: 16381 - protein, 159 aa, Malus domestica
MAEQTEKAFLKQPKVFLSSKKTGKGKRPGKGGNRFWKSVGLGFKTPRDAIEGTYIDKKCPFTGNVSIRGRILSGTCHSAKMSRTIIVRRNYLHYIKKYQRYEKRHSNIPAHVSPCFRVKEGDYVIIGQCRPLSKTVRFNVLKVTPAGSSGTGKKAFTGI

SEQ ID NO: 16382 - protein, 159 aa, Arnica chamissonis
MAEQTEKAFLKQPKVFLCSKKSGKGKRPGKGGNRFWKSIGLGFKTPREAIEGTYIDKKCPFTGDVSIRGRILAGTCHSAKMVRTIIVRRDYLHYVKKYQRYEKRHSNIPAHLSPCFRVKEGDRVTVGQCRPLSKTVRFNVLKVIPAGSSGGGKKAFTGI

SEQ ID NO: 16383 - protein, 159 aa, Persea americana
MAEQTEKAFLKQPKVFLCSKKSGKGKRPGKGGNRYWKSIGLGFKTPRDAIEGTYIDKKCPFTGNVSIRGRILSGTCHSAKMNRTIIVRRDYLHYVKKYQRYEKRHSNIPAHISPCFRAKEGDHVIIGQCRPLSKTVRFNVLKVIPAGSSGGGKKAFTAI

SEQ ID NO: 16384 - protein, 159 aa, Musa acuminata
MAEQTEKAFLKQPKVFLCPKKPGKGKRPGKGGNRFWKSIGLGFKTPREAIEGTYIDKKCPFTGNVSIRGRILAGTCHSAKMNRTIIVRRNYLHYVKKYQRYEKRHSNIAAHISPCFRVKEGDHVIIGQCRPLAKTVTFNVLKVIPAGSTGGGKKAFAAV

SEQ ID NO: 16385 - protein, 158 aa, Ocimum basilicum
MAEQTEKAFLKQPKVFLCSKKSGKGKAPGKGGNRYFKSIGLGFKTPREASEGTYIDKKCPFTGDVSIRGRIIAGTCHSAKMVRTIIVRRNYLHWVKKYQRYEKRHSNIPAHISPCFRVKEGDHVIIGQCRPLSKTVRFNVLKVIPAGSSTGKKAFAGM

SEQ ID NO: 16386 - protein, 160 aa, Brachypodium distachyon
MAEQTEKAFLKQPKVFLCPKKSDKGKRPGKAGNRFWKNVGLGFKTPKEAIEGAYIDKKCPFTGTVSIRGRIIAGTCHSAKMNRTIIICRNYLHFVKKYQRYEKRHSNIPAHIYPCFRVKEGDHVIIGQCRPLSKTVRFNILKVIPAGSTGGTGKKAFTAA

SEQ ID NO: 16387 - protein, 159 aa, Centaurea maculosa
MAEQTEKAFLKQPKVFLCSKKSGKGKRPGKGGNRFWKSIGLGFKTPREAIEGTYIDKKCPFTGDVSIRGRILSGTCHSAKMVRTIIARRDYLHFVKKYQRYEKRHSNIPAHISPCFRVKEGDHVIVGQCRPLSKTVRFNVLKVIPAGSSGGGKKAFTGI

SEQ ID NO: 16388 - protein, 156 aa, Cirsium arvense
QTEKAFLKQPKVFLCSKKSGKGKRPGKGGNRFWKSVGLGFKTPREAIEGTYIDKKCPFTGDVSIRGRILAGTCHSAKMVRTIIARRNYLHFVKKYQRYEKRHSNIPAHISPCFRVKEGDHVIVGQCRPLSKTVRFNVLKVIPAGSSGGGKKAFTGF

SEQ ID NO: 16389 - protein, 159 aa, Cyclamen graecum
MAEQTEKAFLKQHKVFLCSKKSGKGKRPGKGGNRYWKSIGLGFKTPRDAIEGTYIDRKCPFTGDVSIRGRIIAGTCHSAKMMRTIIVRRNYLHYVKKYQRYEKRHSNIPAHISPCFRVKEGDHVVIGQCRPLSKTVRFNVLKVVPAGSSAGGKKAFTAI

SEQ ID NO: 16390 - protein, 159 aa, Solanum melongena
MAEQTEKAFLKQPGVFLSSKKTGKGKRPGKGGNRYFKSIGLGFKTPREATEGTYIDKKCPFTGNVSIRGRILAGTCHSAKMNRTIIVRRNYLHYVKKYQRYEKRHSNIPAHISPCFRVKEGDHVIIGQCRPLSKTVRFNVLKVIPAGSGAGGKKAFTGM

SEQ ID NO: 16391 - protein, 159 aa, Festuca arundinacea
MAEQTEKSFLKQPKVFLSTKKADKAKRPGKAGNRFWKSVGLGFKTPREAIEGTYIDKKCPFTGTVAIRGRIIAGTCHSAKMNRTIIVRRNYLHYVKKYQRYEKRHSNIPAHISPCFRIKEGDHVIIGQCRPLSKTVRFNVLKVIPAGTTGGGKKAFIAA

SEQ ID NO: 16392 - protein, 155 aa, Gerbera hybrid cultivar
AEKAFLKQPKVFLCSKKSGKGKRPGKGGNRFWKSVGLGFKTPREAIEGTYIDKKCPFTGDVSIRGRILAGTCHSAKMVRTIIVRRNYLHYVKKYQRYEKRHSNIPAHISPCFRVKEGDHVTIGQCRPLSKTVRFNVLKVIPAGSSGGGKKAFTGI

SEQ ID NO: 16393 - protein, 159 aa, Ipomoea batatas
MAEQTEKAFLKQPGVFLSSKKTGKGKRPGKGGNRYWKSIGLGFKTPREAIEGTYIDKKCPFTGTVSIRGRILAGTCHSAKMNRTIIVRRNYLHFVKKYQRYEKRHSNIAAHVSPCFRVKEGDHVIIGQCRPLSKTVRFNVLKVIPAGSAGGGKKAFTGI

SEQ ID NO: 16394 - protein, 159 aa, Ipomoea nil
MAEQTEKAFLKQPGVFLSSKKTGKGKRPGKGGNRFWKSIGLGFKTPREATEGTYIDKKCPFTGTVSIRGRILAGTCHSAKMNRTIIVRRNYLHFVKKYQRYEKRHSNIAAHISPCFRVKEGDYVIIGQCRPLSKTVRFNVLKVIPAGSAGGGKKAFTGM

SEQ ID NO: 16395 - protein, 158 aa, Ipomoea nil
MAEQTEKAFLKQPGVFLSSKKTGKGKRPGKGGNRFWKSVGLGFKTPREAIEGAYIDKKCPFTGTVSIRGRILAGTCHSAKMTRTIIVRRNYLHFVKKYQRYEKRHSNIAAHISPCFRVKEGDYVIIGQCRPLSKTVRFNVLKVIPAGSGGGKKAFTGM

SEQ ID NO: 16396 - protein, 159 aa, Leymus cinereus x Leymus triticoides
  Sequence also found in Organisms: Secale cereale, Triticum aestivum
MAEQTEKSFLKQPKVFLSTKKADKAKRPGKAGNRFWKSVGLGFKTPREAIDGTYIDKKCPFTGTVAIRGRIIAGTCHSAKMNRTIIVRRNYLHFVKKYQRYEKRHSNIPAHISPCFRVKEGDHVIIGQCRPLSKTVRFNVLKVVPAGTTGGGKKAFIAA

SEQ ID NO: 16397 - protein, 160 aa, Pinus pinaster
MAEQTERAFLKQPKVFLSSKTSGKGKRPGKGGNRFWKNVGLGFKTPKEAIQGTYIDKKCPFTGTVSIRGRILAGTCYSAKMTRTIIVRRDYLHYVKKYQRYEKRHSNIPAHISPCFRVKEGDHVIIGQCRPLSKTVRFNVLKVIPAGSSSGSAKKAFTAI

SEQ ID NO: 16398 - protein, 159 aa, Tropaeolum majus
MAEQTEKAFLKQPKVFLSSKKAGKGKRPGKGGNRFWKSIGLGFKTPRDAIEGTYIDKKCPFTGNVSIRGRILAGTCHSAKMMRTIVVRRNYLHFVKKYQRYEKRHSNTPAHVSPCFRVKEGDHVIIGQCRPLSKTVRFNVLKVIPAGSSAAGKKAFTGM

SEQ ID NO: 16399 - protein, 159 aa, Nicotiana benthamiana
  Sequence also found in Organisms: Nicotiana tabacum
MAEQTEKAFLKQPGVFLSSKKTGKGKRPGKGGNRYFKSIGLGFKTPREAVEGTYIDKKCPFTGNVSIRGRILAGTCHSAKMNRTIIVRRNYLHYVKKYQRYEKRHSNIPAHISPCFRVKEGDHVIIGQCRPLSKTVRFNVLKVIPAGSAGGGKKAFTGM

SEQ ID NO: 16400 - protein, 159 aa, Nicotiana benthamiana
MAEQTEKAFLKQPGVFLSSKKTGKGKRPGKGGNRYFKSVGLGFKTPREATEGFYIDKKCPFTGNVSIRGRILAGTCHSAKMNRTIIVRRNYLHYVKKYQRYEKRHSNIPAHISPCFRVKEGDHVIIGQCRPLSKTVRFNVLKVIPAGSAGGGKKAFTGM

SEQ ID NO: 16401 - protein, 159 aa, Nicotiana benthamiana
  Sequence also found in Organisms: Nicotiana tabacum
MAEQTEKAFLKQPGVFLSSKKTGKGKRPGKGGNRYFKSIGLGFKTPREATEGTYIDKKCPFTGNVSIRGRILAGTCHSAKMNRTIIVRRNYLHYVKKYQRYEKRHSNIPAHISPCFRVKEGDHVIIGQCRPLSKTVRFNVLKVIPAGSAGGGKKAFTGM

SEQ ID NO: 16402 - protein, 159 aa, Avena sativa
MAEQTEKSFLKQPKVFLSTKKADKSKRPGKAGNRFWKSVGLGFKTPKEAIEGTYIDKKCPFTGTVAIRGRIIAGTCHSAKMNRTIIVRRNYLHFVKKYQRYEKRHSNIPAHISPCFRIKEGDHVIIGQCRPLSKTVRFNVLKVIPAGTTGGGKKAFIAA

SEQ ID NO: 16403 - protein, 159 aa, Allium cepa
MAEQTEKAFLKQPTVFLCSKKSGKGKKPGKAGNRLWRNVGLGFKTPREAIEGTYIDKKCPFTGHVSIRGRIIAGTCHSAKMNRTIIVRRNYLHYVKKYQRYEKRHSNIPAHVSPCFRVKEGDHVIIGQCRPLSKTVRFNVLRVIPAGSTGGGKKAFVAA

SEQ ID NO: 16404 - protein, 159 aa, Allium cepa
MAEQTEKAFLKQPTVFLCSKKTGKGKKPGKAGNRLWRNVGLGFKTPREAIEGTYIDKKCPFTGHVSIRGRIIAGTCHSAKMNRTIIVRRNYLHYVKKYQRYEKRHSNIPAHVSPCFRVKEGDHVIIGQCRPLSKTVRFNVLRVIPAGSTGGGKKAFVAA

SEQ ID NO: 16405 - protein, 159 aa, Petunia hybrida
MAEQTEKAFLKQPGVFLSSKKTGKGKRPGKGGNRYVKSIGLGFKTPREATEGTYIDKKCPFTGNVSIRGRILAGTCHSAKMNRTIIVRRNYLHYVKKYQRYEKRHSNIPAHISPCFRVKEGDHVIIGQCRPLSKTVRFNVLKVIPAGSAGGGKKAFTGM

SEQ ID NO: 16406 - protein, 160 aa, Pinus taeda
MAEQTERAFLKQPKVFLSSKKSGKGKRPGKGGNRFWKNVGLGFKTPKEAIQGTYIDKKCPFTGTVSIRGRILAGTCYSAKMTRTIIVRRDYLHFVKKYQRYEKRHSNIPAHISPCFRVKEGDHVIIGQCRPLSKTVRFNVLKVIPAGSSSGSAKKAFTAI

SEQ ID NO: 16407 - protein, 159 aa, Populus trichocarpa
MAEQTEKAFLKQPRVFLSSKKSGKGKRPGKGGNRFWKSIGLGFKTPRDAIEGTYIDKKCPFTGTVSVRGRILAGTCHSAKMNRTIIVRRNYLHWVKKYQRYEKRHSNIPAHISPCFRIREGDHVTIGQCRPLSKTVRFNVLKVIPAGSSGGAKKAFTAM

SEQ ID NO: 16408 - protein, 159 aa, Primula obconica
MAEQTEKAFLKQPKVFLCSKKSSKGKRPGKGGNRFWKNVGLGFKVPVEAKTGTYIDKKCPFTGDVSIRGRILAGTCHSAKMMRTIIVRRNYLHYVKKYQRYEKRHSNIAAHISPCFRVKEGDHVIIGQCRPLSKTVRFNVLKVIPAGSSGTGKKAFAGI

SEQ ID NO: 16409 - protein, 159 aa, Prunus persica
MAEQTEKAFLKQPKVFLSSKKTGKGKRPGKGGNRFWKSVGLGFKTPRDAIEGTYIDKKCPFTGNVSIRGRVLSGTCHSAKMSRTIIVRRNYLHYIKKYQRYEKRHSNIPAHVSPCFRVKEGDYVIIGQCRPLSKTVRFNVLKVTPAGSSGAGKKAFTGI

SEQ ID NO: 16410 - protein, 159 aa, Rosa hybrid cultivar
MAEQTEKAFLKQPKVFLSSKKTGKGKRPGKGGNRFWKSVGLGFKTPRDAIEGTYIDKKCPFTGNVSIRGRILAGTCHSAKMSRTIIVRRNYLHYIKKYQRYEKRHSNIPAHVSPCFRVKEGDHVIIGQCRPLSKTVRFNVLKVIPAGASAGGKKAFTGA

SEQ ID NO: 16411 - protein, 159 aa, Salvia sclarea
MAEQTEKAFLKQPKVFLCSKKTGKGKTPGKGGNRYFKSIGLGFKTPREASEATYIDKKCPFTGNVSIRGRILAGTCHSAKMVRTIIVRRNYLHWVKKYQRYEKRHSNIPAHISPCFRVREGDHVIIGQCRPLSKTVRFNVLKVIPAGSSGLGKKVFTGM

SEQ ID NO: 16412 - protein, 159 aa, Helianthus annuus
MAEQTEKAFLKQPKVFLCSKKSGKGKRPGKGGNRFWKNIGLGFKTPREAIEGTYIDKKCPFTGDVSIRGRILAGTCHSAKMVRTIIVRRDYLHYVKKYQRYEKRHSNIPAHISPCFRVKEGDHVTVGQCRPLSKTVRFNVLRVIPAGSASAGKKAFTGI

SEQ ID NO: 16413 - protein, 159 aa, Eutrema parvulum
MAEQTEKAFLKQPKVFLCSKKSGKGKRPGKGGNRFWKNIGLGFKTPREATEGAYIDKKCPFTGTVSIRGRILAGTCHSAKMQRTIIVRRNYLHFVKKYQRYEKRHSNIPAHVSPCFRVKEGDHVIIGQCRPLSKTVRFNVLKVIPAGSSAIGKKAFTGM

SEQ ID NO: 16414 - protein, 159 aa, Nicotiana tabacum
MAEQTEKAFLKQPGVFLSSKKTGKGKRPGKGGNRYFKSIGLGFKTPREAIEGSYIDKKCPFTGNVSIRGRILAGTCHSAKMNRTIIVRRNYLHYVKKYQRYEKRHSNIPAHISPCFRVKEGDHVIIGQCRPLSKTVRFNVLKVIPAGSAGGGKKAFTGM

SEQ ID NO: 16415 - protein, 159 aa, Nicotiana tabacum
MAEQTEKAFLKQAGVFLSSKKTGKGKRPGKGGNRYFKSIGLGFKTPREAVEGTYIDKKCPFTGNVSIRGRIIAGTCHSAKMNRTIIVRRNYLHYVKKYQRYEKRHSNIPAHISPCFRVKEGDHVIIGQCRPLSKTVRFNVLKVIPAGSAGGGKKAFTGM

SEQ ID NO: 16416 - protein, 159 aa, Triphysaria pusilla
MAEQTEKAFLKQPKVFLSSKKTGKGKAPGKGGNRYWKSIGLGFKTPREAIEATYIDKKCPFTGNVSIRGRILAGTCHSAKMVRTIIVRRNYLHWVKKYQRYEKRHSNIAAHISPCFRVKEGDHVIIGQCRPLSKTVRFNVLKVVPAGSSGRGKKAFTFI

SEQ ID NO: 16417 - protein, 159 aa, Triphysaria pusilla
MAEQTEKAFLKQPKVFLSSKKTGKGKAPGKGGNRYFKSIGLSFKTPREAIEGTYIDKKCPFTGGVSIRGRILAGTCHSAKMVRTIIVRRNYLHWVKKYQRYEKRHSNIAAHISPCFRVKEGDHVIIGQCRPLSKTVRFNVLKVVPAGSSGLGKKAFTGA

SEQ ID NO: 16418 - protein, 159 aa, Juglans hindsii x Juglans regia
MAEQTEKAFLKQPKVFLCSKKSGKGKRPGKGGNRFWKSIGLGFKTPREAIEGTYIDKKCPFTGDVSIRGRILAGTCHSAKMMRTIIVRRNYLHFVKKYQRYEKRHSNIAAHISPCFRVKEGDYVTIGQCRPLSKTVRFNVLKVIPAGSSGGGKKAFAGI

SEQ ID NO: 16419 - protein, 155 aa, Citrullus lanatus
MAEQTEKAFLKQPKVFLCSKKAGKGKRPGKGGNRFWKSIGLGFKTPREAIEGTYIDKKCPFTGTVSVRGRILAGTCHSAKMVRTIIVRRNYLHYVKKYQRYEKRHPAHISPCFRVKEGDHVIIGQCRPLSKTVRFNVLKVIAGSSSRGKKAFAGI

SEQ ID NO: 16420 - protein, 161 aa, Medicago truncatula
MAEQTEKAFLKQNKVFLCSKISGKGKRPGKGGNRFHKTVGLGFKTPREAIEGTYIDKKCPFTGNVSIRGRIISGTCHSAKMNKTIVVRRNYLHFIKKYQRYEKRHSNIPAHVSPCFRVKEGDHVIIGQCRPLSKTVRFNVLKVIPAGSSSGAGAKKAFTGV

SEQ ID NO: 16421 - protein, 161 aa, Panicum virgatum
MAEQTEKAFLKQPKVFLSTKKSAKDKKPGKGGSRFWKSIGLGFKTPREAIEGTYIDKKCPFTGTVSIRGRIIAGACHSAKMNRTIIVRRNYLHFVKKYQRYEKRHSNIPAHISPCFRVKEGDHVIIGQCRPLSKTVRFNVVKVIPAGSTDGRGGKKAFTAA

SEQ ID NO: 16422 - protein, 160 aa, Pinus pinaster
  Sequence also found in Organisms: Pinus taeda
MAEQTERAFLKQPKVFLSSKTSGKGKRPGKGGNRFWKNVGLGFKTPKEAIQGTYIDKKCPFTGTVSIRGRILAGTCYSAKMTRTIIVRRDYLHFVKKYQRYEKRHSNIPAHISPCFRVKEGDHVIIGQCRPLSKTVRFNVLKVIPAGSSSGSAKKAFTAI

SEQ ID NO: 16423 - protein, 159 aa, Antirrhinum majus
MAEQTEKAFLKQPKVFLSSKKTGKGKAPGKGGNRYFKSIGLGFKTPREAVEGTYIDKKCPFVGDVSIRGRIIAGTCHSAKMVRTIIVRRSYLHWIKKYQRYEKRHSNIPAHISPCFRVKEGDHVIIGQCRPLSKTVRFNVLKVVPAGSSGRGKKAFTGI

SEQ ID NO: 16424 - protein, 159 aa, Fagus grandifolia
MAEQTEKAFLKQPKVFICSKKTGKGKRPGKGGNRFWKSVGLGIKTPREAIQGTYIDKKCPFTGNVSIRGRQLTGTCHSAKMVRTIIVRRDYLHFVKKYQRYEKRHSNIPAHISPCFRVKEGDHIIIGQCRPLSKTVRFNVLKVVPAGSSGGGKKAFTGM

SEQ ID NO: 16425 - protein, 159 aa, Vaccinium corymbosum
MAEQTEKAFLKQPKVFLSSKKTGKGKRPGKGGNRYFKNVGLGFKTPREAIDGTYIDKKCPFTGNVSIRGRIISGTCHSAKMMRTIIVRRNYLHYVKKYQRYEKRHSNIPAHISPCFRVKEGDHVTIGQCRPLSKTVRFNVLKVIPAGSSGGGKKAFTAM

SEQ ID NO: 16426 - protein, 159 aa, Bruguiera gymnorhiza
MAEQTEKAFLKQPKVFLCSKKSGKGKRPGKGGNRYWKNIGLGFKTPREAIEGTYIDKKCPFTGNVSIRGRILAGVCHSAKMNRTIIVRRNYLHFVKKYQRYEKRHSNIAAHVSPCFRVKEGDHVIIGQCRPLSKTVRFNVLKVIPAGSSAGGKKAFTGM

SEQ ID NO: 16427 - protein, 160 aa, Trifolium pratense
MAEQTEKAYLKQPKVFLSSKKSGKGKRPGKGGNRFWKSIGLSFKTPRDAIEGTYIDKKCPFTGNVSIRGRILSGTCHSAKMNRTIIVRRNYLHFIKKYQRYEKRHSNIPAHVSPCFRVKEGDHVIIGQCRPLSKTVRFNVLKVIPAGSSSGAGKKAFTGI

SEQ ID NO: 16428 - protein, 159 aa, Cyclamen graecum
MAEQTEKAFLKQPKVFLSSKKSSKGKRPGKGGNRYWKSIGLGFKTPREAIEGTYIDKKCPFTGDVSIRGRILTGTCHSAKMNRSIIVRRDYLHYVKKYQRYEKRHSNIPAHISPCFRVKEGDHVVIGQCRPLSKTVRFNVLKVVPAGSSAGGKKAFTAI

SEQ ID NO: 16429 - protein, 159 aa, Taraxacum officinale
MAEQTEKAFLKQPKVFICSKKSGKGKRPGKGGNRFFKSVGLGFKTPREAIEGTYIDKKCPFTGDVSIRGRILAGTCHSAKMVRTIIVRRDYFHYVKKYKRYEKRHSNTPAHISPCFRVKEGDRVTIGQCRPLSKTVRFNVLKVVPAGSSGGGKKAFTGF

SEQ ID NO: 16430 - protein, 159 aa, Euonymus alatus
MAEQTEKAFLKQPKVFLSSKKTGKGKRPGKGGNRFWKNIGLGFKTPREATEGTYIDKKCPFTGTVSIRGRILAGTCHSAKMNRTIIVRRNYLHFVKKYQRYEKRHSNIPAHVSPCFRVKEGDHVIIGQCRPLSKTVRFNVLKVIPAGTGGSGKKAFTAI

SEQ ID NO: 16431 - protein, 159 aa, Euonymus alatus
MAEQTEKAFLKQPKVFLSSKKTGKGKRPGKGGNRFWKSIGLGFKTPREAIEGTYIDKKCPFTGTVSIRGRILAGTCHSSKMMRTIVVRRNYLHFVKKYQRYEKRHSNITAHASPCFRVREGDHVIIGQCRPLSKTVRFNVLKVIPAGASAGGKKAFTGM

SEQ ID NO: 16432 - protein, 155 aa, Euphorbia peplus
TEKAFLKQPKVFLSSKKSGKGKRPGKGGNRFWKSIGLGFKTPREAIEGTYIDKKCPFTGTVSIRGRILAGTCHSAKMNRTIIVRRNYLHFIKKYQRYEKRHSNIPAHISPCFRVKEGDHVIIGQCRPLSKTVRFNVLKVIPAGSSGGAKKAFTAI

SEQ ID NO: 16433 - protein, 159 aa, Festuca arundinacea
  Sequence also found in Organisms: Lolium multiflorum, Avena sativa
MAEQTEKSFLKQPKVFLSTKKADKAKRPGKAGNRFWKSVGLGFKTPREAIEGTYIDKKCPFTGTVAIRGRIIAGTCHSAKMNRTIIVRRNYLHFVKKYQRYEKRHSNIPAHISPCFRIKEGDHVIIGQCRPLSKTVRFNVLKVIPAGTTGGGKKAFIAA

SEQ ID NO: 16434 - protein, 159 aa, Carpinus betulus
MAEQTEKAFLKQPNVFLCSKKSGKGKRPGKGGNRFWKSVGLGFKTPREAIDGTYIDKKCPFTGNVSIRGRILSGTCHSAKMIRTIIVRRNYLHFVKKYQRYEKRHSNIPAHISPCFRVKEGDYVTVGQCRPLSKTVRFNVLKVIPAGSSGGGKKAFTGL

SEQ ID NO: 16435 - protein, 159 aa, Ipomoea batatas
MAEQTEKAFLKQPGVFLSSKKTGKGKRPGKGGNRYWKSIGLGFKTPREATEGTYIDKKCPFTGTVSIRGRILAGTCHSAKMTRTIIVRRNYLHFVKKYQRYEKRHSNIAAHISPCFRVKEGDHVIIGQCRPLSKTVRFNVLKVIPAGSAGGGKKAFTGM

SEQ ID NO: 16436 - protein, 159 aa, Lupinus angustifolius
MAEQTEKAFLKQPKVFLSSKKSGKGKRPGKGGNRFWKSIGLGFKTPREAIDGTYIDKKCPFTGNVSIRGRILSGTCHSAKMNRTIIVRRNYLHFIKKYQRYEKRHSNIPAHVSPCFRVKEGDHVIIGQCRPISKTVRFNVLKVIPAGSSGGAKKAFTGI

SEQ ID NO: 16437 - protein, 159 aa, Lupinus angustifolius
MAEQTEKAFLKQPKVFLSSHKSGKGKRPGKGGNRFWKSIGLGFKTPRDAIEGTYIDKKCPFTGNVSIRGRIIAGTCHSAKMTRTIIVRRNYLHYIKKYQRYEKRHSNIPAHVSPCFRVKEGDHVIIGQCRPISKTVRFNVLKVIPAGSSTGAKKAFAGL

SEQ ID NO: 16438 - protein, 159 aa, Tropaeolum majus
MAEQTEKAFLKQPKVFLSSKKTGKGKRPGKGGNRFWKSIGLGFKTPRDAIEGTYIDKKCPFTGNVSIRGRILAGTCHSAKMMRTIVVRRNYLHFVKKYQRYEKRHSNTPAHVSPCFRVKEGDHVIIGQCRPLSKTVRFNVLKVIPAGSSVAGKKAFTGM

SEQ ID NO: 16439 - protein, 159 aa, Olea europaea
MAEQTEKAFLKQPKVFLCSKKTGKGKRPGKGGNRYWKSIGLGFKTPREATEATYIDKKCPFTGDVSIRGRILAGTCHSAKMMRTIIVRRNYLHWVKKYQRYEKRHSNIPAHVSPCFRVKEGDHVIIGQCRPLSKTVRFNVLKVIPAGSSSLGKKAFTGM

SEQ ID NO: 16440 - protein, 159 aa, Pisum sativum
MAEQTEKAYLKQPKVFLCSKISGKGKRPGKGGNRFWKSVGLGFKTPRDAIEGTYIDKKCPFTGNVSIRGRIIAGTCHSAKMNRTIIVRRNYLHFIKKYQRYEKRHSNIPAHVSPCFRVKEGDHVTIGQCRPISKTVRFNVLKVLPAGSSNLAKKAFTGI

SEQ ID NO: 16441 - protein, 159 aa, Lippia dulcis
MAEQTEKAFLKQPKVFLCSKKSGKGKAPGKGGNRYFKSIGLGFKTPREASEGTYIDKKCPFTGNVSIRGRILAGTCHSAKMVRTIIVRRNYLHWVKKYQRYEKRHSNIPAHISPCFRVKEGDHVTIGQCRPLSKTVRFNVLKVIPAGSSGLGKKAFTAM

SEQ ID NO: 16442 - protein, 159 aa, Plantago ovata
MAEQTEKAFLKQPKVFLCSKKTGKGKRPGKGGNRYFKSIGLGFKTPREAIEGTYIDKKCPFTGDVSIRGRILSGTCHSAKMVRTIIVRRDYLHWVKKYQRYEKRHSNTPAHISPCFRVKEGDHVTIGQCRPLSKTVRFNVLKVVPAGSSGRGKKAFTGM

SEQ ID NO: 16443 - protein, 159 aa, Plantago ovata
MAEQTEKAFLKQPKVFLCSKKSGKGKRPGKGGNRYFKSIGLGFKTPREAIEGTYIDKKCPFTGDVSIRGRILSGTCHSAKMVRTIIVRRDYLHWVKKYQRYEKRHSNTPAHISPCFRVKEGDHVTIGQCRPLSKTVRFNVLKVVPAGSSGRGKKAFTGM

SEQ ID NO: 16444 - protein, 159 aa, Solanum tuberosum
  Sequence also found in Organisms: Solanum phureja
MAEQTEKAFLKQPGVFLSSKKTGKGKRPGKGGNRYFKSIGLGFKTPREATEGTYIDKKCPFTGNVSIRGRILAGTCHSAKMNRTIIVRRNYLHYVKKYQRYEKRHSNIPAHISPCFRVKEGDHVTIGQCRPLSKTVRFNVLKVIPAGSGGGGKKAFTGI

SEQ ID NO: 16445 - protein, 159 aa, Solanum lycopersicum
  Sequence also found in Organisms: Solanum tuberosum, Solanum phureja
MAEQTEKAFLKQPGVFLSSKKTGKGKRPGKGGNRYFKSIGLGFKTPREATEGTYIDKKCPFTGNVSIRGRILAGTCHSAKMNRTIIVRRNYLHYVKKYQRYEKRHSNIPAHISPCFRVKEGDHVTIGQCRPLSKTVRFNVLKVIPAGSGGGGKKAFTGM

SEQ ID NO: 16446 - protein, 159 aa, Rosa hybrid cultivar
MAEQTERAFLKQPKVFLSSKKTGKGKRPGKGGNRFWKSVGLGFKTPRDAIEGTYIDKKCPFTGNVSIRGRILAGTCHSAKMSRTIIVRRNYLHYIKKYQRYEKRHSNIPAHVSPCFRVKEGDHVIIGQCRPLSKTVRFNVLKVIPAGASAGGKKAFTGA

SEQ ID NO: 16447 - protein, 159 aa, Carthamus tinctorius
MAEQTEKAFLKQPKVFLCSKKSGKGKRPGKGGTRFWKSVGLGFKTPREAIEGTYIDKKCPFTGDVSIRGRILAGTCHSAKMVGTIIARRDYLHFVKKYKRYEKRHSNIPAHISPCFRVKEGDHVIVGQCRPLSKTVRFNVLKVIPAGSSGGGKKAFTGI

SEQ ID NO: 16448 - protein, 159 aa, Salvia sclarea
MAEQTEKAFLKQPKVFLCSKKTGKGKRPGKGGNRFFKSIGLGFKTPREATEGTYIDKKCPFTGDVSIRGRILAGTCHSAKMVRTIIVRRNYLHWVKKYQRYEKRHSNTPAHISPCFRVKEGDHVTIGQCRPLSKTVRFNVLKVIPAGSSGLGKKAFTAM

SEQ ID NO: 16449 - protein, 160 aa, Sequoia sempervirens
MAEQTEKAFLKQPKVFLCSKKSGKGKRPGKGGNRFWKNIGLGFKTPKEAVQGTYIDKKCPFTGNVSIRGRILTGTCHSAKMNRTIIVRRNYLHFVKKYQRYEKRHSNIPAHISPCFRVKEGDHVIIGQCRPLSKTVRFNVLKVIPAGSSSGSAKKGFAAI

SEQ ID NO: 16450 - protein, 159 aa, Tabernaemontana elegans
MAEQTEKAFLKQPKVFLCSKKSTKGKRPGKGGNRYWKSIGLGFKTPREALEGTYIDKKCPFTGSVSIRGRILAGTCHSAKMVRTIVVRRNYMQFVKKYQRYEKRHSNIPAHISPCFRVKEGDHVIIGQCRPLSKTVRFNVLKVIPAGSSAGGKKAFTGM

SEQ ID NO: 16451 - protein, 159 aa, Solanum lycopersicum
MAEQTEKAFLKQPGVFLSSKKTGKGKRPGKGGNRYFKSIGLGFKTPREATEGTYIDKKCPFTGNVSIRGRILAGTCHSAKMNRTIIVRRNYLHYVKKYQRYEKRHSNIPAHISPCFRVKEGDHVTIGQCRPLSKTVRFNVLKVIPAGSGGVGKKAFTGM

SEQ ID NO: 16452 - protein, 159 aa, Triphysaria pusilla
MAEQTEKAFLKQPKVFLSSKKTGKGKAPGKGGNRYWKSIGLGFKTPREAIEATYIDKKCPFTGNVSIRGRILAGTCHSAKMVRTIIVRRNYLHWVSKYQRYEKRHSNIAAHISPCFRVKEGDHVIIGQCRPLSKTVRFNVLKVVPAGSSGRGKKAFTFI

SEQ ID NO: 16453 - protein, 159 aa, Tripterygium wilfordii
MAEQTEKAFLKQPKVFLCSKKTGKGKRPGKGGNRFWKNIGLGFKTPREAIDGTYIDKKCPFAGTVSIRGRILAGTCHSAKMTRTIIVRRNYLHFVKKYQRYEKRHSNIPAHVSPCFRVKEGDHVIIGQCRPLSKTVRFNVLKVIPAGSGGSGKKAFTAI

SEQ ID NO: 16454 - protein, 159 aa, Tripterygium wilfordii
MAEQTEKAFLKQPKVFLSSKKTGKGKRPGKGGNRFWKSIGLGFKTPREAIEGTYIDKKCPFTGTVSIRGRILAGTCHSAKMMRSIVVRRNYLHFVKKYQRYEKRHSNIPAHVSPCFRVKEGDHVIIGQCRPLSKTVRFNVLKVIPAGSSASGKKAFAGM

SEQ ID NO: 16455 - protein, 160 aa, Valeriana officinalis
MAEQTEKAFLKQPKVFLSSKKSGKGKRPGKAGNRFYKSIGLNFKTPREAIEGTYIDKKCPFTGNVSIRGRIIKGTCHSAKMVRTIIVRRNYLHYVKKYQRYEKRHSNIPAHVSPCFRVKEGDHIIIGQCRPLSKTVRFNVLKVVPAGSSGGVGKKAFVGI

SEQ ID NO: 16456 - protein, 160 aa, Valeriana officinalis
MAEQTEKAFLKQPKVFLSSKKSGKGKRPGKAGNRFYKSIGLNFKTPREAIDGTYIDKKCPFTGNVSIRGRIIKGTCHSAKMVRTIIVRRNYLHYVKKYQRYEKRHSNIPAHVSPCFRVKEGDHIIIGQCRPLSKTVRFNVLKVVPAGSSGGVGKKAFTGI

SEQ ID NO: 16457 - protein, 159 aa, Zostera marina
MADQTEKAFLKQPKVFLSSKKSGKARKPGKGGNRFWKSIGLGFKTPKSAIEGHYIDKKCPFTGTVSIRGRIITGTCHSAKMNRTIIVRRNYLHFVKKYQRYEKRHSNIPAHISPCFRAKEGDHIIIGQCRPLSKTVRFNVLKVIPAGSTGGGKKAFTAI

SEQ ID NO: 16458 - protein, 163 aa, Elaeis guineensis
MAEQTERAFLKQPKVFLCSKKSGKGKRPGKGGNRFWKSIGLGFKTPREAIEGAYVDKKCPFTGNVSIRGRILAGTCHSAKMNRTIIVRRNYLHYVKKYQRYEKRHSNIAAHISPCFRVKEGDHVIIGQCRPLSKTVRFNVLKVIPAGSKGGSGKKAFTAIRSF

SEQ ID NO: 16459 - protein, 159 aa, Rosmarinus officinalis
MAEQTEKAFLKQPKVFLCSKKSGKGKRPGKGGNRYWKSIGLGFKTPRDAIEGTYIDKKCPFTGNVSIRGRILTGTCHSAKMVRTIIVRRNYLHFVKKYQRFEKRHSNIPAHVSPCFRVKEGDHVTIGQCRPLSKTVRFNVLKVVPAGSSGGGKKAFTVM

SEQ ID NO: 16460 - protein, 159 aa, Rosmarinus officinalis
MAEQTEKAFLKQPRVFLSSKKSGKGKRPGKGGNRYWKSIGLGFKTPREAIEGTYIDKKCPFTGNVSIRGRILAGTCHSAKMVRTIVVRRNYLHFVKKYQRYEKRHSNIPAHISPCFRVKEGDHVYIGQCRPLSKTVRFNVLKVIPAGSSGGGKKAFTLI

SEQ ID NO: 16461 - protein, 159 aa, Amsonia hubrichtii
MAEQTEKAFLKQPKVFLCSKKTSKGKRPGKGGNRYFKSIGLGFKTPREATEATYIDKKCPFTGSVSIRGRILAGTCHSAKMVRTIIVRRNYLHFVKKYQRYEKRHSNIPAHVSPCFRVKEGDHVIIGQCRPLSKTVRFNVLKVIPAGSSAGGKKAFTGM

SEQ ID NO: 16462 - protein, 159 aa, Arabidopsis lyrata
MAEQTEKAFLKQPKVFLSSKKSGKGKRPGKGGNRFWKNIGLGFKTPREATEGAYIDKKCPFTGTVSIRGRILAGTCHSAKMQRTIIVRRNYLHFVKKYQRYEKRHSNIPAHVSPCFRVKEGDHVIIGQCRPLSKTVRFNVLKVIPAGSSAIGKKAFSGM

SEQ ID NO: 16463 - protein, 159 aa, Arabidopsis lyrata
MAEQTEKAFLKQPKVFLSSKTSGKGKRPGKGGNRFWKNIGLGFKTPREAIEGAYIDSKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFGKKAFTGV

SEQ ID NO: 16464 - protein, 159 aa, Catharanthus roseus
MAEQTEKAFLKQPKVFLCSKKTGKGKRPGKGGNRYWKSIGLGFKTPRDAIEGTYIDKKCPFTGNVSIRGRILTGTCHSAKMVRTIIVRRNYLHFVKKYQRYEKRHSNTPAHVSPCFRVKEGDHVTIGQCRPLSKTVRFNVLKVIPAGSSGTGKKAFTGM

SEQ ID NO: 16465 - protein, 160 aa, Cedrus atlantica
MAEQTERAFLKQPKVFLSSKKSGKGKRPGKGGNRFWKNIGLGFKTPKEAVQGTYIDKKCPFTGNVSIRGRILAGTCYSAKMNRTIIVRRDYLHFVKKYQRYEKRHSNIPAHISPCFRVKEGDHVIIGQCRPLSKTVRFNVLKVIPAGSSSGSAKKAFTAI

SEQ ID NO: 16466 - protein, 160 aa, Cichorium intybus
MAEQTEKAFLKQPKVFLCSKKSGKGKRPGKGGNRFWKSVGLGFKTPREAIEGTYIDKKCPFTGDVSIRGRILTGTCNSAKMVRTIIVRRDYFHYIKKYQRYEKRHSNTPAHISPCFRVKEGDHVTIGQCRPLSKTVRFNVLKVIPAGSSGGGGKKAFTGF

SEQ ID NO: 16467 - protein, 159 aa, Cleome spinosa
MAEQTEKAFLKQPKVFLCSKKTGKGKRPGKGGNRFWKNIGLGFKTPREAIEGTFIDKKCPFTGTVSVRGRILAGTCHSAKMQRTIIVRRNYLHFVRKYQRYEKRHSNIPAHVSPSFRVKEGDHVIIGQCRPLSKTVRFNVLKVIPAGSAAGGKKAFTGM

SEQ ID NO: 16468 - protein, 159 aa, Cleome spinosa
MAEQTEKAFLKQPRVFLCSKKTGKGKRPGKGGNRFWKNVGLGFKTPREAIEGTFIDKKCPFTGPVSVRGRILAGTCHSAKMQRTIIVRRNYLHFVRKYQRYEKRHSNIPAHVSPCFRVKEGDHVIIGQCRPLSKTVRFNVLKVIPAGSAAGGKKAFTGM

SEQ ID NO: 16469 - protein, 159 aa, Trifolium pratense
MAEQTEKAFSKQQKVFLSSKKSGKGKRPGKGGNRFWKSVGLGFKPPRDAIEGTYIDKKCPYTGNVSIRGRILAGTCHSAKMNRTIIVKRDYLHFVKKYQRYEKRHSNIPAHISPCFRVKEGDHVIIGQCRPLSKTVRFNALKVIPAGSASGAKKAFTGI

SEQ ID NO: 16470 - protein, 159 aa, Cyclamen graecum
MAEQTEKAFLKQHKVFLCSKKSGKGKRPGKGGNRYWKSIGLGFKTPRDAIEGTYIDRKCPFTGDVSIRGRIIAGTCHSAKMMRTIIVRRNYLHYVKKYQRYEKRHSNIPAHISPCFRVKEGDHVTIGQCRPLSKTVRFNVLKVIPAGSAAGGKKAFAAI

SEQ ID NO: 16471 - protein, 159 aa, Cyclamen graecum
MAEQTEKAFLKQHKVFLSSKKSGKGKRPGKGGNRYWKSIGLGFKTPREAIEGTYIDKKCPFTGDVSIRGRILAGTCHSAKMMRTIIVRRNYLHYVKKYQRYEKRHSNIAAHLSPCFRVKEGDHVTIGQCRPLSKTVRFNVLKVIPAGSSGTGKKAFTAI

SEQ ID NO: 16472 - protein, 160 aa, Distylium racemosum
MAEQTEKAFLKQPKVFLCSKKSGKGKRPGKGGTRFWKNIGLGFKTPKEAIQGTYIDKKCPFTGNVSIRGRILTGTCYSAKMNRTIIVRRNYLHFVKKYQRYEKRHSNIPAHISPCFRVKEGDHVIIGQCRPLSKTVRFNVLKVIPAGSSGGAAKKGFAAM

SEQ ID NO: 16473 - protein, 160 aa, Epimedium sagittatum
MAEQTEKAYLKQPKVFLCSKKSGKGKRPGKGGNRFWKSVGLGFKTPRDAIEGTYIDKKCPFTGDVSIRGRILAGTCHSAKMVRTIIVRRNYLHYVKKYQRYEKRHSNIPAHVSPCFRVKEGDHVTIGQCRPLSKTVRFNVLKVIPAGSSGGGGKKGFAAM

SEQ ID NO: 16474 - protein, 160 aa, Eschscholzia californica
MAEQTEKAFLKQPKVFLCSKKSGKGKRPGKGGNRFFKSIGLGFKTPREAIEGTYIDKKCPFTGNVSIRGRILSGTCHSAKMVRTIIVRRNYLHYVKKYQRYEKRHSNIPAHISPCFRVKEGDHVTVGQCRPLSKTVRFNVLKVIPAGSSGGGGKKAFVAM

SEQ ID NO: 16475 - protein, 160 aa, Eucalyptus grandis
MDAQTEKAFLKQPKVFLCSKKSGKGKRPGKGGNRYHKSVGLGFKTPREAIEGTYIDKKCPFTGNVSIRGRILAGTCHSAKMMRTIIVRRNYLHFVKKYQRYEKRHSNIPAHISPCFRVKEGDHVTVGQCRPLSKTVRFNVLKVIPAGSSGGGGKKAFTGM

SEQ ID NO: 16476 - protein, 159 aa, Euonymus alatus
MAEQTEKAFLKQPKVFLSSKKTGKGRRPGKGGNRFWKNIGLGFKTPRDATEGTYIDKKCPFTGTVSIRGRILAGTCHSAKMTRTIIVRRNYLHFVKKYQRYEKRHSNIPAHVSPCFRVKEGDHVIIGQCRPLSKTVRFNVLKVIPAGSGGSGKKAFTAI

SEQ ID NO: 16477 - protein, 159 aa, Ipomoea nil
MAEQTEKAFLKQPGVFLSSKKTGKGKRPGKGGNRYWKSIGLGFKTPREATEGTYIDKKCPFAGTVSIRGRILAGTCHSAKMTRTIIVRRNYLHFVKKYQRYEKRHSNIAAHVSPCFRVKEGDHVIIGQCRPLSKTVRFNVLKVIPAGSASGGKKAFTGM

SEQ ID NO: 16478 - protein, 159 aa, Jatropha curcas
MAEQTEKAFLKQPKVFLSSKKSGKGKRPGKGGNRFWKSIGLGFKTPREAIEGTYIDKKCPFTGTVSVRGRILAGTCHSAKMIRTIIVRRNYLHFIKKYQKYEKRHSNIPTNISPCFRVKEGDHVIIGQCRPLSKTVRFNVLKVIPAGSSGGGKMAFTGM

SEQ ID NO: 16479 - protein, 159 aa, Actinidia deliciosa
MAEQTEKAFLKQPKVFLSSKKTGKGKRPGKGGNRYWKSIGLGFKTPRDAIEGTYIDKKCPFTGDVSIRGRILAGTCHSAKMMRTIIVRRNYLHYVKKYRRYEKRHSNIPAHISPCFRIKEGDHVTIGQCRPLSKTVRFNVLKVIPAGSSGGGKKAFTAI

SEQ ID NO: 16480 - protein, 160 aa, Liriodendron tulipifera
MAEQTEKAFLKQPKVFLSSKKTGKGKRPGKGGNRYWKSIGLGFKTPRDAIEGTYIDKKCPFTGSVSIRGRILAGTCHSAKMMRTIIVRRNYLHYVKKYQRYEKRHSNIPAHVSPCFRVKEGDHVIIGQCRPLSKTVRFNVLKVIPAGSSGGGGKKAFAAI

SEQ ID NO: 16481 - protein, 160 aa, Pinus pinaster
MAEQTERAFLKQPKVFLSSKTSGKGKRPGKGGNRFWKNVGLGFKTPKEAVQGTYIDKKCPFTGTVSIRGRILAGTCYSAKMTRTIIVRRDYLHFVKKYQRYEKRHSNIPAHISPCFRVKEGDHVIIGQCRPLSKTVRFNVLKVIPAGSSSGSAKKAFTAI

SEQ ID NO: 16482 - protein, 159 aa, Avena sativa
MAEQTEKSFLKQPKVFLSTKKADKAKRPGKAGNRFWKSVGLGFKTPREAIEGTYIDKKCPFTGTVAIRGRIIAGTCHSAKMNRTIIVRRNYLHFVKKYQRYEKRHSNIPAHISPCFRIKESDHVIIGQCRPLSKTVRFNVLKVIPAGTTGGGKKAFIAA

SEQ ID NO: 16483 - protein, 159 aa, Olea europaea
MAEQTEKAFLKQPNVFICSKKTGKGKRPGKGGNRYFKSIGLGFKTPREATEGTYIDKKCPFTGDVSIRGRILAGTCHSAKMMRTIIVRRNYLHWVKKYQRYEKRHSNIPAHLSPCFRVKEGDHVIIGQCRPLSKTVRFNVLKVIPAGSSGLGKKAFTGM

SEQ ID NO: 16484 - protein, 160 aa, Papaver somniferum
MAEQTEKAFLKQPKVFICSKVSGKGKRPGKGGNRFYKNVGLGFKTPREAIEGTYIDKKCPFTGDVSIRGRILSGTCHSAKMVRTIVVRRNYLHYVKKYQRYEKRHSNIPAHISPCFRVKEGDHVIIGQCRPLSKTVRFNVLKVIPAGSSTGSGKKAFTAM

SEQ ID NO: 16485 - protein, 159 aa, Chenopodium quinoa
MAEQTEKAFLKQPKVFLSSNKSGKGKRPGKGGNRFWKSIGLGFKTPRDAIEGTYIDKKCPFTGNVSIRGRILAGTCHSAKMQRTIIVRRNYLHYIKKYQRYEKRHSNIPAHVSPCFRVREGDHVIIGQCRPISKTVRFNVLKVIPAGAATGGKKAFTGL

SEQ ID NO: 16486 - protein, 159 aa, Rhizophora mangle
MAEQTEKAFLKQPKVFLCSKTSGKGKRPGKGGNRYWKSIGLGFKTPRDASEGTYIDKKCPFTGNVSIRGRILAGTCHSAKMNRTIIVRRNYLHFVKKYQRYEKRHSNIPAHVSQCFRVKEGDHVIIGQCRPLSKTVRFNVLKVIPAGTSGRGKKAFTGI

SEQ ID NO: 16487 - protein, 160 aa, Sciadopitys verticillata
MAEQTEKAFLKQPKVFLCSKKSGKGKRPGKGGNRFWKNIGLGFKTPKEAVQGTYIDKKCPFTGDVSIRGRILTGTCYSAKMNRTIIVRRNYLHFVKKYQRYEKRHSNIPAHISPCFRVKEGDHVIIGQCRPLSKTVRFNVLKVIPAGSSSGSAKKGFAAI

SEQ ID NO: 16488 - protein, 159 aa, Tragopogon dubius
MAEQTEKAFLKQPKVFLCSKKSGKGKRPGKGGNRFWKSIGLGFKTPREAIDGTYIDKKCPFTGDVSIRGRIISGTCHSAKMVRTIIVRRDYFHFVKKYQRYEKRHSNIPAHISPCFRVREGDHITVGQCRPLSKTVRFNVLKVTPAGSTGGGKKAFTGF

SEQ ID NO: 16489 - protein, 151 aa, Citrullus lanatus
MAEQTEKAFLKQPKVFLCSKKSGKGKRPGKGGNRFWKSIGLGFKTPRDAIEGTYIDKKCPFTGTVSIRGRILAGTCHSAKMVRTIIVRRNYLHYVKKYQRYEKRHSNIPAHIAPCFRVKEGDHVIIGQCRPLSKTVRFNVLKVIPAAFTGI

SEQ ID NO: 16490 - protein, 159 aa, Zostera marina
MADQTEKAFLKQPKVFLSSKKSGKARKPGKGGNRFWKSIGLGFKTPKSAIEGHYIDKKCPFTGTVSIRGRIITGTCHSAKMNRTIVVRRNYLHFVKKYQRYEKRHSNIPAHISPCFRAKEGDHIIIGQCRPLSKTVRFNVLKVIPAGSTGVGKKAFTAI

SEQ ID NO: 16491 - protein, 156 aa, Echinochloa colona
EKAFLKQPKVFLSTKKSGKGKKPGKGGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVVKVIPAGSTGGSGGKKAFTAA

SEQ ID NO: 16492 - protein, 160 aa, Pinus taeda
MAEQTERAFLKQPKVFLSSKTSGKGKRPGKGGNRFWKNVGLGFKTPKEAIQGTYIDKKCPFTGTVSIRGRILVGTCYSAKMTRTIIVRRDYLHFVKKYQRYEKRHSNIPAHISPCFRVKEGDHVIIGQCRPLSKTVRFNVLKVIPAGSSSGSTKKAFIAI

SEQ ID NO: 16493 - protein, 159 aa, Spinacia oleracea
MAEQTEKAFLKQPKVFLSSKKTGKGKRPGKGGNRFWKSIGLSFKTPREAIEGTYIDKKCPFTGSVSIRGRILAGTCHSAKMQRTIIVRRNYLHYIKKYQRYEKRHSNIPAHVSPCFRVKEGDHVIIGQCRPISKTVRFNVLKVIPAGAAAGGKKAFAGL

SEQ ID NO: 16494 - protein, 160 aa, Arabidopsis lyrata
MAEQTEKAFLKQPKVFLSSKKSGKGKRPGKGGNRFWKSIGLGFKTPREAIDGAYVDKKCPFTGTVSIRGRILAGTCHSAKMQRTIIVRRDYLHFVKKYQRYEKRHSNIPAHVSPCFRVKEGDHIIIGQCRPLSKTVRFNVLKVIPAGSSSSFGKKAFTGM

SEQ ID NO: 16495 - protein, 159 aa, Arabidopsis thaliana
MAEQTEKAFLKQPKVFLSSKISGKGKRPGKGGNRFWKNIGLGFKTPREAIDGAYIDSKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFGKKAFTGV

SEQ ID NO: 16496 - protein, 154 aa, Arnica chamissonis
EKAFLKQPKVFLCSKKSGKGKRPGKGGNRFWKSVGLGFKTPREAIEGTYIDKKCPFTGDVSIRGRILAGTCNSAKMVRTIIVRRDYLHYVKKYQRYEKRHSNIPAHISPCFRVKEGDRVTIGQCRPLSKTVRFNVLKVIPAGSSGGGKKAFTGI

SEQ ID NO: 16497 - protein, 159 aa, Brassica juncea
MAEQTEKAFLKQPKVFLSSKISGKGKRPGKGGNRFSKNIGLGFKTPREAIEGTYIDRKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16498 - protein, 159 aa, Brassica juncea
MAEQTEKAFLKQPKVFLSSKKSGKGKRPGKGGNRFWKNIGLGFKTPREAIDGHYIDKKCPFTGTVSVRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16499 - protein, 159 aa, Brassica juncea
MAEQTEKAFLKQPKVFLSSKKSGKGKRPGKGGNRFWKNIGLGFKTPREAIDGTYIDRKCPFTGTVSVRGRILAGTCHSAKMQRTIIVRRNYLHFVKKYQRYEKRHSNIPAHVSPCFRVKEGDHVIIGQCRPLSKTVRFNVLKVIPAGASAFSKKAFTGM

SEQ ID NO: 16500 - protein, 158 aa, Fagus grandifolia
MAEQTEKAFLKQPKVFICSKKTGKGKRPGKGGNRFWKSIGLNFKTPKEAINGTYIDKKCPFAGNVSIRGRIITGYCHSAKMVRTIIVRRDYLHFVKKYQRYEKRHSNIPAHLSPCFRVKEGDHVVIGQCRPLSKTVRFNVLKVVPAGSSGGKKAFTGM

SEQ ID NO: 16501 - protein, 159 aa, Beta vulgaris
MAEQTEKAFLKQPKLFLSSKKTGKGKRPGKGGNRFWKSIGLGFKTPRDAIEGTYIDKKCPFTGSVSIRGRILAGTCHSAKMQRTIIVRRNYLHYIKKYQRYEKRHSNIPAHVSPCFRVKEGDHVIIGQCRPISKTVRFNVLKVIPAGAATGGKKAFTGM

SEQ ID NO: 16502 - protein, 159 aa, Cleome spinosa
MAEQTEKAFLKQPKVFLCSKKTGKGKRPGKGGNRFWKNVGLGFKTPREATEGTFIDKKCPFTGPVSVRGRILAGTCHSAKMQRTIIVRRNYLHFVRKYQRYEKRHSNIPAHVSPCFRVKEGDHVIVGQCRPLSKTVRFNVLKVIPAGSSAGGKKAFTGM

SEQ ID NO: 16503 - protein, 160 aa, Mesembryanthemum crystallinum
MAEQTEKAFLKQPKVFLSSKKTGKGKRPGKGGNRFFKNIGLGFKTPREAIEGTYIDKKCPFTGNVSIRGRILAGTCHSAKMQRTIIVRRNYLHYIKKYQRYEKRHSNIAAHVSPAFRVKEGDHVIIGQCRPLSKTVRFNVLKVIPAGSSAAAGKKAFTGM

SEQ ID NO: 16504 - protein, 158 aa, Ipomoea batatas
MAEQTEKAFLKQPGVFLSSKKTGKGKRPGKGGNRYWKSIGLGFKTPREATEGAYIDKKCPFTGTVSIRGRILAGTCHSAKMTRTIIVRRNYLHFVKKYQRYEKRHSNIAAHASPCFRVKEGDHVIIGQCRPLSKTVRFNVLKVIPAGSGGGKKAFTGM

SEQ ID NO: 16505 - protein, 158 aa, Jatropha curcas
PNRTEKAFLKQPKVFLSSKKLGKGKRPGKGGNRFWKSIGLGFKTPREAIEGTYIDKKCPFTGTVSVRGRILAGTCHSAKMMRTIIVRRNYLHFIKKYQRYEKRHSNIPAHISPCFRVKEGDHVIIGQCRPLSKTVRFNVLKLIPAGSSGGGKKAFTGL

SEQ ID NO: 16506 - protein, 159 aa, Tropaeolum majus
MAEQTEKAFLKQPKVFLSSKKTGKGKRPGKGGNRFWKNIGLGFKTPRDAIEGTYIDKKCPFTGNVSIRGRILAGTCHSSKMMRTIIVRRNYLHFVKKYQRYEKRHSNTPAHVSPCFRVKEGDHVIIGQCRPLSKTVRFNTLKVIPAGSSAAGKKAFTGM

SEQ ID NO: 16507 - protein, 159 aa, Primula obconica
MAEQTEKAFLKQPNVFLCSKKSGKGKRPGKGGNRYVKNIGLGFKTPRDASEGTYIDKKCPFTGDVSIRGRILAGTCHSAKMMRTIIVRRNYLHYVKKYQRYEKRHSNIPAHISPCFRVKEGDHVIIGQCRPLSKTVRFNVLKVIPAGSAAGGKKAFAAV

SEQ ID NO: 16508 - protein, 159 aa, Chenopodium quinoa
MAEQTEKAFLKQPKVFLSSKKTGKGKRPGKGGNRFWKSIGLGFKTPREAIEGAYIDKKCPFTGSVSIRGRILAGTCHSAKMQRTIIVRRNYLHYIKKYQRYEKRHSNIPAHVSPCFRVKEGDHVIIGQCRPISKTVRFNVLKVIPAGAAAGGKKAFAGI

SEQ ID NO: 16509 - protein, 159 aa, Chenopodium quinoa
MAEQTEKAFLKQPKVFLSSNKSGKGKRPGKGGNRFWKSIGLGFKTPRDAIEGTYIDKKCPFTGNVSIRGRILAGTCHSAKMQRTIIVRRNYLHYIKKYQRYEKRHSNIPAHVSPCFRVREGDHVIIGQCRPISKTVRFNVLKVIPAGAATGGKKAFAGL

SEQ ID NO: 16510 - protein, 159 aa, Raphanus sativus
MAEQTEKAFLKQPKVFLSSKKSGKGKRPGKGGNRFWKNIGLGFKTPRDAIEGHYIDKKCPFTGTVSVRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16511 - protein, 159 aa, Rosa hybrid cultivar
MAEQTERAFLKQPKVFLSSKKTGKGKRPGKGGNRYWKSVGLGFKTPRDAIEGTYIDKKCPFTGNVSIRGRILAGTCHSAKMNKTIIVRRNYLHYIKKYQRYEKRHSNIAAHVSPCFRVKEGDHVIIGQCRPLSKTKRFNVLKVIPAGSSAGGKKAFTGI

SEQ ID NO: 16512 - protein, 159 aa, Salvia sclarea
MAEQTEKAFLKQPKVFLCSKKTGKGKAPGRGGSRYFKSIGLGFKTPREASEGTYIDKKCPFTGDVSIRGRILAGTCRSAKMMRTIIERRNYLHWVKKYQRYEKRHSNIPAHISPCFRVKEGDHVIIGQCRPLSKTVRFNVLKVIPAGSSGQGKKAFTGM

SEQ ID NO: 16513 - protein, 159 aa, Solanum phureja
MAEQTEKAFLKQPGVFLSSKKTGKGKRPGKGGNRYFKSIGLGFKTPREATEGTYIDKKCPFTGNVSIRGRILAGTCHSAKMNRTIIVRRNYLHYVKNYFRYEKRHSNIPAHISPCFRVKEGDHVTIGQCRPLSKTVRFNVLKVIPAGSGGGGKKAFTGM

SEQ ID NO: 16514 - protein, 160 aa, Picea glauca
MAEQTERAFLKQPKVFLSSKKSGKGKRPGKGGNRFFKNVGLGFKTPKEAVQGTYIDKKCPFTGNVSIRGRILAGTCYSAKMTRTIIVRRDYLHFVKKYQRYEKRHSNIPAHISPCFRVKEGDHVIIGQCRPLSKTVRFNVLKVIPAGSSSGSAKKAFTAI

SEQ ID NO: 16515 - protein, 160 aa, Thalictrum flavum
MAEQTEKAFLKQPKVFLCSKKSGKGKRPGKGGNRFFKSIGLGFKTPREAIEGTYIDKKCPFTGNVSVRGRILSGTCHSAKMVRTIIVRRNYLHFVKKYQRYEKRHSNIPAHVSPCFRVKEGDYVTIGQCRPLSKTVRFNVLKVIPAGSSGGSGKKAFLGV

SEQ ID NO: 16516 - protein, 159 aa, Eutrema halophilum
  Sequence also found in Organisms: Eutrema parvulum
MAEQTEKAFLKQPKVFLSSKKSGKGKRPGKGGNRFWKNIGLGFKTPRDAIEGTYIDQKCPFTGIVSIRGRILAGTCHSAKMQRTIIVRRNYLHFVKKYQRYEKRHSNIPAHVSPCFRVKEGDHVIIGQCRPLSKTVRFNVLKVIPAGASAFGKKAFTGM

SEQ ID NO: 16517 - protein, 159 aa, Eutrema parvulum
MAEQTEKAFLKQPKVFLSSKKSGKGKRPGKGGNRFWKNIGLGFKTPRDAIEGSYIDGKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFGKKAFTGM

SEQ ID NO: 16518 - protein, 156 aa, Aquilegia formosa
TEKAFLKQPKVFICSKKSGKGKRPGKGGNRFFKSIGLGFKTPREAIEGTYIDKKCPFTGNVSVRGRILAGTCHSAKMVRTIIVRRNYLHYVKKYQRYEKRHSNIPAHVSPCFRVKEGDHVIIGQCRPLSKTVRFNVLKVIPAGSSGGSGKKAFLGV

SEQ ID NO: 16519 - protein, 159 aa, Arabidopsis lyrata
MAEQTEKAFLKQPKVFLSSKKSGKEKRPGKGGNRFWKNIGLGFKTPREAIEGAYVDKKCPFTGTVSIRGRILAGTCHSAKMQRTIIVRRDYLHFVKKYQRYEKRHSNIPAHVSPCFRVKEGDHVTIGQCRPLSKTVRFNVLKVIPAGSSSIGKKAFTGM

SEQ ID NO: 16520 - protein, 160 aa, Arabidopsis thaliana [sequence omitted]

SEQ ID NO: 16521 - protein, 159 aa, Brassica napus
  Sequence also found in Organisms: Brassica juncea, Brassica oleracea, Brassica rapa
MAEQTEKAFLKQPKVFLSSKKSGKGKRPGKGGNRFWKNIGLGFKTPRDAIDGHYIDKKCPFTGTVSVRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16522 - protein, 159 aa, Brassica napus
  Sequence also found in Organisms: Brassica juncea, Brassica oleracea, Brassica rapa
MAEQTEKAFLKQPKVFLSSKKSGKGKRPGKGGNRFWKNIGLGFKTPRDAIDGTYIDRKCPFTGTVSVRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16523 - protein, 159 aa, Brassica napus
  Sequence also found in Organisms: Brassica juncea, Brassica oleracea, Brassica rapa, Raphanus sativus
MAEQTEKAFLKQPKVFLSSKISGKGKRPGKGGNRFSKNIGLGFKTPREAIQGTYIDRKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16524 - protein, 159 aa, Brassica napus
  Sequence also found in Organisms: Brassica oleracea, Brassica rapa
MAEQTEKAFLKQPKVFLSSKKSGKGKRPGKGGNRFWKNIGLSFKTPRDAIDGTYIDRKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16525 - protein, 159 aa, Beta vulgaris
MAEQTEKAFLKQPKLFLSSKKSGKGKRPGKGGNRFWKSIGLGFKTPREAIEGAYIDKKCPFTGSVSIRGRILAGTCHSAKMQRTIIVRRNYLHYIKKYQRYEKRHSNIAAHVSPCFRVKEGDHVIIGQCRPLAKTVRFNVLKVIPAGAAAGGKKAFTGI

SEQ ID NO: 16526 - protein, 160 aa, Castanea mollissima
MAEQTEKAFLKQPKVFLCAKKTGKGKRPGKGGNRYWKNVGLGIKTPREAIDGTYIDKKCPFTGNVSIRGRQISGTCHSAKMIRTIIVRRDYLHFVKKYQRYEKRHSNIPAHISPCFRVKEGDHVTIGQCRPLSKTVRFNVLKVTSAGSSGGAGKKAFTGM

SEQ ID NO: 16527 - protein, 159 aa, Cichorium intybus
MAEQTEKAFLKQPKVFLSSKKSGKGKRPGKGGNRFWKSIGLGFKTPREAIEGTYIDKKCPFTGDVSIRGRILTGTCNSAKMVRTIIVRRDYFHYVKKYQRYEKRHSNTPAHISPCFRVKEGDHVTVGQCRPLSKTVRFNVIKVIPAGSLSGGKKAFTGF

SEQ ID NO: 16528 - protein, 160 aa, Trifolium pratense
MAEQTEKAYLKQRNVFLSSKKSGKGKRPGKGGNRFWKAIGLGFKTPRDAIEGTYIDKKCPFTGNVSIRGRILSGTCHSAKMNRTIVVRRNYLHFIKKYQRYEKRHSNIPAHVSPCFRVKEGDHVIIGQCRPLSKTVRFNVLKVIPAGSSSGAGKKAFTGI

SEQ ID NO: 16529 - protein, 159 aa, Taraxacum officinale
MAEQTEKAFLKQPKVFICSKKSGKGKRPGKGGNRFWKSVGLGFKTPREAIEGTYIDKKCPFTGDVSIRGRILSGTCNSAKMVRTIIVRRDYFHFVKKYQRYEKRHSNTPAHVSPCFRVKEGDRVTIGQCRPLSKTVRFNVLKVTPAGSSGTGKKAFTGM

SEQ ID NO: 16530 - protein, 160 aa, Eucalyptus grandis
MDAQTEKAFLKQPKVFLCSQKSGKGKRPGKGGNRYHKSVGLGFKTPREAVEGTYIDKKCPFTGNVSIRGRILAGTCHSAKMMRTIIVRRNYLHFVKKYQRYEKRHSNIPAHISPCFRVKEGDHVTVGQCRPLSKTVRFNVLKVIPAGSSGGGGKKAFTGM

SEQ ID NO: 16531 - protein, 160 aa, Lactuca sativa
MAEQTEKAFLKQPKVFLCSKKSGKGKRPGKGGNRFWKSVGLGFKTPREAIEGTYIDKKCPFTGDVSIRGRILSGTCHSAKMVKTIIVRRDYFHYVKKYQRYEKRHSNTPAHISPCFRVKEGDRVTIGQCRPLSKTVRFNVLKVTPAGSSGSTGKKAFAGF

SEQ ID NO: 16532 - protein, 160 aa, Lactuca sativa
MAEQTEKAFLKQPKVFLCSKKSGKGKRPGKGGNRFWKSVGLGFKTPREAIEGTYIDKKCPFTGDVSIRGRILTGTCHSAKMVKTIIVRRDYFHYIKKYQRYEKRHSNTPAHISPCFRVKEGDHVTIGQCRPLSKTVRFNVLKVIPAGSSGSTGKKAFAGF

SEQ ID NO: 16533 - protein, 160 aa, Quercus alba
MAEQTEKAFLKQPKVFLCSKKTGKGKRPGKGGNRYWKNVGLGIKTPREAIDGTYIDKKCPFTGNVSIRGRQISGTCNSAKMVRTIIVRRDYLHFVKKYQRYEKRHSNIPAHISPCFRVKEGDHVTIGQCRPLSKTVRFNVLKVTSAGSSGGAGKKAFTGM

SEQ ID NO: 16534 - protein, 160 aa, Platanus occidentalis
MAEQTEKAFLKQPKVFLCSKKSGKGKRPGKGGNRYWKSIGMGIKTPRDAIEGTYIDKKCPFTGSVSVRGRILTGTCHSAKMMRTIIVRRDYLHYVKKYQRYEKRHSNIPAHVSPCFRVKEGDHVIIGQCRPLSKTVRFNVLKVVPAGSSGGGGKKAFTIM

SEQ ID NO: 16535 - protein, 159 aa, Raphanus sativus
MAEQTEKAFLKQPKVFLSSKTSGKGKRPGKGGNRFVKNIGLGFKTPREAISGTYIDSKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFSKKAFTGM

SEQ ID NO: 16536 - protein, 159 aa, Raphanus sativus
MAEQTEKAFLKQPKVFLSSKTSGKGKRPGKGGNRFSKNIGLGFKTPREAIEGTYIDRKCPFTGTVSVRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16537 - protein, 165 aa, Trigonella foenum-graecum
MAEQTEKAFLKQQKVFLCSKISGKGKRPGKGGNRFYKAVGLGFKTPRDAIEGTYIDKKCPFTGNVSIRGRILAGTCHSAKMNRTIIVRRNYLHFIKKYQRYEKRHSNIPAHVSPCFRVKEGDHVIIGQCRPLSKTVRFNVLKVIPAGSSSGAGAGAGAKKAFTGI

SEQ ID NO: 16538 - protein, 160 aa, Cycas rumphii
MAEQTEKAFLKQPKVFLSSKKSGKGKRPGKGGNRFWKNIGLGFKTPKEAIEGTYIDKKCPFTGNVSIRGRILTGTCYSAKMTRTIIVRRDYLHFVKKYQRYEKRHSNIAAHISPCFRVKEGDRVIIGQCRPLSKTVRFNVLKVIPMGSSTGGSKKAFTAI

SEQ ID NO: 16539 - protein, 160 aa, Abies balsamea
MAEQTERAFLKQPKVFLSSKKSGKGKRPGKGGNRFWKNIGLGFKTPKEAVQGTYIDKKCPFTGNVSVRGRILAGTCYSAKMTRTIIVRRDYLHFVKKYQRYEKRHSNIPAHISPCFRVKEGDHVIIGQCRPLSKTVRFNVLKVIPAGSSSGSAKKAFAAI

SEQ ID NO: 16540 - protein, 159 aa, Amorphophallus konjac
MAEQTEKAFLKQPKVFLCSKKSGKGKRPGKGGNRYWKSIGLGFKVPREAIEGTYIDKKCPFTGNVSIRGRILSGICHSAKMNRTIIVRKDYLHYVKKYQRYEKRHSNIPAHVSPCFRVKEGDHVTIGQCRPLSKTVRFNVLKVTPAGSAGGGKKAFAAF

SEQ ID NO: 16541 - protein, 159 aa, Arabidopsis thaliana
MAEQTEKAFLKQPKVFLSSKKSGKGKRPGKGGNRFWKNIGLGFKTPREAIEGTYIDQKCPFTGTVSIRGRILSGTCHSAKMQRTIIVRRDYLHFVKKYRRYEKRHSNIPAHVSPCFRVKEGDRVTIGQCRPLSKTVRFNVLKVIPAGSSSIGKKAFTGM

SEQ ID NO: 16542 - protein, 159 aa, Brassica juncea
MAEQTEKAFLKQPKVFLSSKISGKGKRPGKGGNRFVKNIGLGFKTPREATQGTYIDSKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16543 - protein, 159 aa, Brassica napus
  Sequence also found in Organisms: Brassica juncea, Brassica rapa
MAEQTEKAFLKQPKVFLSSKISGKGKRPGKGGNRFVKNIGLGFKTPREATQGTYIDSKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFAKKAFTGA

SEQ ID NO: 16544 - protein, 159 aa, Brassica juncea
MAEQTEKAFLKQPKVFLSSKISGKGKRPGKGGNRFVKNIGLGFKTPREASQGTYIDSKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16545 - protein, 159 aa, Brassica napus
  Sequence also found in Organisms: Brassica oleracea, Triticum aestivum
MAEQTEKAFLKQPKVFLSSKISGKGKRPGKGGNRFVKNIGLGFKTPREASQGTYIDSKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFAKKAFTGA

SEQ ID NO: 16546 - protein, 159 aa, Brassica oleracea
MAEQTEKAFLKQPKVFLSSKKSGKGKRPGKGGNRFWKNIGLGFKTPRDAIDGTYIDRKCPFTGTVSVRGRILAGTCHSAKMQRTIVVRRNYLHFVKKYQRYEKRHSNIPAHVSPCFRVKEGDHVIIGQCRPLSKTVRFNVLKVIPAGASAFAKKAFTGM

SEQ ID NO: 16547 - protein, 159 aa, Fagus grandifolia
MAEQTEKAYLKQPKVFQCSKKSGKGKRPGKGGNRFWKSIGLKIKTPRDAIEGTYIDKKCPFTGDVSIRGRIITGTCHSAKMIRTIIVRRDYLHFVKKYQRYEKRHSNIPAHVSPCFRVKEGDYVVIGQCRPLSKTVRFNVLRVVPSGSSGGVKKAFTGI

SEQ ID NO: 16548 - protein, 159 aa, Cleome gynandra
MAEQTEKAFLKQPKIFLCSKRPGKGKRPGKGGNRFWKNIGLGFKTPREAIEGTFIDKKCPFTGPVSVRGRILAGTCHSAKMQRTIVVRRNYLHFVRKYQRYEKRHSNIPAHISPCFRVKEGDHVIIGQCRPLSKTVRFNVLKVIPAGSSAGGKKAFTAM

SEQ ID NO: 16549 - protein, 159 aa, Taraxacum officinale
MAEQTEKAFLKQPKVFICSKKSGKGKRPGKGGNRFYKSVGLGFKTPREAIEGTYIDKKCPFTGDVSIRGRILSGTCNSAKMVRTIIVRRDYFHFVKKYQRYEKRHSNTPAHVSPCFRVKEGDRVTIGQCRPLSKTVRFNVLKVTPAGSSGTGKKAFTGM

SEQ ID NO: 16550 - protein, 159 aa, Mimulus guttatus
MAEQTEKAFLKQPKVFLCSKKSGKGKTPGKGGNRYFKSIGLQYKTPREASEGTYIDKKCPFTGDVSIRGRILAGTCHSAKMVRTIIVRRNYMHWVSKYQRYEKRHSNIPAHISPCFRVKEGDHVTIGQCRPLSKTVRFNVLKVNPAGSTGLGKKAFTGM

SEQ ID NO: 16551 - protein, 159 aa, Raphanus sativus
MAEQTEKAFLKQPKVFLSSKISGKGKRPGKGGNRFVKNIGLGFKTPRDAIQGTYIDSKCPFTGTVSIRGRILAGTCHSAKMQRTIIVRRNYLHFVKKYQRYEKRHSNIPAHVSPCFRVKEGDHVIIGQCRPLSKTVRFNVLKVIPAGASAFAKKAFTGA

SEQ ID NO: 16552 - protein, 159 aa, Raphanus sativus
MAEQTEKAFLKQPKVFLSSKKSGKGKRPGKGGNRFWKNIGLGFKTSREAIDGHYIDKKCPLTGTVSVRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16553 - protein, 159 aa, Raphanus sativus
MAEQTEKAFLKQPKVFLSSKTSGKGKRPGKGGNRFSKNIGFGFKTPREAIEGTYIDRKCPFTGTVSVRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16554 - protein, 159 aa, Silene vulgaris
MAEQTEKAFLKQPKVFLSSKTTGKGKRPGKGGNRFFKSIGLGFKTPRDAIEGTYIDKKCPFTGNVSIRGRILAGTCHSAKMQRTIIVRRNYLHYIKKYQRYEKRHSNIAAHVSPCFRVKEGDHVTIGQCRPLSKTVRFNVLKVIPAGSAAGGKKAFTAM

SEQ ID NO: 16555 - protein, 159 aa, Solanum phureja
MAEQTEKAFLKQPGVFLSSKKTGKGKRPGKGGNRYFKSIVLGSKTPREATEGTYIDKKCPFTGNVSIRGRILAGTCHSAKMNRTIIVRRNYLHYVKNYFRYEKRHSNIPAHISPCFRVKEGDHVTIGQCRPLSKTVRFNVLKVIPAGSGGGGKKAFTGM

SEQ ID NO: 16556 - protein, 160 aa, Tragopogon dubius
MAEQTEKAFLKQPKVFLCSKKSDKGKRPGKGGNRFWKNVGLGIKTPREAIEGTYIDKKCPFTGDVSIRGRIMKGTCHSAKMVRTIIVRSDYFHFVKKYQRFEKRHSNTPAHVSPCFRVKEGDHVTIGQCRPLSKTVRFNVLKVVPAGSSGGVGKKAFTGF

SEQ ID NO: 16557 - protein, 168 aa, Manihot esculenta
MAEQTEKAFLKQPKVFLSSKKSGKGKRPGKGGNRFWKSIGLGFKTPREAIEGTYIDRKCPFTGTVSIRGRILAGTCHSAKMMRTIIVRRNYLHFIKKYQRQVTALLSTIYEKRHSNIPAHISPCFRVKEGDHVIIGQCRPLSKTVRFNVLKVIPAGSSGSGKKAFTGM

SEQ ID NO: 16558 - protein, 167 aa, Cynodon dactylon
SMPSPTYLPGRPPGQVLKQPKVFLCLKKATKGKKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAGKKAFTAA

SEQ ID NO: 16559 - protein, 166 aa, Prunus persica
MAEQTEKAFLKQPKVFISSKKSGKGKRPGKGGNRFWKSVGLGFKTPREAIEGTYIDKKCPFTGNVSIRGRILAGTCHSAKMNKTIIIRRNYLHYIKKYQRHDSCIHVYEKRHSNIPAHVSPCFRVKEGDHVTIGQCRPLSKTKRFNVLKVTPAGSSGAGKKAFTGI

SEQ ID NO: 16560 - protein, 150 aa, Acacia harpophylla
MAEQTEKGFLKQPRVFLSSKKSGKGKRPGKGGNRFWKSVGLGFKTPKEAIEGTYIDKKCPFVGNVSIRGRIIAGTCHSAKMTRTIIVRRNYLHWVKKYQRYEKRYSNIPAHISPCFRVKEGDHVIIGQCRPLSKTVRFNVVKVIPAGSSS

SEQ ID NO: 16561 - protein, 160 aa, Amborella trichopoda
MAEQTEKAFLKQPKVFLSSKKSGKGKRPGKGGNRFWKNIGLGFKTPREAIEGTFIDKKCPFTGSVSIRGRILTGTCYSAKMTRTIIVRRDYLHFVKKYQRYEKRHSNIPAHISPCFRVKEGDHVVIGQCRPLSKTVRFNVLKVIPAGSAGGGGKKAFAPI

SEQ ID NO: 16562 - protein, 159 aa, Ambrosia trifida
MAEQTEKGVFEATQGVLCSKKSGKGKRPGKGGNRFWKSIGLGFKTPREAIDGTYIDKKCPFTGDVSIRGRIIAGTCHSAKMVRTIIVRRDYLHYVKKYQRYEKRHSNIPAHISPCFRVKEGDHVTIGQCRPLSKTVRFNVLKVIPAGSSSAGKKAFTGI

SEQ ID NO: 16563 - protein, 159 aa, Amorphophallus konjac
MAEQTERAFLKQPKVFLCSKKSGKGKRPGKGGNRYWKSIGLGFKVPREAIEGTYIDKKCPFTGNVSIRGRILSGICHSAKMNRTIIVRKDYLHYVKKYQRYEKRHSNIPAHVSPCFRVKEGDHVTIGQCRPLSKTVRFNVLKVTPAGSAGGGKKAFAAF

SEQ ID NO: 16564 - protein, 159 aa, Castanea mollissima
MAEQTEKAFLKQPKVFLSSKKSGKAKRPGKGGNRYWKNIGLNFKTPREAIDGTYIDKKCPFTGNVSIRGRIISGTCHSAKMVRTIIVRRDYLHFVKKYQRYEKRHSNIPAHISPCFRVKEGDYVTIGQCRPLSKTVRFNVLKVLSAGSASAGKKAFTGM

SEQ ID NO: 16565 - protein, 156 aa, Cryptomeria japonica
MAEQTEKAFLKQPKVFLCSKKSGKGKRPGKGGNRFFKNIGLGFKTPKEAVQGTYIDKKCPFTGNVSIRGRILTGTCHSAKMNRTIIVRRNYLHFVKKYQRYEKRHSNIPAHISPCFRVKEGDHIIVGQCRPLSKTVRFNVLKVIPAGSSSGSANKG

SEQ ID NO: 16566 - protein, 160 aa, Papaver somniferum
MAEQTEKAYLKQLKVFQCSKVSGKGKRPGKGGNRYYKNVGLGFKTPREAIEGTYIDKKCPFTGNVSIRGRILAGTCHSAKMVRTIIVRRNYLHYVKKYQRYEKRHSNIPAHISPCFRVKEGDHVTVGQCRPLSKTVRFNVLKVIPAGSSGGGGKKAFVAM

SEQ ID NO: 16567 - protein, 159 aa, Raphanus sativus
MADQTEKAFLKHPKVFLSSKKSGKGKRPGKGGNRFWKNIGLGFKTPRDAIDGHYIDKKCPFTGTVSVRGRILAGTCHSAKMQRTIIVRRNYLHFVKKYQRYEKRHSNIPAHVSPCFRVKEGDHVIIGQCRPLSKTVRFNVLKVIPAGASAFAKKAFTGM

SEQ ID NO: 16568 - protein, 159 aa, Silene vulgaris
MAEQTEKAFLKQPKVGILTKSGGKGKRPGKGGNRFFKSIGLGFKTPRDAIEGTYIDKKCPFTGNVSIRGRILAGTCHSAKMQRTIIVRRNYLHYIKKYQRYEKRHSNIAAHVSPCFRVKEGDHVIIGQCRPLSKTVRFNVLKVIPAGSASGGKKAFTAM

SEQ ID NO: 16569 - protein, 156 aa, Eutrema parvulum
QTEKAFLKQPKVFLCSKKSGKGKRPGKGGNRFWKNIGLGFKTPRDAVEGGYVDKKCPFTGTVSIRGRILAGTCHSAKMQRTIIVRRNYLHFVKKYQRYEKRHSNIPAHVSPCFRVKEGDHVIIGQCRPLSKTVRFNVLKVIPAGSSAFGKKAFAGM

SEQ ID NO: 16570 - protein, 159 aa, Triphysaria pusilla
MAEQTEKAFLKQPKVFLSSKKAGKAKTPGKGGSRYFKSIGLNFKTPREAIEGSYIDKKCPFTGGVSIRGRIIAGTCHSAKMVRTIIVRRNYLHWDSKYKRYAKRHSNIAAHISPCFRVKEGDHVIIGQCRPLSKTVRFNVLKVVPAGSSGLGKKSFTGA

SEQ ID NO: 16571 - protein, 159 aa, Vinca minor
MAEQTEKAFLKQPKVFLCSKKTGKGKRPGKGGNRYWKSIGLGFKTPRDAIEGTYIDKKCPFTGNVSIRGRILSGTCHSAKMVRTIIVRRNYLHFVKKYQRYEKRHSNIPAHVSPCFRVKEGDYVTVGQCRPLSKTVRFNVVKVIPAGSSTGGKKAFAGM

SEQ ID NO: 16572 - protein, 171 aa, Cenchrus ciliaris
MAGRGPPRKSWGEQTEKAFLKQPKVFLSTKKADKSKKPGKAGNRFWKSIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVVKVIPAGSTGGAGGKKAFTAA

SEQ ID NO: 16573 - protein, 151 aa, Cirsium arvense
VLKQPKVFLCSKKSGKGKRPGKGGNRFWKSVGLGFKTPREAIEGSYIDKKCPFTGDVSIRGRILAGTCHSAKMVRTIIVRRNYLHFVKKYQRYEKRHSNIPAHISPCFRVKEGDHVTVGQCRPLSKTVRFNVLKVIPAGSSGGGKKAFTGI

SEQ ID NO: 16574 - protein, 166 aa, Panicum virgatum
NVLHLPIFQTEKAFLKQPKVFLSTKKSAKGKKPGKGGSRFWKSIGLGFKTPREAIEGTYIDKKCPFTGTVSIRGRIIAGTCHSAKMNRTIIVRRNYLHFVKKYQRYEKRHSNIPAHISPCFRVKEGDYVIIGQCRPLSKTVRFNVVKVIPAGSTGGSGGKKAFTAA

SEQ ID NO: 16575 - protein, 165 aa, Distylium racemosum
MAETQNVQTEKAFLKQPKVFLCSKKSGKGKRPGKGGNRFWKNIGLGFKTPKEAIQGTYIDKKCPFTGSVSIRGRILTGTCYSAKMNRTIIVRRNYLHFVKKYQRYEKRHSNIPAHISPCFRVKEGDHVIVGQCRPLSKTVRFNVLKVIPAGSSGGGDKKKGFAAL

SEQ ID NO: 16576 - protein, 162 aa, Gnetum gnemon
MSQAEQTEKAFLKQPKVFLCSKKSGKGKRPGKGGNRFYKNIGLGFKTPKEAITGNYIDKKCPFSGNVSIRGRILAGTCYSAKMTRTIIVRRDYLHYVKKYQRYEKRHSNIAAHISPAFRVKEGDHVIIGQCRPLSKTVRFNVLRVIPAGSSTGGAKKAFTGM

SEQ ID NO: 16577 - protein, 156 aa, Brassica napus
QTEKAFLKQPKVFLSSKKSGKGKRPGKGGNRFWKNIGLGFKTPRDAIDGTYIDRKCPFTGTVSVRGRILAGTCHSAKMQRTIVVRRNYLHFVKKYQRYEKRHSNIPAHVSPCFRVKEGDHVIIGQCRPLSKTVRFNVLKVIPAGASAFAKKAFTGM

SEQ ID NO: 16578 - protein, 160 aa, Mimulus guttatus
MAEQTEKAFLKQPKVFLCSKKSGKGKTPGKGGNRYWKNIGLIYKTPREAIEGTYIDKKCPFTGNVSIRGRIISGTCHSAKMMRTIIVRKDYFHWVKKYQRYEKRHSNIPAHVSPCFRVKEGDRVTIGQCRPLSKTVRFNVLKVSPAGSSSALGKKSFTGF

SEQ ID NO: 16579 - protein, 159 aa, Quercus alba
MAEQTEKAFLKQPKVFLSSKKSGKAKRPGKGGNRYWKNIGLNYKTPRDAIEGTYIDKKCPFTGNVSIRGRIISGTCQSAKMVRTIIVRRDYLHFVKKYQRYEKRHSNIPAHISPCFRVKEGDYVTIGQCRPLSKTVRFNVLKVLSAGSVSAGKKAFTGM

SEQ ID NO: 16580 - protein, 160 aa, Zamia vazquezii
MAEQTERAFLKQPKVFLSSKTSGKGKRPGKGGNRFWKNIGLGFKTPREAIEGTYIDKKCPFTGTVSIRGRILTGTCYSAKMTRTIIVRRDYLPFVKKYQRYEKRHSNIPAHISPCFRIKEGDRVIIGQCRPLSKTVRFNVLKVIPMGSSTGGSKKAFTAI

SEQ ID NO: 16581 - protein, 159 aa, Eutrema halophilum
MAEQTEKAFLKQPKVFLSSKKSGKGKRPGKGGNRFWKNIGLGFKTPRDAIEGSYIDGKCPFTGTVSIRGRILAGTCHSAKMQSGHYGRGNYLHFVKKYQRYEKRHSNIPAHVSPCFRVKEGDHVIIGQCRPLSKTVRFNVLKVIPAGASAFGKKAFTGM

SEQ ID NO: 16582 - protein, 159 aa, Heritiera littoralis
PWPNRPRRHFEATKVFLSSKKSGKGRRPGKGRNRFWKSIGLGFKTPREAIEGTYIDKKCPFTGTVSIRGRILAGTCHSAKMMRTIIVRRNYLHYIKKYQRYEKRHSNIPAHISPCFRVKEGDHVIIGQCRPLSKTVRFNVLKVIPAGSSGGGKKAFTGM

SEQ ID NO: 16583 - protein, 159 aa, Arachis hypogaea
MAERTEKAFLKQPKVFLCSKKSGKGKRPGKGGSRFWKGIGLGFKTPREAIQGTYIDKKCPFTGTVSIRGRILAGTCHSAKMTRTIIVRRNYLHFIKKYQRYEKRHSNIAAHISPCFRVKEGDHVIMGMQAIVKAVRLNVLKVIPAGSSSGVAKKAFTGM

SEQ ID NO: 16584 - protein, 195 aa, Triticum aestivum
MAAEDVEFVDYERDDGDDGMEDEEEDGEVSARALPVPHIAAPAVARTSRGRFVGRSRSVIASTRDRFESIPFAGTSAHGGPQRSIEGWIIIVSGVKEDAEESDLYDAFAEFGEVKDLHFNLERRTGYGKGYALVEYGCFEEAQTAIRSMNGTQLLTKTIHVDWAFNRGPIQNVTSARPAQRRSRTPPRRLAAMTY

SEQ ID NO: 16585 - protein, 651 aa, Zea mays
MPLGQRPGDKSDARYCGVEVLDFPAGEDLPAVLNHSLASAFDFILVPLVDPNYRPAPGSVLPVSASDLILGPAQWSNHVVGKISEWIDLDSEDERLRLDSELTLKQEIAWASHVSLQACVLPAPRRSFCGNYARVVNQILQGLTNMHLWLRLPLEKSEPMDDDLDKIKNNSHTSEIVDSWELWNSFRLLCDHSSQLCVALDILSTLPSINSLARWFGEPVRAAILQTEAFLTNAKGYPCLSKRHQSLLTGFFKHSVQVIISGRSNHNVFPVSEGVLSGDESYAEDSRVRHALTPYLEYIAYLYRKMDPLPEQERIEINYRDFLQSPLQPLMDNLEAQTYETFEKDVVKYTQYRRAVAKALVDRVADDAVSTTRTVLMVVGAGRGPLVRASLQAAEETGRKLKVYAVEKNPNAVITLHSLIKLEGWESLVTVISSDMRCWDAPEKADVLVSELLGSFGDNELSPECLDGAQRFLKPDGISIPSSYTSFIQPITASKLHNDIKAHKDIAHFETAYVVKLHRIATLAPPQQVFTFTHPNFSPNASNQRYTKLQFEMLPDMGSCLVHGFAGYFDSVLYKDVHLGIEPNTATPNMFSWFPIFFPLRKPIYVPEGSPIEVHFWRCCAPTKVWYEWAVTTPTPSPIHNSNGRSYWVGL

SEQ ID NO: 16586 - protein, 650 aa, Sorghum bicolor
MPLGQRPGDKSDSRYCGVEVLDFPAGEGLPAVLSHSISSGFDFILAPLVDPNYRPAPGAVLPVSASDLVLGPAQWSNHVVGKISEWIDLDAEDERLRLDSELTLKQEIAWASHVSLQACVLPAPRTSFCGNYARVVNQILQGLTNMHLWLRLPLEKSEPMDDDLDKIKNNNHMSEIVDSWELWNSFRLLCDHSSQLCVALDISSTLPSINSLGRWFGEPVKAAILQTNAYLTNSKGYPCLSKRHQRLLTGFFNHSVQVIISGRSNLNVFPASGVLSGDESCIEDSPVRHALAPYLEYIAYLYQKMDPLPEQERFEINYRDFLQSPLQPLMDNLEAQTYETFEKDVVKYTQYRRAVAKALVDRVADDAVSTTRTVLMVVGAGRGPLVRASLQAAEETGRKLKVYAVEKNPNAVITLHSLIKLEGWESLVTVISSDMRCWDAPEKADILVSELLGSFGDNELSPECLDGAQRFLKPDGISIPSSYTSFIQPITASKLHNDIKAHKDIAHFETAYVVKLHRIATLAPTQQVFTFNHPNFSPSASNQRYTKLQFEMLPDMGSCLVHGFAGYFDSVLYKDVHLGIEPNTATPNMFSWFPIFFPLRKPIYVPQGSPIEVHFWRCCAPTKVWYEWAVTTPTPSPVHNSNGRSYWVGL

SEQ ID NO: 16587 - protein, 649 aa, Oryza sativa
MPLGQRAGDKSESRYCGVEVLDFPAGEELPAVLSHSLSSSFDFLLAPLVDPDYRPTPGSVLPVAASDLVLGPAQWSSHIVGKISEWIDLDAEDEQLRLDSEITLKQEIAWASHLSLQACVLPPPKRSSCANYARVVNHILQGLTNLQLWLRIPLEKSEPMDEDHDGAKDNSDMSDTVDSWEWWNSFRLLCEHSSQLCVALDVLSTLPSMNSLGRWFGEPVRAAILQTNAFLTNARGYPCLSKRHQKLLTGFFNHSVQVIISGRSNHNVSQGGVLSGDENHTEDTAVRHALSPYLDYIAYIYQRMDPLPEQERFEINYRDFLQSPLQPLMDNLEAQTYETFEKDTVKYTQYQRAIAKALVDRVSDDDVSTTKTVLMVVGAGRGPLVRASLQAAEETGRKLKVYAVEKNPNAVITLHSLIKLEGWESLVTIISSDMRCWEAPEKADILVSELLGSFGDNELSPECLDGAQRFLKPDGISIPSSYTSFIEPITASKLHNDIKAHKDIAHFETAYVVKLHRIARLAPTQSVFTFDHPNPSPNASNQRYTKLKFEIPQETGSCLVHGFAGYFDAVLYKDVHLGIEPNTATPNMFSWFPIFFPLRKPIYVPSKTPIEVHFWRCCGATKVWYEWAVTAPSPSPIHNSNGRSYWVGL

SEQ ID NO: 16588 - protein, 651 aa, Secale cereale
MPLGQRAGDKSDSRYCGVEVLDFPAGDGLPAVLTHSLSSAFDFLLAPLVDPDYRPTPGAVLPVAASDLVLSPSQWSSHIVGKISEWIDLDSEDEQLRLDSELTLRQEIAWATHLSLQACVLPAPKRSTCANYARVVNNILQGLTNMQLWLRIPLEKSESMDEDQDKVNNNNPTSETVDSWEWWNSFRLLCEHSSQLYVALDILSSLPSMNSLGRWFGEPVRAAILQTDAFLTNARGYPCLSKRHQTLLTGFFNHSVQAIISGRSNHSVSQVSEGVLSGDENHTEDTPTGHALSPYLDYIAYLYQRMDPLPEQERFEINYRDFLQSPLQPLMDNLEAQTYETFEKDTVKYTQYQRAIAKALVDKVSDDEVSTTRTVLMVVGAGRGPLVRASLQAAEETGRKLKVYAVEKNPNAVITLHSLIKLEGWESMVTIISSDMRCWDAPEKADILVSELLGSFGDNELSPECLDGAQRFLKPDGISIPSSYTSFIQPVTASKLHNDIKAHKDIAHFETAYVVKLHRVARLAPPQEVFSFTHPNFSPKATNQRYTKLQFELPQDTGSCLVHGFAGYFDAVLYKDVHLGIEPNTCTPNMFSWFPIFFPLRKPIYVPSESPIEVHFWRCCGATKVWYEWALVAPSPSPIHNSNGRSYWVGL

SEQ ID NO: 16589 - protein, 651 aa, Hordeum vulgare
MPLGQRAGDKSDSRYCGVEVLDFPAGDGLPAVLTHSLSSAFDFLLAPLVDPDYRPTPGAVLPVAASDLVLSPSQWSSHIVGKVSEWIDLDSEDEQLRLNSELTLKQEIAWATHLSLQACVLPPPKRSTCANYARVVNNILQGLTNMQLWLRIPLEKSESMDEDHDKVNNNNPTSETVDSWESWNSFRLLCEHSSQLYVALDILSSLPSMNSLGRWFGEPVRAAIVQTDAYLTNARGYPCLPKRHQTLLTGFFNHSVQVIISGRSNHNLSQVSEGVLSGDENHTEDTPTRHALGPYLDYIAYLYQRMDPLPEQERFEINYRDFLQSPLQPLMDNLEAQTYETFEKDTVKYTQYQRAIAKALVDKVSDDEVSTARMVLMVVGAGRGPLVRASLQAAEETGRKLKVYAVEKNPNAVITLHSLIKLEGWESMVTIISSDMRCWDAPEKADILVSELLGSFGDNELSPECLDGAQRFLKPDGISIPSSYTSFIQPVTASKLHNDIKAHKDIAHFETAYVVKLHRVARLAPPQEVFSFTHPNFSPKATNQRYTKLQFELPQDTGSCLVHGFAGYFDAVLYKDVHLGIEPNTCTPNMFSWFPIFFPLRKPIYVPSESPIEVHFWRCCGSTKVWYEWALVAPSPSPIHNSNGRSYWVGL

SEQ ID NO: 16590 - protein, 643 aa, Brachypodium distachyon
MPLGQRAGDKSDSRYCGVEVLDFPAGDGLPAVLTHSLSSAFDFLLAPLVDPDYRPTPGTVLPVAASDLVLSPSQWSSHIVGKISEWIDLDSEDEQLRLDSELTLKQEIAWASHLSLQACVLPPPRRSSCANYARVVNNILQGLTNMQLWLRIPLEKSEPMDEDRDQSDIVDSWEWWNSFRLLCEHSSQLYVALDILSSLPSMNSLGRWFGEPVRAAILQTDAFLTNARGYPCLSKRHQTLLTGFFNHSVQAIISGRSNHNVSQVAEGVLSGAENHTADTPIRHTLSPYLDYIAYLYQRMDPLPEQERFEINYRDFLQSPLQPLMDNLEAQTYETFEKDTVKYAQYQRAIAKALVDKVSDDEVSTTRTVLMVVGAGRGPLVRASLQAAEETGRKLKVYAVEKNPNAVITLHSLIKLEGWESMVTIISSDMRCWDAPEKADILVSELLGSFGDNELSPECLDGAQRFLKPDGISIPYSYTSFIQPVTASKLHNDIKAHKDIAHFETAYVVKLHRVARLAPPQPVFSFTHPNFPKATNQRYTKLQFKLPQDTGSCLVHGFAGYFDAVLYKDVHLGIEPNTCTPNMFSWFPIFFPLRKPIYIPSESPIEVHFWRCCGATKVWYEWAMMAPSPSPIHNSNGRSYWVGL

SEQ ID NO: 16591 - protein, 86 aa, Oryza sativa
  Sequence also found in Organisms: Panicum virgatum
MATVPVNPKPFLNNLTGKPVIVKLKWGMEYKGYLVSVDSYMNLQLANTEEYIDGQFSGNLGEILIRCNNVLYLRGVPEDAEIEDAE

SEQ ID NO: 16592 - protein, 86 aa, Brachypodium distachyon
  Sequence also found in Organisms: Festuca arundinacea, Lolium multiflorum
MATVPVNPKPFLNNLTGKPVIVKLKWGMEYKGYLVSVDSYMNLQLANTEEYIDGQFSGNLGEILIRCNNVMYLRGVPEDTEIEDAE

SEQ ID NO: 16593 - protein, 86 aa, Pennisetum glaucum
MATVPVNPKPFLNNLTGKPVIVKLKWGMEYKGYLASVDSYMNLQLANTEEYIDGQFSGNLGEILIRCNNVLYLRGVPEDTEIEDAE

SEQ ID NO: 16594 - protein, 86 aa, Elaeis guineensis
MATVPVNPKPFLNNLTGKPVIVKLKWGMEYKGYLVSVDSYMNLQLANTEEYIDGQFSGNLGEILIRCNNVLYLRGVPEDEEIEDAE

SEQ ID NO: 16595 - protein, 86 aa, Musa acuminata
MATVPVNPKPFLNNLTGKPVIVKLKWGMEYKGYLVSVDSYMNLQLANTEEYIDGQFTGNLGEILIRCNNVLYLRGVPEDEEIEDAE

SEQ ID NO: 16596 - protein, 86 aa, Brachypodium distachyon
  Sequence also found in Organisms: Lolium multiflorum
MATVPVNPKPFLNNLTGKPVIVKLKWGMEYKGYLVSVDSYMNLQLANTEEYIDGQFSGNLGEILIRCNNVMYMRGVPEDTEIEDAE

SEQ ID NO: 16597 - protein, 86 aa, Festuca arundinacea
  Sequence also found in Organisms: Avena sativa
MATVPVNPKPFLNNLTGKPVIVKLKWGMEYKGYLVSVDSYMNLQLANTEEYIDGKFSGNLGEILIRCNNVMYLRGVPEDTEIEDAE

SEQ ID NO: 16598 - protein, 87 aa, Festuca arundinacea
MATVPVNPKPFLLNNLTGKPVIVKLKWGMEYKGYLVSVDSYMNLQLANTEEYIDGQFSGNLGEILIRCNNVMYLRGVPEDTEIEDAE

SEQ ID NO: 16599 - protein, 86 aa, Setaria italica
  Sequence also found in Organisms: Avena sativa
MATVPVNPKPFLNNLTGKPVIVKLKWGMEYKGYLVSVDSYMNLQLANTEEYIDGQFSGNLGEILIRCNNVMYLRGVPEDAEIEDAE

SEQ ID NO: 16600 - protein, 86 aa, Eragrostis curvula
MATVPVNPKPFLNNLTGKPVMVKLKWGMEYKGFLVSVDSYMNLQLANTEEYIDGQFSGNLGEILIRCNNVLYLRGVPEDTEIEDAE

SEQ ID NO: 16601 - protein, 86 aa, Elaeis guineensis
  Sequence also found in Organisms: Ananas comosus
MAAVPVNPKPFLNNLTGKPVIVKLKWGMEYKGYLVSVDSYMNLQLANTEEYIDGQFSGNLGEILIRCNNVLYLRGVPEDEEIEDAE

SEQ ID NO: 16602 - protein, 86 aa, Sorghum bicolor
  Sequence also found in Organisms: Saccharum officinarum, Triticum aestivum
MATVPVNPKPFLNNLTGKTVIVKLKWGMEYKGYLTSVDSYMNLQLANTEEYIDGQFSGNLGEILIRCNNVLYLRGVPEDTEIEDAE

SEQ ID NO: 16603 - protein, 86 aa, Musa acuminata
MATVPVNPKPFLNNLTGKPVIVKLKWGMEYKGYLVSVDSYMNLQLANTEEYIDGQFTGNLGEILIRCNNVLYLRGVPEDEEIEDAD

SEQ ID NO: 16604 - protein, 86 aa, Cocos nucifera
MRTVPVNPKPFLNNLTGKPVIVKLKWGMEYKGYLVSVDSYMNLQVANTEEYIDGQFSGNLGEILIRCNNVLYLRGVPEDEEIEDAE

SEQ ID NO: 16605 - protein, 86 aa, Cocos nucifera
  Sequence also found in Organisms: Elaeis guineensis
MATVPVNPKPFLNNLTGKPVIVKLKWGMEYKGFLVSVDSYMNLQLANTEEYIDGQFTGNLGEILIRCNNVLYLRGVPEDEEIEDAE

SEQ ID NO: 16606 - protein, 86 aa, Festuca arundinacea
MATVPVNPKPFLNNLTGKSVIVKLKWGMEYKGYLVSVDSYMNLQLANTEEYIDGQFSGNLGEILIRCNNVMYMRGVPEDTEIEDAE

SEQ ID NO: 16607 - protein, 86 aa, Zea mays
MATVPVNPKPFLNNLTGKPVIVKLKWGMEYKGYLASVDSYMNLQLANTEEYIDGQFSGNLGEILIRCNNVMYLRGVPEDAEIEDAE

SEQ ID NO: 16608 - protein, 86 aa, Saccharum officinarum
MATVPVNPKPFMNNLTGKPVIVKLKWGMEYKGYLASVDSYMNLQLANTEEYIDGQFSGNLGEILIRCNNVLYLRGVPEDAEIEDAE

SEQ ID NO: 16609 - protein, 86 aa, Curcuma longa
MATVPVNPKPFLNNLTGKPVIVKLKWGMEYKGYLVSVDSYMNLQLANTEEFIDGQFTGNLGEILIRCNNVLYLRGVPEDEEIEDAD

SEQ ID NO: 16610 - protein, 86 aa, Sorghum bicolor
MATVPVNPKPFLNNLTGKFVIVKLKWGMEYKGYLASVDSYMNLQLANTEEYIDGQFSGNLGEILIRCNNVLYLRGVPEDAEIQDAE

SEQ ID NO: 16611 - protein, 88 aa, Platanus occidentalis
MATVPVNPKPFLNNLTGKPVIVKLKWGMEYKGYLVSVDSYMNLQLANTEEYIDGQFTGNLGEILIRCNNVLYLRGVPEDEEIEEAEQD

SEQ ID NO: 16612 - protein, 86 aa, Amborella trichopoda
MATVPVNPKPFLNNLTGKPVMVKLKWGMEYKGYLVSVDSYMNLQLANTEEYIDGQLSGNLGEILIRCNNVLYLRGVPEDEEVEDAD

SEQ ID NO: 16613 - protein, 86 aa, Secale cereale
MATVPVNPKPFLINLTGKSVIVKLKWGMEYKGYLVSVDSYMNLQLANTEEYIDGQFSGNLGEILIRCNNVMYMRGVPEDTEIEDAA

SEQ ID NO: 16614 - protein, 88 aa, Glycine max
MATIPVNPKPFLNNLTGKPVIVKLKWGMEYKGYLVSVDSYMNLQLANTEEYIEGQFTGNLGEILIRCNNVLYLRGVPEDEEIEDVAED

SEQ ID NO: 16615 - protein, 88 aa, Centaurea maculosa
  Sequence also found in Organisms: Cirsium arvense
MATVPVNPKPFLNNLTGKPVIVKLKWGMEYKGYLVSVDSYMNLQLANSEEYIDGQFTGNLGEILIRCNNVLYLRGVPEDEEIEEAERD

SEQ ID NO: 16616 - protein, 86 aa, Triticum aestivum
MATVPVNPKPFLNNLTGKSVIVKLKWGMEYKGYLVSVDSYMNLQLADTEEYIDGQFSGNLGDILIRCNNVMYMRGVPEDTEIEDAA

SEQ ID NO: 16617 - protein, 88 aa, Glycine max
  Sequence also found in Organisms: Phaseolus vulgaris, Cajanus cajan
MATIPVNPKPFLNNLTGKPVIVKLKWGMEYKGYLVSVDSYMNLQLANTEEYIEGQFTGNLGEILIRCNNVLYLRGVPEDEEIEDAAED

SEQ ID NO: 16618 - protein, 88 aa, Cichorium intybus
  Sequence also found in Organisms: Cirsium arvense, Gerbera hybrid cultivar, Lactuca sativa, Scabiosa columbaria
MATVPVNPKPFLNNLTGKPVIVKLKWGMEYKGYLVSVDSYMNLQLANSEEYIDGQFTGNLGEILIRCNNVLYLRGVPEDEEIEEADRD

SEQ ID NO: 16619 - protein, 88 aa, Vigna unguiculata
MATIPVNPKPFLNNLTGKPVIVKLKWGMEYKGYLVSVDSYMNLQLANTEEYIEGQFTGNLGEILIRCNNVLYLRGVPEDEEIEDAAEE

SEQ ID NO: 16620 - protein, 88 aa, Eschscholzia californica
MASVPVNPKPFLNNLTGKPVMVKLKWGMEYKGYLVSVDSYMNLQLANTEEYIDGQFTGNLGEILIRCNNVLYLRGVPEDEEIEDADKD

SEQ ID NO: 16621 - protein, 88 aa, Lotus japonicus
MATIPVNPKPFLNNLTGKPVIVKLKWGMEYKGYLVSVDSYMNLQLANTEEYIEGQFTGNLGEILIRCNNVLYLRGVPEDEEIEDAPED

SEQ ID NO: 16622 - protein, 88 aa, Carthamus tinctorius
MATVPVNPKPFMNNLTGKPVIVKLKWGMEYKGYLVSVDSYMNLQLANSEEYIDGQFTGNLGEILIRCNNVLYLRGVPEDEEIEEAERD

SEQ ID NO: 16623 - protein, 86 aa, Amorphophallus konjac
MATIPVNPKPFLNNLTGKRVIVKLKWGMEYKGFLVSVDSYMNLQLANTEEYIEGQFTGNLGEILIRCNNVLYLRGVPEDEDIEDAE

SEQ ID NO: 16624 - protein, 86 aa, Allium cepa
MAAIPVNPKPFLNNLTGKPVIAKLKWGMEYKGFLVSVDSYMNLQLANTEEYIDGQFTGNLGEILIRCNNVLYLRGVPEDEEIEDAD

SEQ ID NO: 16625 - protein, 88 aa, Conyza canadensis
MATVPVNPKPFLNNLTGKPVIVKLKWGMEYKGFLVSVDSYMNLQLANSEEYIDGVLSGNLGEILIRCNNVLYLRGVPEDEEIEDADHD

SEQ ID NO: 16626 - protein, 88 aa, Conyza canadensis
MATVPVNPKPFLNNLTGKPVIVKLKWGMEYKGYLVSVDSYMNLQLANSEEYIDGELSGNLGEILIRCNNVLYLRGVPEDEEIEEAGHD

SEQ ID NO: 16627 - protein, 87 aa, Aristolochia fimbriata
MATPVNPKPFLNNLTGEPVIVKLKWGMEYKGYLVSVDSYMNLQLANTEEYVDGQFTGNLGEILIRCNNVLYLRGVQEDEEIEDAEKD

SEQ ID NO: 16628 - protein, 88 aa, Chelidonium majus
MASVPVNPKPFLNNLTGKPVMVKLKWGMEYKGYLVSVDSYMNLQLANTEEFIDGQFTGNLGEILIRCNNVLYLRGVPEDEEIEDADKD

SEQ ID NO: 16629 - protein, 88 aa, Cicer arietinum
MATIPVNPKPFLNNLTGKPVIVKLKWGMEYKGYLVSVDSYMNLQLANTEEYIEGSFTGNLGEILIRCNNVLYLRGVPEDEEIEDAAED

SEQ ID NO: 16630 - protein, 88 aa, Vigna unguiculata
MATIPVNPKPFLNNLTGKPVIVKLKWGMEYKGYLVSVDSYMNLQLANTEEYIEGQFTGNLGEILIRCNNVLYLRGVPEDEEIEEAAED

SEQ ID NO: 16631 - protein, 88 aa, Taraxacum officinale
MATVPVNPKPFLNNLTGKPVFVKLKWGMEYKGYLVSVDSYMNLQLANSEEYIDGQFTGNLGEILIRCNNVLYLRGVPEDEEIEEADRD

SEQ ID NO: 16632 - protein, 88 aa, Flaveria ramosissima
  Sequence also found in Organisms: Helianthus annuus
MATVPVNPKPFLNNLTGKAVIVKLKWGMEYKGYLVSVDSYMNLQLSNSEEYIDGQFTGNLGEILIRCNNVLYLRGVPEDEEIEDADRD

SEQ ID NO: 16633 - protein, 88 aa, Vitis vinifera
MATVPLNPKPFLNNLTGKPVIVKLKWGMEYKGYLVSVDSYMNLQLANSEEYIDGQFTGNLGEILIRCNNVLYLRGVPEDEEIEEADRD

SEQ ID NO: 16634 - protein, 88 aa, Lupinus angustifolius
MATIPVNPKPFLNNLTGKHVIVKLKWGMEYKGYLVSVDSYMNLQLANTEEYIEGQFTGNLGEILIRCNNVLYLRGVPEDEEIEDAPED

SEQ ID NO: 16635 - protein, 88 aa, Arachis hypogaea
MATIPVNPKPFLNNLTGKPVIVKLKWGMEYKGYLVSVDSYMNLQLANTEEYIEGQFTGNLGEILIRCNNVLYLRGVPEDEEIDDAAED

SEQ ID NO: 16636 - protein, 88 aa, Rosa hybrid cultivar
  Sequence also found in Organisms: Fragaria vesca
MATIPVNPKPFLNNLTGKTVFVKLKWGMEYKGFLVSVDSYMNLQLANTEEYIDGQFTGNLGEILIRCNNVLYLRGVPEDEEIEDAEQD

SEQ ID NO: 16637 - protein, 85 aa, Abies balsamea
MATVPVNPKPFLNNLTGKPVIVKLKWGMEYKGYLVSVDSYMNLQLASTEEYIDGQFTGNLGEVLIRCNNVLYLRGVPEDEDIENE

SEQ ID NO: 16638 - protein, 86 aa, Artemisia annua
MATVPVNPKPFLNNLTGKPVIVKLKWGMEYKGYLVSVDSYMNLQLANSEEYVDGQFTGSLGEILIRCNNVLYMRGVPEDEEIEEAD

SEQ ID NO: 16639 - protein, 84 aa, Cedrus atlantica
  Sequence also found in Organisms: Pinus pinaster, Pinus taeda, Pseudotsuga menziesii, Picea glauca
MATVPVNPKPFLNNLTGKPVIVKLKWGMEYKGYLVSVDSYMNLQLASTEEYIDGQFTGNLGEVLIRCNNVLYLRGVPEDEDIEE

SEQ ID NO: 16640 - protein, 84 aa, Gnetum gnemon
MATVPVNPKPFLNNLTGKPVIVKLKWGMEYKGYLVSVDSYMNLQLASTEEYIDGQFSGNLGEVLIRCNNVLYLRGVPEDDDVEE

SEQ ID NO: 16641 - protein, 85 aa, Podocarpus macrophillus
MATVPVNPKPFLNNLTGKPVIVKLKWGMEYKGYLVSVDSYMNLQLASTEEFVEGQFTGNLGEVLIRCNNVLYLRGVPEDEEIEDA

SEQ ID NO: 16642 - protein, 86 aa, Primula obconica
MATVPVNPKPFLNNLTGKTVIVKLKWGMEYKGFLVSVDSYMNLQLANSEEYIDGQSTGNLGEILIRCNNVLYLRGVPEDEEIEEAD

SEQ ID NO: 16643 - protein, 84 aa, Sciadopitys verticillata
MATVPVNPKPFLNNLTGKPVIVKLKWGMEYKGYLVSVDSYMNLQLANTEEYIDGQFTGNLGEVLIRCNNVLYLRGVPEDDDLEE

SEQ ID NO: 16644 - protein, 88 aa, Spinacia oleracea
MATVPVNPKPFLNNLTGKPVIVKLKWGMEYKGYLVSVDGYMNLQLANTEEYIEGQKTGDLGEILIRCNNVLYLRGVPEDEEIEDADKD

SEQ ID NO: 16645 - protein, 88 aa, Ambrosia trifida
MATVPVNPKPFLNNLTGKAVIVKLKWGMEYKGYLVSVDSYMNLQLSNSEEYIDGQFTGNLGEILIRCNNVLYMRGVPEDEEIEDADRD

SEQ ID NO: 16646 - protein, 88 aa, Beta vulgaris
MATVPVNPKPFLNNLTGKPVIVKLKWGMEYKGYLVSVDSYMNLQLANTEEYIEGQKTGDLGEILIRCNNVLHLRGVPEDEEIEDADND

SEQ ID NO: 16647 - protein, 88 aa, Castanea mollissima
  Sequence also found in Organisms: Quercus alba
MATIPVNPKPFLNNLTGKPVIVKLKWGMEYKGFLASVDSYMNLQLANTEEYIDGQFTGNLGEILIRCNNVLYLRGVPEDEEIEEADRD

SEQ ID NO: 16648 - protein, 88 aa, Trifolium pratense
  Sequence also found in Organisms: Vicia sativa
MATIPVNPKPFLNNLTGKHVIVKLKWGMEYKGYLVSVDSYMNLQLANTEEYIEGNFTGNLGEILIRCNNVLYLRGVPEDEEIEDAAED

SEQ ID NO: 16649 - protein, 88 aa, Echinacea purpurea
MATVPVNPKPFLNNLTGKAVIVKLKWGMEYKGYLVSVDSYMNLQLSNSEEFIDGQFTGNLGEILIRCNNVLYLRGVPEDEEIEDADRD

SEQ ID NO: 16650 - protein, 88 aa, Fraxinus spp
  Sequence also found in Organisms: Olea europaea
MATVPVNPKPFLNNLTGKPVMVKLKWGMEYKGFLVSVDSYMNLQLANAEEYIDGQFSGSLGEILIRCNNVLYLRGVPEDEEIEEADRD

SEQ ID NO: 16651 - protein, 88 aa, Panax ginseng
MATVPVNPKPFLNNLTGKPVIVKLKWGMEYKGYLVSVDSYMNLQLANSEEYIDGQFTGNLGEILIRCNNVLYMRGVPEDEELEEADRD

SEQ ID NO: 16652 - protein, 88 aa, Actinidia deliciosa
MATVPVNPKPFLNNLTGKKVIVKLKWGMEYKGFLVSVDSYMNLQLANSEEYIEGQFTGNLGEILIRCNNVLYLRGVPEDEEIEEAEED

SEQ ID NO: 16653 - protein, 88 aa, Actinidia deliciosa
MATVPVNPKPFLNNLTGKKVIVKLKWGMEYKGFLVSVDSYMNLQLANSEEYIEGQFTGNLGEILIRCNNVLYLRGVPEDDEIEEAEED

SEQ ID NO: 16654 - protein, 87 aa, Liriodendron tulipifera
MTTPVNPKPFLNNLTGKPVIAKLKWGMEYKGYLVSVDSYMNLQLANTEEYIDGQFTGNLGEILIRCNNVLYLRGVPEDEEIEDADKD

SEQ ID NO: 16655 - protein, 88 aa, Medicago truncatula
MATIPVNPKPFLNNLTGKPVIVKLKWGMEYKGYLVSVDSYMNLQLANTEEYIEGNFTGNLGEILIRCNNVLYMRGVPEDEEIEDAADD

SEQ ID NO: 16656 - protein, 88 aa, Orobanche aegyptiaca
MATVPVNPKPFLNNLTGKPVMVKLKWGMEYKGFLVSVDSYMNLQLANAEEYIDGQCTGSLGEILIRCNNVLYLRGVPEDEEIEDAEHD

SEQ ID NO: 16657 - protein, 88 aa, Arachis hypogaea
MATIPVNPKPFLNNLTGKQVIVKLKWGMEYKGYLVSVDSYMNLQLANTEEYIEGQFTGNLGEILIRCNNVLYLRGVPEDEEIDDAAED

SEQ ID NO: 16658 - protein, 88 aa, Chenopodium quinoa
MATVPVNPKPFLNNLTGKPVIVKLKWGMEYKGYLVSVDGYMNLQLANTEEYIEGQKTGDLGEILIRCNNVLYLRGVPEDEEIEDADRD

SEQ ID NO: 16659 - protein, 88 aa, Salvia sclarea
MATVPVNPKPFLNNLTGKPVMVKLKWGMEYKGYLVSVDSYMNLQLANAEEYIDGQCTGSLGEILIRCNNVLYLRGVPEDEEIEDADRD

SEQ ID NO: 16660 - protein, 88 aa, Sarracenia psittacina
MATVPVNPKPFLNNLTGKRVIVKLKWGMEYKGFLVSVDSYMNLQLANSEEYIEGQFTGNLGEILIRCNNVLYLRGVPEDDEIEEAEEE

SEQ ID NO: 16661 - protein, 88 aa, Sarracenia psittacina
MATVPVNPKPFLNNLTGKRVIVKLKWGMEYKGFLVSVDSYMNLQLANSEEYIEGQFTGNLGEILIRCNNVLYLRGVPEDDEIEEAEED

SEQ ID NO: 16662 - protein, 88 aa, Sesamum indicum
MATVPVNPKPFLNNLTGKPVMVKLKWGMEYKGYLVSVDSYMNLQLANAEEYIDGQSTGNLGEILIRCNNVLYLRGVPEDEEIEEADQD

SEQ ID NO: 16663 - protein, 88 aa, Trigonella foenum-graecum
MATIPVNPKPFLNNLTGKPVIVKLKWGMEYKGYLVSVDSYMNLQLANTEEYIEGNFTGNLGEILIRCNNVLYMRGVPEDEEIEDAAED

SEQ ID NO: 16664 - protein, 88 aa, Zostera marina
MATVPVNPKPFLNNLTGKHVIVKLKWGMEYKGFLVSIDSYMNLQLANTEEFIEGQFTGNLGEILIRCNNVLYLRGVPEDEEIEDAERD

SEQ ID NO: 16665 - protein, 87 aa, Pteridium aquilinum
MAAIPVNPKPFLNNLTGKPVIVKLKWGMEYKGYLVSVDSYMNLQLASTEEYIDGQLIGNLGEILIRCNNVLYLRGVPEDEEIDEAEE

SEQ ID NO: 16666 - protein, 84 aa, Cycas rumphii
MATVPVNPKPFLNNLTGKPVIVKLKWGMEYKGYLVSVDSYMNLQLASTEEFIDGQFTGNLGEVLIRCNNVLYLRGVPEDEDVED

SEQ ID NO: 16667 - protein, 84 aa, Cephalotaxus harringtonia
  Sequence also found in Organisms: Cryptomeria japonica, Sequoia sempervirens
MATVPVNPKPFLNNLTGKPVIVKLKWGMEYKGYLVSVDSYMNLQLASTEEYIDGQFTGNLGEVLIRCNNVLYLRGVPEDEDLEE

SEQ ID NO: 16668 - protein, 86 aa, Chrysanthemum coronarium
MATVPVNPKPFLNNLTGKPVIVKLKWGMEYKGYLVSVDSYMNLQLANSEEYIDGECTGSLGEILIRCNNVLYMRGVPEDEEIEEAD

SEQ ID NO: 16669 - protein, 86 aa, Chrysanthemum coronarium
MATIPVNPKPFLNNLTGKPVIVKLKWGMEYKGYLVSVDSYMNLQLANSEEYVDGVCTGNLGEILIRCNNVLYMRGVPEDEEIEEAE

SEQ ID NO: 16670 - protein, 84 aa, Zamia vazquezii
MATVPVNPKPFLNNLTGKPVIVKLKWGMEYKGYLVSVDSYMNLQLASTEEFIDGQFTGNLGEILIRCTNVLYLRGVPEDEDLED

SEQ ID NO: 16671 - protein, 90 aa, Prunus mume
MATIPVNPKPFLNNLTGKTVIVKLKWGMEYKGFLVSVDSYMNLQLANTEEYIDGQFTGNLGEILIRCNNVLYLRGVPEDEEIEEAEQLQD

SEQ ID NO: 16672 - protein, 89 aa, Lippia dulcis
MATVPVNPKPFLNNLTGKPVMVKLKWGMEYKGFLVSVDSYMNLQLANAEEYIDGQCTGSLGEILIRCNNVLYLRGVPEDEEIEDAEDRD

SEQ ID NO: 16673 - protein, 88 aa, Conyza canadensis
MATVPVNPKPFLNNLTGKPVIVKLKWGMEYKGFLVSVDSYMNLQLANSEEYIDGQLSGNLGEILIRCNNVLYLRGVPEDEDLEEADRD

SEQ ID NO: 16674 - protein, 88 aa, Echinacea purpurea
  Sequence also found in Organisms: Rosmarinus officinalis
MATVPVNPKPFLNNLTGKPVMVKLKWGMEYKGYLVSVDSYMNLQLANAEEYIDGQCTGSLGEILIRCNNVLYLRGVPEDEEIEEADRD

SEQ ID NO: 16675 - protein, 88 aa, Rosmarinus officinalis
MATVPVNPKPFLNNLTGKPVMVKLKWGMEYKGYLVSVDSYMNLQLANAEEYIEGQFSGSLGEILIRCNNVLYLRGVSEDEEVEDADHD

SEQ ID NO: 16676 - protein, 88 aa, Ambrosia trifida
MATVPVNPKPFLNNLTGKPMIVKLKWGMEYKGFLVSVDSYMNLQLANSEEYIDGQFTGNLGEILIRCNNVLYIRGVPEDEEIDDADRD

SEQ ID NO: 16677 - protein, 88 aa, Malus domestica
MATIPVNPKPFLNNLTGKTVIVKLKWGMEYKGFLVSTDAYMNLQLANTEEYIDGQSTGNLGEILIRCNNVLYLRGVPEDEEIEDAEQD

SEQ ID NO: 16678 - protein, 87 aa, Aristolochia fimbriata
MTTPVNPKPFLNNLTGEPVIVKLKWGMEYKGYLVSVDSYMNLQLANTEEYVDGQFTGNLGEILIRCNNVLYLRGVPQDEEIEDAEKD

SEQ ID NO: 16679 - protein, 88 aa, Artemisia annua
MATIPVNPKPFLNNLTGKPVIVKLKWGMEYKGYLVSVDSYMNLQLANTEEYIDAQFTGRLGEILIRCNNVLYMRGVPEDEEIEEADRD

SEQ ID NO: 16680 - protein, 88 aa, Beta vulgaris
MATVPVNPKPFLNNLTGKPVIVKLKWGMEYKGYLVSVDSYMNLQLANTEEYIEGQKTGDLGEILIRCNNVLHLRGVPEDEEIDDADQD

SEQ ID NO: 16681 - protein, 88 aa, Vaccinium corymbosum
MATVPVNPKPFLNNLTGKRVIVKLKWGMEYKGFLVSVDSYMNLQLANSEEYIEGQFTGNLGEILIRCNNVLYLRGVPEDEEVEEAEED

SEQ ID NO: 16682 - protein, 88 aa, Manihot esculenta
MATIPVNPKPFLNNLTGKTVIVKLKWGMEYKGFLASVDSYMNLQLGNTEEYIDGQFTGNLGEILIRCNNVLYLRGVPEDEDIEDAERD

SEQ ID NO: 16683 - protein, 88 aa, Cyclamen graecum
MATVPVNPKPFLNNLTGKKVIVKLKWGMEYKGFLVSVDSYMNLQLANSEEYIEGQFTGNLGEILIRCNNVLYLRGVPEDEEIEEADQD

SEQ ID NO: 16684 - protein, 88 aa, Eucalyptus grandis
MATIPVNPKPFLNNLTGKPVIVKLKWGMEYKGFLVSVDSYMNLQLANTEEYIDGQFTGSLGEILIRCNNVLYLRGVPEDEDLEDANQD

SEQ ID NO: 16685 - protein, 88 aa, Actinidia deliciosa
MAAVPVNPKPFLNNLTGKKVIVKLKWGMEYKGFLVSVDSYMNLQLANSEKYIEGQFSGNLGEILIRCNNVLYLRGVPEDDEIEEAEED

SEQ ID NO: 16686 - protein, 88 aa, Lippia dulcis
MATVPVNPKPFLNNLTGKPVMVKLKWGMEYKGFLVSVDSYMNLQLANAEEYIDGQCTGSLGEILIRCNNVLYLRGVPEDEEIEDADRD

SEQ ID NO: 16687 - protein, 88 aa, Populus trichocarpa
MATVPVNPKPFLNNLTGKTVIVKLKWGMEYKGFLASVDSYMNLQLGNTEEYIDGQFTGNLGEILIRCNNVLYLRGVPEDEDIEDADRD

SEQ ID NO: 16688 - protein, 88 aa, Papaver somniferum
MASVPVNPKPFLNNLTGKTVMVKLKWGMEYKGFLVSVDSYMNLQLANTEEYIDGQFTGNLGEILIRCNNVLYLRGVAEDEEIEDADKD

SEQ ID NO: 16689 - protein, 87 aa, Ipomoea nil
MATVPVNPKPFLNNLTGKPVMVKLKWGMEYKGFLVSVDSYMNLQLANAEEYIDGQSTGTLGEILIRCNNVLYLRGVPEDEEVEDAAE

SEQ ID NO: 16690 - protein, 87 aa, Marchantia polymorpha
MATVPVNPKPFLNDLTGKPVIVKLKWGMEYKGYLVSVDSYMNLQLASTEEYIDGQFTGNLGEVLIRCNNVLYLRGVPEDEDAVEEDE

SEQ ID NO: 16691 - protein, 82 aa, Artemisia annua
MATVPVNPKPFLNNLTGKPVIVKLKWGMEYKGYLVSVDSYMNLQLANSEEYVDGQFTGSLGEILIRCNNVLYMRGVPEDEEI

SEQ ID NO: 16692 - protein, 86 aa, Chrysanthemum coronarium
MATIPVNPKPFLNNLTGKPVIVKLKWGMEYKGYLVSVDSYMNLQLANSEEYVDGVCTGSLGEILIRCNNVLYMRGVPEDEEIEEAE

SEQ ID NO: 16693 - protein, 86 aa, Chrysanthemum coronarium
MATIPVNPKPFLNNLTGKPVIVKLKWGMEYKGYLVSVDSYMNLQLANSEEYVDGQCTGSLGEILIRCNNVLYMRGVPEDEEIEEAG

SEQ ID NO: 16694 - protein, 90 aa, Prunus persica
  Sequence also found in Organisms: Prunus mume
MATIPVNPKPFLNNLTGKTVIVKLKWGMEYKGFLVSVDSYMNLQLANTEEYIDGQSTGNLGEILIRCNNVLYLRGVPEDEEIEEAEQLQD

SEQ ID NO: 16695 - protein, 89 aa, Amaranthus tuberculatus
MATVPVNPKPFLNNLTGKPVIVKLKWGMEYKGYLVSVDGYMNLQLANTEEYIEGQKTGDLGEILIRCNNVMYLRGVPEDEEIEDADRDD

SEQ ID NO: 16696 - protein, 89 aa, Vaccinium corymbosum
MATVPVNPKPFLNNLTGKRVIVKLKWGMEYKGFLVSVDSYMNLQLANSEEYIEGQFTGNLGEILIRCNNVLYLRGVPEDEDIEEAEPED

SEQ ID NO: 16697 - protein, 88 aa, Rosmarinus officinalis
MATVPVNPKPFLNNLTGKPVMVKLKWGMEYKGFLVSVDSYMNLQLANAEEYIDGQCTGSLGEILIRCNNVLYLRGVPEDEEIEEADRD

SEQ ID NO: 16698 - protein, 88 aa, Malus domestica
MATIPVNPKPFLNNLTGKTVIVKLKWGMEYKGFLVSTDAYMNLQLANTEEYIDGQSTGNLGEILIRCNNVLYLHGVPEDEEIEDAERE

SEQ ID NO: 16699 - protein, 88 aa, Daucus carota
MATVPVNPKPFLNNLTGKRVIVKLKWGMEYKGFLVSVDSYMNLQLANSEEYIDGQFTGNLGEILIRCNNVLYMRGVPEDEDLEDADHD

SEQ ID NO: 16700 - protein, 88 aa, Daucus carota
MATVPVNPKPFLNNLTGKRVIVKLKWGMEYKGFLVSVDSYMNLQLANSEEYIDGQFTGNLGEILIRCNNVLYMRGVPEDEDLEDADRD

SEQ ID NO: 16701 - protein, 88 aa, Daucus carota
  Sequence also found in Organisms: Petroselinum crispum
MATVPVNPKPFLNNLTGKHVIVKLKWGMEYKGFLVSVDSYMNLQLANSEEYIDGQFTGNLGEILIRCNNVLYMRGVPEDEDLEDADRD

SEQ ID NO: 16702 - protein, 88 aa, Manihot esculenta
MATIPVNPKPFLNNLTGKTVIVKLKWGMEYKGFLASVDSYMNLQLGNTEEYIDGQFTGNLGEILIRCNNVLYLRGVPEDEDIEDADRD

SEQ ID NO: 16703 - protein, 88 aa, Chrysanthemum coronarium
MATVPVNPKPFLNNLTGKPVIVKLKWGMEYKGYLVSVDSYMNLQLANSEEYIDGECTGSLGEILIRCNNVLYMRGVPEDEEIEEADRD

SEQ ID NO: 16704 - protein, 88 aa, Citrus clementina
MATIPVNPKPFLNNLTGKTVIVKLKWGMEYKGFLASVDSYMNLQLGNAEEYVDGQFSGNLGEILIRCNNVLYLRGVPEDEEIEDADRD

SEQ ID NO: 16705 - protein, 88 aa, Linum usitatissimum
MATVPVNPKPFLNNLTGKTVIVKLKWGMEYKGFLASVDSYMNLQLGNAEEYIDGQFTGNLGEILIRCNNVLYMRGVPEDEEIEDADRD

SEQ ID NO: 16706 - protein, 88 aa, Hevea brasiliensis
MATIPVNPKPFLNNLTGKTVIVKLKWGMEYKGFLASVDSYMNLQLGNTEEYIDGQFTGNLGEILIRCNNVLYLRGVPEDEDIEDADHD

SEQ ID NO: 16707 - protein, 87 aa, Humulus lupulus
MSIPVNPKPFLNNLTGKTVFVKLKWGMEYKGFLVSVDSYMNLQLANTEEYIDGQFTGNLGEILIRCNNVLYLRGVPEDEEIEDAERE

SEQ ID NO: 16708 - protein, 88 aa, Tropaeolum majus
MATIPVNPKPFLNNLTGKTVIVKLKWGMEYKGYLASVDSYMNLQLGNAEEYIEGQFTGNLGEILIRCNNVLYLRGVPEDEEIEDADRD

SEQ ID NO: 16709 - protein, 88 aa, Helianthus annuus
MATVPVNPKPFLNNLTGKPVIVKLKWGMEYKGFLVSVDSYMNLQLANSEEYIDGQFTGNLGEILIRCNNVLHLRGAPEDEEIDEADRD

SEQ ID NO: 16710 - protein, 88 aa, Tabernaemontana elegans
MATVPVNPKPFLNNLTGKPVMVKLKWGMEYKGYLVSVDSYMNLQLANAEEYIEGQFTGSLGEILIRCNNVLYLRGVTEDEEVEDADRD

SEQ ID NO: 16711 - protein, 87 aa, Secale cereale
  Sequence also found in Organisms: Triticum aestivum
MATVPVNPKPFLQNLTGKMVIVKLKWGMEYKGYLVSVDSYMNLQLSGTEEYIDGQCSGNLGDILIRCNNVMYLRGVPEEDTDIPDAA

SEQ ID NO: 16712 - protein, 86 aa, Cleome gynandra
MATIPVNPKPFLNNLTGKTVIVKLKWGMEYKGFLASVDSYMNLQLGNAEEYIDGQLTGNLGEILIRCNNVLYMRGVPEDEELEDAE

SEQ ID NO: 16713 - protein, 77 aa, Avena sativa
MATVPVNPKPFLNNLTGKPVIVKLKWGMEYKGYLVSVDSYMNLQLANTEEYIDGQFSGNLGEILIRCNNVMYMRGVP

SEQ ID NO: 16714 - protein, 81 aa, Ananas comosus
MATVPVNPKPFLNNLTGKKVIVKLKWGMEYKGFLVSVDSYMNLQLANSEEYIEGQFTGNLGEILIRCNNVLYLRGVPEDEE

SEQ ID NO: 16715 - protein, 90 aa, Thalictrum flavum
MAASVPVNPKPFLNNLTGKPVMVKLKWGMEYKGFLVSVDSYMNLQQLANTEEYIDGQFTGNLGEILIRCNNVLYLRGVPEDEEIEEADRD

SEQ ID NO: 16716 - protein, 88 aa, Amsonia hubrichtii
MATVPVNPKPFLNNLTGKTVMVKLKWGMEYKGYLVSVDSYMNLQLANAEEYVDGQFTGSLGEILIRCNNVLYLRGVTEDEEVEDADRD

SEQ ID NO: 16717 - protein, 88 aa, Antirrhinum majus
MATVPVNPKPFLNNLTGKSVMVKLKWGMEYKGFLVSVDSYMNLQLANAEEYIDGQCTGSLGEILIRCNNVLYLRGVPEDEEIEEADRD

SEQ ID NO: 16718 - protein, 86 aa, Ocimum basilicum
TVPVNPKPFLNNLTGKPVMVKLKWGMEYKGYLVSVDSYMNLQLANAEEYIDGQCTGSLGEILIRCNNVLYLRGVPEDEEIEEADQD

SEQ ID NO: 16719 - protein, 88 aa, Ricinus communis
MATIPVNPKPFLNNLTGKTVIVKLKWGMEYKGFLASVDSYMNLQLGNTEEFIDGQFTGNLGEILIRCNNVLYLRGVPEDEELEDADRD

SEQ ID NO: 16720 - protein, 88 aa, Catharanthus roseus
MATVPVNPKPFLNNLTGKPVMVKLKWGMEYKGYLVSVDSYMNLQLANAEEYIEGQFTGSLGEILIRCNNVLYMRGVTEDEEVEDADGD

SEQ ID NO: 16721 - protein, 87 aa, Cucumis sativus
  Sequence also found in Organisms: Cucumis melo
MSIPVNPKPFLNNLTGKTVVVKLKWGMEYKGFLVSVDSYMNLQLANTEEYIDGQFTGSLGEILIRCNNVLYLRGVPEDEEIEDAERD

SEQ ID NO: 16722 - protein, 88 aa, Fagopyrum esculentum
MATVPVNPKPFLNNLTGKRVIVKLKWGMEYKGFLVSVDSYMNLQLANTEEYIEGEHTGDLGEILIRCNNVLYLRGVPEDEELEDADRD

SEQ ID NO: 16723 - protein, 88 aa, Mimulus guttatus
MATVPVNPKPFLNNLTGKPVMVKLKWGMEYKGFLVSVDSYMNLQLANAEEYIDGKCTGSLGEILIRCNNVLYLRGVPEDEEIEEADQD

SEQ ID NO: 16724 - protein, 88 aa, Carica papaya
MATIPVNPKPFLNNLTGKTVIVKLKWGMEYKGFLASVDSYMNLQLGNAEEYIEGQFTGNLGEILIRCNNVLYLRGVPEDEEIEDADRD

SEQ ID NO: 16725 - protein, 88 aa, Eutrema halophilum
MATIPVNPKPFLNNLTGKTVIVKLKWGMEYKGYLASVDSYMNLQLGNTEEYIDGQLTGNLGEILIRCNNVLYVRGVPEDEELEDADQD

SEQ ID NO: 16726 - protein, 88 aa, Triphysaria pusilla
MATVPVNPKPFLNNLTGKSVMVKLKWGMEYKGFLVSVDSYMNLQLANAEEYIDGQCTGSLGEILIRCNNVLYLRGVTEDEEIEEAEQD

SEQ ID NO: 16727 - protein, 88 aa, Zostera marina
MATVPVNPKPFLNNLTGKHVIVKLKWGMEYKGFLVSIDSYMNLQLANTEEFIDGQFTGNLGEILIRCNNVLYLRGVPEDEDIEGVNQD

SEQ ID NO: 16728 - protein, 85 aa, Papaver somniferum
MASVPVNPKPFLNNLTGSPVMVKLKWGMEYKGFLVSVDSYMNLQLANTEEYIDGQFTGNLGEILIRCNNVLYLRGVPEEIDADED

SEQ ID NO: 16729 - protein, 92 aa, Panicum virgatum
MDSCFVQAAVPVNPKPFLNNLTGKPVIVKLKWGMEYKGYLVSVDSYINLQLANTEEYIDGQFSGNLGEILIRCNNVLYLRGVPEDAQIDDAD

SEQ ID NO: 16730 - protein, 89 aa, Fagus grandifolia
MAAAIPVNPKPFLNNLTGKPVIVKLKWGMEYKGFLASVDSYMNLQLANTEEYIDGQFTGNLGEILIRCNNVIYLRGVPEDEEIEEADQD

SEQ ID NO: 16731 - protein, 88 aa, Arabidopsis thaliana
  Sequence also found in Organisms: Arabidopsis lyrata
MATIPVNPKPFLNNLTGKTVIVKLKWGMEYKGFLASVDSYMNLQLGNTEEYIDGQLTGNLGEILIRCNNVLYVRGVPEDEELEDADQD

SEQ ID NO: 16732 - protein, 88 aa, Brassica napus
  Sequence also found in Organisms: Brassica juncea, Brassica oleracea, Brassica rapa, Raphanus sativus
MATIPVNPKPFLNNLTGKTVIVKLKWGMEYKGFLASVDSYMNLQLGNTEEYIDGQLTGNLGEILIRCNNVLYVRGVPEDEELGDAEQD

SEQ ID NO: 16733 - protein, 88 aa, Bupleurum chinense
MATVPVNPKPFLNNLTGKRVMVKLKWGMEYKGFLVSVDSYMNLQLANSEEYIDGQFTGNLGEILIRCNNVLYMRGVPEDDDLEDIDRD

SEQ ID NO: 16734 - protein, 88 aa, Theobroma cacao
MATIPVNPKPFLNNLTGKTVIVKLKWGMEYKGFLASVDSYMNLQLGNAEEYVDGQFTGNLGEILIRCNNVLYLRGVPEDEDIEDADRD

SEQ ID NO: 16735 - protein, 88 aa, Gossypium hirsutum
  Sequence also found in Organisms: Gossypium raimondii
MATIPVNPKPFLNNLTGKTVIVKLKWGMEYKGFLASVDSYMNLQLGNAEEYVDGQFTGNLGEILIRCNNVLYLRGVPEDEDIEDADKD

SEQ ID NO: 16736 - protein, 87 aa, Cucurbita pepo
MSIPVNPKPFLNNLTGKTVVVKLKWGMEYKGFLVSVDSYMNLQLANTEEYIDGQCTGSLGEILIRCNNVLYLRGVPEDEEIEDAERD

SEQ ID NO: 16737 - protein, 88 aa, Solanum lycopersicum
  Sequence also found in Organisms: Solanum melongena
MATVPVNPKPFLNNLTGKPVMVKLKWGLEYKGYLVSVDSYMNLQLANAEEFTDGVSSGSLGEILIRCNNVLYLRGVPEDEELEDADRD

SEQ ID NO: 16738 - protein, 88 aa, Euonymus alatus
MATIPVNPKPFLNDLTGKTVIVKLKWGMEYKGFLGSVDSYMNLQLGNAEEYVDGQFTGNLGEILIRCNNVLYLRGVPEDEEIEDAAQD

SEQ ID NO: 16739 - protein, 87 aa, Momordica charantia
MSIPVNPKPFLNNLTGKTVVVKLKWGMEYKGFLVSVDSYMNLQLANTEEYIDGQFTGSLGEILIRCNNVLYLRGVPEDEEIEDVERE

SEQ ID NO: 16740 - protein, 88 aa, Raphanus sativus
MATIPVNPKPFLNNLTGKTVIVKLKWGMEYKGFLASVDSYMNLQLGNTEEYIDGQLTGNLGEILIRCNNVLYVRGVPEDEELADAEQD

SEQ ID NO: 16741 - protein, 88 aa, Tripterygium wilfordii
MATIPVNPKPFLNNLTGKTVIVKLKWGMEYKGFLASVDSYMNLQLGNAEEYVDGQLTGNLGEILIRCNNVLYLRGVPEDEEIEDAAED

SEQ ID NO: 16742 - protein, 87 aa, Physcomitrella patens
MATVPVNPKPFLNDLTGKPVIVKLKWGMEYKGYLVSVDSYMNLQLASTEEFVDGAFTGNLGEVLIRCNNVMYLRGVPEDEDAAEDDE

SEQ ID NO: 16743 - protein, 87 aa, Silene vulgaris
MATVPVNPKPFLNNLTGKQVIVKLKWGMEYKGYLVSVDGYMNLQLADTEEYIEGEMTGNLGEILIRCNNVLYLRGVPEDEEMDGDRD

SEQ ID NO: 16744 - protein, 83 aa, Chrysanthemum coronarium
IPVNPKPFLNNLTGKPVIVKLKWGMEYKGYLVSVDSYMNLQLANSEEYVDGQCTGSLGEILIRCNNVLYMRGVPEDEEIEEAG

SEQ ID NO: 16745 - protein, 89 aa, Carpinus betulus
MSIPVNPKPFLNNLTGKPVIVKLKWGMEYKGFLASMDSYMNLQLANTEEYIDGQFTGNLGEILIRCNNVLYLRGVPEDEEIEDADRDQD

SEQ ID NO: 16746 - protein, 88 aa, Cleome gynandra
MATIPVNPKPFLNNLTGKTVIVKLKWGMEYKGFLASVDSYMNLQLGNAEEYIDGQLTGNLGEILIRCNNVLYMRGVPEDEELEDADQD

SEQ ID NO: 16747 - protein, 87 aa, Cucurbita pepo
MSIPVNPKPFLNNLTGKTVVVKLKWGMEYKGFLVSVDSYMNLQLANTEEYIDGQCTGSLGEILIRCNNVLYLRGVPEDEELEDAERD

SEQ ID NO: 16748 - protein, 87 aa, Nicotiana benthamiana
  Sequence also found in Organisms: Nicotiana tabacum
MSVPVNPKPYLNNLTGKPVMVKLKWGMEYKGYLVSVDSYMNLQLANAEEYIDGQCTGSLGEILIRCNNVLYLRGVPEDEELEDADRD

SEQ ID NO: 16749 - protein, 88 aa, Solanum tuberosum
  Sequence also found in Organisms: Solanum phureja
MATVPVNPKPFLNNLTGKHVMVKLKWGLEYKGYLVSVDSYMNLQLANAEEFTDGVSSGSLGEILIRCNNVLYLRGVPEDEELEDADRD

SEQ ID NO: 16750 - protein, 88 aa, Tripterygium wilfordii
MATIPVNPKPFLNNLTGKTVIVKLKWGMEYKGFLASVDSYMNLQLGNAEEYVDGELTGNLGEILIRCNNVLYLRGVPEDEEIEDADRD

SEQ ID NO: 16751 - protein, 87 aa, Ceratodon purpureus
MATVPVNPKPFLNDLTGKPVIVKLKWGMEYKGYLVSVDSYMNLQLASTEEFVDGAFTGNLGEVLIRCNNVMYLRGVPEDEDAAEDDD

SEQ ID NO: 16752 - protein, 90 aa, Plantago ovata
MATVPVNPKPFLNNLTGKTVMVKLKWGMEYKGFLVSVDSYMNLQLANAEEYIDGQCTGSLGEILIRCNNVLYLRGVPEDEEIAEADADRD

SEQ ID NO: 16753 - protein, 89 aa, Lippia dulcis
MATVPVNPKPFLQTLTGKPVMVKLKWGMEYKGFLVSVDSYMNLQLANAEEYVDGQCTGSLGEILIRCNNVLYLRGVPEDEEIEEADRDD

SEQ ID NO: 16754 - protein, 89 aa, Utricularia gibba
MATVPVNPKPFLNNLTGKPVMVKLKWGMEYKGFLVSVDSYMNLQLANAEEYIDGQCTGSLGEILVRCNNVLYLRGVPEDEDMEEAPDRD

SEQ ID NO: 16755 - protein, 94 aa, Aquilegia formosa
VFNYLISQTVPVNPKPFLNNLTGKPVMVKLKWGMEYKGFLVSVDSYMNLQLANTEEYIDGQFTGNLGEILIRCNNVLYLRGVPEDEEIEEADRD

SEQ ID NO: 16756 - protein, 94 aa, Aquilegia formosa
MFFYLLLQTVPVNPKPFLNNLTGKPVMVKLKWGMEYKGFLVSVDSYMNLQLANTEEYIDGQFTGNLGEILIRCNNVLYLRGVPEDEEIEDVDRD

SEQ ID NO: 16757 - protein, 88 aa, Heritiera littoralis
MATIPVNPKPFLNNLTGKTVIVKLKWGMEYKGFLASVDSYMNLQLGNAEEFIDGQFTGNLGEILVRCNNVLYLRGVPEDEDLEDADRD

SEQ ID NO: 16758 - protein, 88 aa, Capsicum annuum
MATVPVNPKPFLNNLTGKPVMVKLKWGLEYKGFLVSVDSYMNLQLANAEEFTDGVSTGSLGEILIRCNNVLYLRGVPEDEELEDADRD

SEQ ID NO: 16759 - protein, 93 aa, Cannabis sativa
YILTFLQSIPVNPKPFLNNLTGKTVFVKLKWGMEYKGFLVSVDSYMNLQLANTEEYIDGQFTGNLGEILIRCNNVLYLRGVPEDEEIEDAERE

SEQ ID NO: 16760 - protein, 87 aa, Ipomoea nil
MATVPVNPNPFLNHLTGKPVMVKLKWGMEYKGFLVSVDSYMHLQLANAEEYIDGQSPGTLGAILIRRNNVLYLRGVPEDEEVEDAAE

SEQ ID NO: 16761 - protein, 87 aa, Physcomitrella patens
MATIPVNPKPFLNDLTGKPVIVKLKWGMEYKGYLVSVDSYMNLQLASTEEFVDGAFTGNLGEVLIRCNNVMYLRGVPEDEDAAEDDD

SEQ ID NO: 16762 - protein, 91 aa, Euphorbia peplus
MATIPVNPKPFLNNLTGKTVIVKLKWGMEYKGFLASVDSYMNLQLGNTEEFIDGQFTGNLGEILIRCNNVLYLRGVPEDEDIEDGDGDQAD

SEQ ID NO: 16763 - protein, 91 aa, Nicotiana benthamiana
MWSLQTVPVNPKPFLNNLTGKPVMVKLKWGMEYKGYLVSVDSYMNLQLANAEEYIDGQCTGSLGEILIRCNNVLYLRGVPEDEELDDADRD

SEQ ID NO: 16764 - protein, 90 aa, Fragaria vesca
MASIPVNPKPFLNNLTGKSVLVKLKWGMEYKGFLVTVDSYMNLQLANTEEFIDGQFTGNLGEILIRCNNVLYLRGVPEDEGIVDAHQQQD

SEQ ID NO: 16765 - protein, 89 aa, Cleome spinosa
MATIPVNPKPFLNNLTGKTVIVKLKWGMEYKGFLASVDSYMNLQLGNAEEYIDGQLTGNLGEILIRCNNVLYMRGVPEDEELGDADHDD

SEQ ID NO: 16766 - protein, 89 aa, Eutrema parvulum
FLQTIPVNPKPFLNNLTGKTVIVKLKWGMEYKGFLASVDSYMNLQLGNTEEYIDGQLTGNLGEILIRCNNVLYVRGVPEDEELGDAEQD

SEQ ID NO: 16767 - protein, 88 aa, Valeriana officinalis
MATVPVNPKPFLNNLTGKAVIVKLKWGMEYKGFLVAIDSYMNLQLANSEEFIDGESTGNLGEILIRCNNVLYIRGVPEDEDIEEADRD

SEQ ID NO: 16768 - protein, 93 aa, Euphorbia esula
MATIPVNPKPFLNNLTGKTVIVKLKWGMEYKGFLASVDSYMNLQLGNTEEFIDGQFTGNLGEILIRCNNVLYLRGVPEDEDIEDADGDGDQAD

SEQ ID NO: 16769 - protein, 73 aa, Glycyrrhiza uralensis
TIPVNPKPFLNNLTGKPVIVKLKWGMEYKGYLVSVDSYMNLQLANTEEYIEGQFTGNLGEILIRCNNVLYLRG

SEQ ID NO: 16770 - protein, 87 aa, Epimedium sagittatum
MSVPVNPKPFLNNLTGKTVVVKLKWGMEYKGYLVSVDSYMNLQLADTEEFVDGQATGKIGEILIRCNNVLYLRGLPEDEEIEDAPQD

SEQ ID NO: 16771 - protein, 87 aa, Nuphar advena
MAVPVNPKPFLNNLTGNPVIVKLKWGMEYQGYLASVDSYMNLQLANAEEIIDGQNAGQLGEILIRCNNVLYIRGVPEDEDMENAGGG

SEQ ID NO: 16772 - protein, 87 aa, Vinca minor
MATVPVNPKPFLNNLIGKTVMVKLKWGMEYKGNLVSVDSYMNLQLTNAEEYVEGQFTGSLGEILIRCNNVLYLRGVEDEEVEDVDED

SEQ ID NO: 16773 - protein, 93 aa, Nicotiana benthamiana
FNLRSLQTVPVNPKPFLNNLTGKPVMVKLKWGMEYKGYLVSVDSYMNLQLANAEEYIDGQCTGSLGEILIRCNNVLYLRGVPEDEELDDADRD

SEQ ID NO: 16774 - protein, 92 aa, Hordeum vulgare
CFFTPLQTVPVNPKPFLQNLTGKMVIVKLKWGMEYKGYLVSVDSYMNLQLSGTEEFIDGQCSGNLGDILIRCNNVMYLRGVPEVDTEIPDAA

SEQ ID NO: 16775 - protein, 70 aa, Avena sativa
GKPVIVKLKWGMEYKGYLVSVDSYMNLQLANTEEYIDGQFSGNLGEILIRCNNVMYLRGVPEDTEIEDAE

SEQ ID NO: 16776 - protein, 84 aa, Selaginella moellendorffii
MATVPVNPKPFLNELTGKAVMVKLKWGMEYKGFLISVDSYMNLQLGNTEEFIDGQFAGNLGEVLIRCNNVLYLRGIPEEEEGSQ

SEQ ID NO: 16777 - protein, 507 aa, Brachypodium distachyon
MASTVLEATRAAHEDLERLERLAVRELQRDPANARDRLFQSHRVRHMIDLVVSTSEKLVEIYDDKDSARKDEISTHLTAPVQDDIFNKFYDRLKEIRNYHRRNQSARFVSETDDYEELLKEEPAIEFTGEEAFGRYLDLHELYNEFINSKFGSRMEYSAYVGTFAQTEKITHSLKATRQYKEYLEHVLEYLTSFLYRTEPLQDLEKIFTKLESEFEEQWANGEVPGWENKGTEKETASQESAIDLDYYSTVEELVELGPEKLKEALAARGLKSGGTVQQRAERLFLLKHKALELLDRKHFAKGSRSSVSNAPNGNNFKDDLKKEIALLEIKMRRLCEILDEVIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIDEAKALWDRIQSKQGLNKWRPDLEEEYEDQDGNIYNKKTYTDLQRQGLI

SEQ ID NO: 16778 - protein, 504 aa, Echinochloa colona
MASTVLEATRAAHEDLERLERLAVRELQRDPANARDRLFQSHRVRHMLDLVVSTSDKLVEIYEDKDNARKDEINTHLTAPTQNVLFSKYYERLKEIRDYHRRNPSARFVSTTDDYEELLKEEPAIEFTGEEAFGRYLDLHELYNEFINSKFGTPMEYSAYVGSFAQMEKISQSHKATRQYREYLEHILEYLTSFLYRTEPLQDIEKIFAKLESEFEERWANGEVPGWGKQSAPEESDIDLDYYSTVEELVELGPEKLKQALAARGLKSGGTVQQRAERLFLLKHTPLEQLDRKHFAKVPRTKDVSSTASDGNNFKDDLKKEIALMEVKMRRLCELLDEVFVRTKENAEKKLTLTYEEMEAEREEEEVQADTESDDEEQQIYNPLKLPMGWDGKPIPYWLYKLHGLGQEFKCEICGNQSYWGRRAYERHFKEWRHQHGMRCLGIPNTKNFNEITSIQEAKGLWEKIQARQGLNKWRPDLEEEYEDQEGNIYNKKTYTDLQRQGLI

SEQ ID NO: 16779 - protein, 503 aa, Setaria italica
MASTVLEATRAAHEDLERLERLAVRELQRDPANARDRLFQSHRVRHMLDLVVSTSDKLVEIYEDNDNARKDEINTHLTAPTQSLLFSKYYERLKEIRDYHRRNPSARFVSTTDDYEELLKEEPVIEFTGEEAFGRYLDLHELYNEFINSKFGAPMEYSAYVGSFSQMEKISQSHKATRQYREYLEHILEYLTSFLYRTEPLQDIEKIFAKLESEFEERWANEEVPGWGNKSTEESEIDLDYYSTVEELVELGPEKLKHALAARGLKSGGTVQQRAERLFLLKHTPLEQLDRKHFAKVPRTKDVSDASSNGNHFKDDLKKEIALMEVKMRRLCELLDEVFVRTKENAEKKLTLTYEEMEAEREEEEVQADTESDDDEQQIYNPLKLPMGWDGKPIPYWLYKLHGLGQEFKCEICGNHSYWGRRAYERHFKEWRHQHGMRCLGIPNTKNFNEITSIEEARGLWEKIQARQGLNKWRPDLEEEYEDQEGNIYNKKTYTDLQRQGLI

SEQ ID NO: 16780 - protein, 504 aa, Sorghum bicolor
MASTVLEATRAAHEDLERLERLAVRELQREPANPRDRLFQSHRVRHMLDLVVSTSDKLVEIYEDKDNARKDEINTHLTAPTQSGLFSKYYERLKEIREYHRRNLSARFVSTTDDFEELLKEEPVIEFTGEETFGRYLDLHELYNEFINSKFGTPMEYSAYVGCFSQTDKISHSHKATRQYREYLEHVLEYLTSFLYRTEPLQDIEKIFLKLESEFEERWANGEIPGWGNKGTEKESEIDLDYYSTVEELVELGPEKLKQALAARGLKSGGTVQQRAERLFLLKHTPLEQLDRKHFAKVPRTKDGSNTSSNDNNVKDDTKKEIALMEVKMRRLCELLDEAFVRTKENAEKKLTLTYEEMEAEREEEEVQADTESDDEEQQIYNPLKLPMGWDGKPIPYWLYKLHGLGQEFKCEICGNHSYWGRRAYERHFKEWRHQHGMRCLGIPNTKNFNEITSIDEAKALWEKIQARQGVNKWRPDLEEEYEDQEGNIYNKKTYTDLQRQGLI

SEQ ID NO: 16781 - protein, 504 aa, Sorghum bicolor
MASTVLEATRAAHEDLERLERLAVRELQRDPANPRDRLFQSHRVRHMLDLVVSTSGKLVEIYEDKDNARKDEINTHLTAPTQSGLFSKYYERLKEIREYHRRNPSARFVSTTDDYEELLKEEPIIEFTGEESFGRYLDLHELYNEFINSKFGTPMEYSAYVGCFSQTDKISHSHKATRQYREYLEHILEYLTSFLYRTEPLQDIDKIFLKLESEFEERWANGEIPGWGNKGAEKESEIDLDYYSTVEELVELGPEKLKQALAARGLKSGGTVQQRADRLFLLKLTPLEQLDRKHFAKVPHTKDGSNTASNGNTLKDDMKKEIALMEVKMKRLCELLDEAFVRTKENAEKKLTLTYEEMEAEREEEEVQADSESDDEEQQIYNPLKLPMGWDGKPIPYWLYKLHGLGQEFKCEICGNHSYWGRRAYERHFKEWRHQHGMRCLGIPNTKNFNEITSIDEAKALWEKIQARQGVNKWRPDLEEEYEDQEGNIYNKKTYTDLQRQGLI

SEQ ID NO: 16782 - protein, 508 aa, Avena sativa
MASSVLEATRAAHEDLERLERLAVRELQRDPANTRDRLFQSHRVRNIIDLVVTTSDRLVEIYEDKDGARKEEISNHLTAPVQDDIFHKFFDRLKDIRESHRRNHSARFVSETDDHEELLKEEPAIEFSGEEAFGRYLDLHELYNEFINSKFGSLMEYSAYVGTFSQTEKITHSLKATRQYKEYLEHILEYLTYFLRRTEPLQDLQKIFTKLESEFEEQWANGEVPGWENKGTEKESVVQESEVDLDYYNSVEELVELGPEKLKEALAARGLKAGGTVQQRAERLFLLKHTPLEQLDRKHFAKGSRSSVSNVPSNGNNSKDDLKKEIALIELKMRRLCEILDEVIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIEEAKALWERIQSKQGLNKWRPDLEEEYEDTDGNIYNRKTYTDLQRQGLI

SEQ ID NO: 16783 - protein, 508 aa, Festuca arundinacea
MASSVLEATRAAHEDLERLERLAVRELQRDPANARDRLFQSHRVRNIIDLVVTTSDRLVEIYEDKDGARKEEISNHLTAPAQDDIFHKFFDRLKDIRESHRRNHSARFVSDTDDHEELLREEPAIEFSGEEAFGRYLDLHELYNEFINSKFGSLMEYSAYVGTFSQTEKITHSLKATRQYKEYLEHILEYLTYFLRRTEPLQDLQKIFTKLESDFEEQWANGEVPGWENKGTEKESVLQESEVDLDYYSSVEELVELGPEKLKEALAARGLKGGGTVQQRAERLFLLKHTPLEQLDRKHFVKGSRSSVSNVPSNGNNSKDDLKKEIALIEVKMRRLCEILDEVIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIEEAKALWERIQSKQGLNKWRPDLEEEYEDTDGNIYNKKTYTDLQRQGLI

SEQ ID NO: 16784 - protein, 492 aa, Triticum aestivum
MASSVLEATRAAHEDLERLERLAVRELQRDPANARDRLFQSHRVRHMLDLVVSTSDKLVEIYEDKDGARKDEISTHLTAPVQSDIFPKYYERLKEIRDYHRRNHSARFVSETDDYEELLKEEPAIEFTGEEAFGRYLDLHELYNEFINSKFGSLMEYSAYVGTFAQTEKIAHNLKATRPYKEYLEHILEYLMSFLYRTEPLQDIEKIFTKLESEFEEQWINGEVPGWENKGTEKESVLQESAVDLDYYSTVEELVELGPEKLKEALTARGLKGGGTVQQRAERLFLLKHTPLEKLDRKHFAKGDDLKKEIALIEMKMKRLCEILDEVIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIKEATALWERIQAKQGQNKWRPDLEEEYEDKDGNIYNKKTYTDLQRQGLI

SEQ ID NO: 16785 - protein, 508 aa, Avena sativa
MASSVLEATRAAHEDLERLERLAVRELQRDPANARDRLFQSHRVRNIIDLVITTSDRLVEIYEDKDGARKEEISNHLTAPVQDDIFHKFFDRLKDIRESHRRNHSAHFVSETDDHEELLKEEPAIEFSGEEAFGRYLDLHELYNEFINSKFGSLMEYSAYVGTFSQTEKITHSLKATRQYKEYLEHILEYLTYFLRRTEPLQDLQKIFTKLESEFEEQWANGEVPGWENKGTEKESVVQESEVDLDFYNSVEELVVLGPEKLKEALAARGLKAGGTVQQRAERLFLLKHTPLEQLDRKHFAKGSRCSVSNVPSNGNNSKDDLKKEIALIELKMRRLCEILDEVIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIEEAKALWERIQSKQGLNKWRPDLEEEYEDTDGNIYNRKTYTDLQRQGLI

SEQ ID NO: 16786 - protein, 508 aa, Avena sativa
MASSVLEATRAAHEDLERLERLAVRELQRDPANTRDRLFQSHRVRNIIDLVVTTSDRLVEIYEDKDGARKEEISNHLTAPVQDDIFHKFFDRLKDIRESHRRNHSARFVSETDDHEELLKEEPAIEFSGEEAFGRYLDLHELYNEFINSKFGSLMEYSAYVGTFSQTEKITHSLKATRQYKEYLEHILEYLTYFLRRTEPLQDLQKIFTKLESEFEEQWANGEVPGWENKGTEKESVVQESEVDLDFYNSVEELVVLGPEKLKEALAARGLKAGGTVQQRAERLFLLKHTPLEQLDRKHFAKGSRSSVSNGPSNGNNSKDDLKKEIALIELKMRRLCEILDEVIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIEEAKALWERIQSKQGLNKWRPDLEEEYEDTDGNIYNRKTYTDLQRQGLI

SEQ ID NO: 16787 - protein, 508 aa, Avena sativa
MASSVLEATRAAHEDLERLERLAVRELQRDPANARDRLFQSHRVRNIIDLVITTSDRLVEIYEDKDGARKEEISNHLTAPVQDDIFHKFFDRLKDIRESHRRNHSACFVSETDDHEELLKEEPAVEFSGEEAFGRYLDLHELYNEFINSKFGSLMEYSAYVGIFSQTEKITHSLKATRQYKEYLEHILEYLTYFLRRTEPLQDLQKIFTKLESEFEEQWANGEVPGWENKGTEKESVVQESEVDLDYYNSVEELVELGPEKLKEALAARGLKAGGTVQQRAERLFLLKHTPLEQLDRKHFAKGSRSSVSNVPSNGNNSKDDLKKEIALIELKMRRLCEILDEVVVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIEEAKALWERIQSKQGLNKWRPDLEEEYEDTDGNIYNRKTYTDLQRQGLI

SEQ ID NO: 16788 - protein, 504 aa, Saccharum officinarum
MASTVLEATRAAHEDLERLERLAVRELQREPANPRDRLFQSHRVRHMLDLVVSTSGKLVEIYEDKDNARKDEINTHLTAPTQSGLFSKYYERLKEIREYHRRNPSARFVSTTDDYEELLKEELVIEFTGEETFGRYLDLHELYNKFINSKFGTPMEYSAYVGCFSQTDKISHSHKATRQYREYLEHILEYLTSFLYRTEPLQDIDKIFLKLESEFEERWANGEIPGWGNKGAERESEIDLDYYSTVEELVELGPEKLKQALAARGLKSGGTVQQRADRLFLLKLTPLEQLDRKHFAKVPHTKDGSNTASNGNTFRDDMKKEIALMEVKMKRLCELLDEAFVRTKENAEKKLTLTYEEMEAEREEEEVQADTESDDEEQQIYNPLKLPMGWDGKPIPYWLYKLHGLGQEFKCEICGNHSYWGRRAYERHFKEWRHQHGMRCLGIPNTKNFNEITSIDEAKALWEKIQARQGVNKWRPDLEEEYEDQEGNIYNKKTYTDLQRQGLI

SEQ ID NO: 16789 - protein, 492 aa, Triticum aestivum
MASSVLEATRAAHEDLERLERLAVRELQRDPANARDRLFQSHRVRHMLDLVVSTSDKLVEIYEDKDGARKDEISTHLTAPVQSDIFPKYYERLKEIRDYHRRNHSARFVSETDDYEELLKEEPAIEFTGEEAFGRYLDLHELYNEFINSKFGSLMEYSAYVGTFAQTEKIAHNLKATRPYKEYLEHILEYLMSFLYRTEPLQDIEKIFTKLESEFEEQWTNGEVPGWENKGTEKESVLQESAVDLDYYSTVEELVELGPEKLKEALTARGLKGGGTVQQRAERLFLLKHTPLEKLDRKHFAKGDDLKKEIALIEMKMKRLCEILDEVIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIKEATALWERIQAKQGQNKWRPDLEEEYEDKDGNIYNKKTYTDLQRQGLI

SEQ ID NO: 16790 - protein, 508 aa, Avena sativa
MASSVLEATRAAHEDLERLERLAVRELQRDPANTRDRLFQSHRVRNIIDLVVTTSDRLVEIYEDKDGARKEEISNHLTAPVQDDIFHKFFDRLKDIRESHRRNHSAHFVSETDDHEELLKDEPAIEFSGEEAFGRYLDLHELYNEFINSKFGSLMEYSAYVGTFSQTEKITHSLKATRQYKEYLEHILEYLTYFLRRTEPLQDLQKIFTKLESEFEEQWANGEVPGWENKGTEKESVVQESEVDLDFYNSVEELVVLGPEKLKEALAARGLKAGGTVQQRAERLFLLKHTPLEQLDRKHFAKGSRSSVSNVPSNGNNSKDDLKKEIALIELKMRRLCEILDEVIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIEEAKALWEKIQSKQGLNKWRPDLEEEYEDTDGNIYNRKTYTDLQRQGLI

SEQ ID NO: 16791 - protein, 491 aa, Triticum aestivum
ASSVLEATRAAHEDLERLERLAVRELQRDPANARDRLFQSHRVRHMLDLVVSTSDKLVEIYEDKDGARKDEISTHLTAPVQSDIFPKYYERLKEIRDYHRRNHSARFVSETDDYEELLKEEPAIEFTGEEAFGRYLDLHELYNEFINSKFGSLMEYSAYVGTFAQTEKIAHNLKATRPYKEYLEHILEYLMSFLYRTEPLQDIEKIFTKLESEFEEQWTNGEVPGWENKGTEKESVLQESAVDLDYYSTVEELVELGPEKLKEALTARGLKGGGTVQQRAERLFLLKHTPLEKLDRKHFAKGDDLKKEIALTEMKMKRLCEILDEVIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIKEATTLWERIQAKQGQNKWRPDLEEEYEDKDGNIYNKKTYTDLQRQGLI

SEQ ID NO: 16792 - protein, 492 aa, Secale cereale
MASSVLEATRAAHEDLERLERLAVRELQRDPVNARDRLFQSHRVRHMLDLVVSTSDKLVEIYEDKDGARKDEISTHLTAPVQSDIFPKYYERLKEIRDYHRRNHSARFVSETDDYEELLKEEPAIEFTGEEAFGRYLDLHELYNEFINSKFGSLMEYSAYVGTFAQTEKIAHNLKATRPYKEYLEHILEYLMSFLYRTEPLQDIEKIFTKLESEFEEQWTNGEVPGWENKGTEKDSVLQESTVDLDYYSTVEELVELGPEKLKEALTARGLKGGGTVQQRAERLFLLKHTPLEKLDRKHFAKGDDLKKEIALIEVKLKRLCEILDEVIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIKEATALWERIQAKQGQNKWRPDLEEEYEDKDGNIYNKKTYTDLQRQGLI

SEQ ID NO: 16793 - protein, 482 aa, Echinochloa colona
MASTVLEATRAAHEDLERLERLAVRELQRDPANARDRLFQSHRVGHMLDLVVSTSDKLVEIYEDKDNARKDEINTHLTAPTQNVLFSKYYERLKEIRDYHRRNPSARFVSTTDDYEELLKEEPAIEFTGEEAFGRYLDLHELYNEFINSKFGTPMEYSAYVGSFAQMEKISQSHKATRQYREYLEHILEYLTSFLYRTEPLQDIEKIFAKLESEFEERWANGEVPGWGKQSAPEESDIDLDYYSTVEELVELGPEKLKQALAARGLKSGGTVQQRAERLFLLKHTPLEQLDRKHFAKVPRTKDVSSTASDGNNFKDDLKKEIALMEVKMRRLCELLDEVFVRTKENAEKKLTLTYEEMEAEREEEEVQADTESDDEEQQIYNPLKLPMGWDGKPIPYWLYKLHGLGQEFKCEICGNHSYWGRRAYERHFKEWRHQHGMRCLGIPNTKNFNEITSIEEAKGLWEKIQARQGLNKWRPDLEEEY

SEQ ID NO: 16794 - protein, 481 aa, Pennisetum glaucum
AVRELQRDPANARDRLFQSHRVRHMLDLVVSTSDKLVEIYEDKDNSRKDEINTHLTAPTQSLLFSKYYERLKEIRDYHRRNPSARFVSTTDDYEELLKEEPVIEFTGEEAFGRYLDLHELYNEFINSKFGTPMEYSAYVGCFSQTEKISQSHKTTRQFKEYLEHILEYLTSFLYRTEPLQDIEKIFAKLETEFEERWANGEVPGWGNKSMEESDIDLDYYSTVEELVELGPEKLKHALAARGLKSGGTVQQRAERLFLLKHTPLEQLDRKHFAKVPRTKDVSDAASNGNNFKDDMKKEIALMELKMKRLCELLDEFFVRTKENAEKKLTLTYEEMEAEREEEEVQADTDSDDEEQQIYNPLKLPMGWDGKPIPYWLYKLHGLGQEFKCEICGNHSYWGRRAYERHFKEWRHQHGMRCLGIPNTKNFNEITSIEEARGLWGKIQARQGLNKWRPDLEEEYEDQEGNIYNKKTYADLQRQGLI

SEQ ID NO: 16795 - protein, 638 aa, Zea mays
MADAHHFNNISLGGRGGGHPGQFKLYSGGLAWKKQGGGKIIEVDKGDITNVAWMRIPKSYQLSVGTKEGLCYRFFGFREQDVSNLTNFIEKSTGITPEEKQLSVSGQNWGGIQINGNMLCFNVGSKEAFEVSLADVAQTQMQGKTDVVLEFHVDDTTGANEKDSLMDLSFHVPTSNTQFIGDEHRTSAQMLWQAISVEIDGGGSSEMAVVTFDGIAILTPRGRYSVELHQSFLRLQGQANDFKIQYSSILRLFVLPKSHNPHTFVVITLDPPIRKGQTLYPHIVIQFETEAVVERELTLSGEILAEKYKDRLESSYRGLIHEVFSKVLRGLSSAKVTRPSTFRSCLDGYAVKSSLKAEDGLLYPLEKGFFFLPKPPTLIPHEEIEYVEFERHGAGGASISSHYFDLLVKLTNDQELLFRNIQRNEYHNLFNFISGKHLKILNLGDGQGRTSGVTAVLQSTDDDSVDPHLERIKNQAGNEESDEEDEDFVADKDDSGSPTDDSDAEGSDASMSGGEKEKPSKKEASSSKPPVKKKQKSGPDEGSQKKKPKKKKDPNAPKRAIAPFMYFSKAERANIKSSNPELATTEIAKKLGERWQKMTAEERQPYVEQSQVDKQRYAEESAAYRGAAAQQGSGAGSE

SEQ ID NO: 16796 - protein, 644 aa, Sorghum bicolor
MADGHHFNNISLGGRGGGNPGQFKLYSGGLAWKKQGGGKIIEVDKGDITSVAWMRIPKSYQLSVGTKEGLCYRFFGFREQDVSSLTNFIEKSTGITPEEKQLSVTGHNWGGIEINGSMLCFNVGSKEAFEVSLADVAQTQMQGKTDVVLEFHVDDTTGANEKDSLMDLSFHVPTSNTQFVGDEHRTSAQMLWQAISVEIDGGGSSEMAVVTFDGIAILTPRGRYSVELHQSFLRLQGQANDFKIQYSSILRLFVLPKSHNPHTFVVITLDPPIRKGQTLYPHIVIQFETEAVVERELALSGEVLAEKYKDRLESSYRGLIHEVFSKVLRGLSGAKVTRPSTFRSCQDGYAVKSSLKAEDGLLYPLEKGFFFLPKPPTLIPHDEIEYVEFERHGAGGASISSHYFDLLVKLTNDQEHLFRNIQRNEYHNLFNFISGKHLKILNLGDGQGRTSGVTAVLQSTDDDSVDPHLERIKNQAGNDESDEEDEDFVADKDDSGSPTDDSDADGSDASMSGGDKEKPSKKEASSSKEASSSKPPVKKKQKSGPDEGSQKKRPKKKKDPNAPKRAIAPFMYFSKAERANIKSSNPELATTEIAKKLGERWQKMTAEERQPYVEQSQVDKQRYAEESAAYRGAAAQQGSGAGSE

SEQ ID NO: 16797 - protein, 638 aa, Panicum virgatum
MTEGHHFNNISLGGRGGGNPGQFKLYSGGLAWKKQGGGKIIEVDKADITSVTWMKIPKSYQLSVGTRDGLCYRFFGFREQDVSGLTNFIQKSTGITPEEKQLSISGHNWGGVAINGNMLCFNVGSKEAFEVSLADVSQSQMQGKTDVVLEFHVDDTTGANEKDSLMDLSFHVPTSNTQFVGDEHRTSAQMLWQAISVQIDGGGSSETAVATFDGIAILTPRGRYSVELHQSFLRLQGQANDFKIQYSSILRLFVLPKSHNPHTFVVITLDPPIRKGQTLYPHIVIQFETETVVERELTLSEEVLAEKYKDRLESSYRGLIHEVFSMVLRGLSGAKVTRPSTFRSCQDGYAVKSSLKAEDGLLYPLEKGFFFLPKPPTLIPHEEIEYVEFERHGAGGASISSHYFDLLVKLKNDQEHLFRNIQRNEYHNLFNFISGKHIKILNLGDGQGRAGGVTAVLQSTDDDSVDPHLERIKNQAGNEESDEEDEDFVADKDDSGSPTDDSDEDGSDASLTGGEKEKSSKKEASSSKPPVKKKQKSVPDEGSQKKKPKKKKDPNAPKRAIAPFMYFSKAERANIKSSNPELATTEIAKKLGERWQKMSAEERQPYIEQSQVDKQRYAEESAAYRGATTQQGSGDGSE

SEQ ID NO: 16798 - protein, 638 aa, Setaria italica
MMDGHHFNNISLGGRGGGNPGQFKLYSGGLAWKKQGGGKIIEVDKADITSVTWMRIPKSYQLSVGTKEGLCYRFFGFREQDVSSLTNYIQKSTGITPQEKQLSISGQNWGGIEINGNVLCFNVGSKEAFEVSLADVSLSQMQGKTDVVLEFHVDDTTGANEKDSLMDLSFHVPTSNTQFIGDEHRTSAQMLWQAISVQIDGGGSSEAAVATFDGIAILTPRGRYSVELHQSFLRLQGQANDFKIQYSSILRLFVLPKSHNPHTFVVITLDPPIRKGQTLYPHIVIQFETETIVERELTLSEEVLAEKYKDRLQSSYRGLIHEVFSMVLRGLSGAKVTRPSTFRSCQDGYAVKSSLKAEDGLLYPLEKAFFFLPKPPTLISHDEIEYVEFERHGAGGASISSHYFDLLVKLKNDQEHLFRNIQRNEYHNLFNFISGKHLKILNLGDGQGRAGGVTAVLQSTDDDSVDPHLERIKNQAGNEESDEEDEDFVAEKDDSGSPTDDSDEDGSDASLSGEEKEKSSKKEASTSKPPVKKKQKSVPDEGSQKKKPKKKKDPNAPKRAIAPFMYFSKAERPNIKSSNPELATTEIAKKLGERWQKMSAEERQPYIEQSQVDKQRYAEESAAYRGASTQQGSGGGSD

SEQ ID NO: 16799 - protein, 643 aa, Triticum aestivum
MTDGHLFNNISLGGRVGNNPGQFRLYSGGLAWKKQGGGKTIEVDKADIISVTWMKIPRSYQLSVGTKEGIRYVFKGFREQDVSNLTNFIQKNTGTTPEEKQLSVSGHNWGAVDINGNMLSFNVGSKEAFEVSLSDVSQTQLQGKTDVVLEFHVDDTTGANEKDSLMDLSFHVPTSNTQFLGDEERPSAHIFWQKILAIADVGSSEEAVVSLEGIAILTPRGRYTVELHMSFLRLQGQANDFKIQYSSILRLFVLPKSNNPHTFVVITLDPPIRKGQTLYPHIVIQFVTENVVEKELSLSEEVLAEKYKDRLQSSYNGLEHEVFSKILRGLSGAKVTRPSTFRSCQDGYAVKSSLKAEDGLLYPLEKGFFFLPKPPTLILHEEIEYVEFERHGAGGASMSSHYFDLLVKLKNDQEHLFRNIQRNEYHNLFNFVSGKNLKILNLGEDGQDRTGAVAAALQSTDDDPVDPHLERIKNQAGDEESDEEDEDFVADKDDSGSPSDDSEEGSDASISDGEKEKSSKKEASSSKPPAKRKPKNVDVEGSEKRKPKKKQKKDPNAPKRAIAPFMYFSKAERANLKNINPELSTTDIAKKLGEKWQKMSAEEKQPYVEQSQVDKKRYAEESAAYRGAGAAPVDVDSADGSSD

SEQ ID NO: 16800 - protein, 641 aa, Oryza sativa
MTDGHLFNNILLGGRAGSNPGQFKVYSGGLAWKRQGGGKTIEIEKSDLTSVTWMKVPRAYQLGVRTKDGLFYKFIGFREQDVSSLTNFMQKNMGLSPDEKQLSVSGQNWGGIDINGNMLTFMVGSKQAFEVSLADVSQTQMQGKTDVLLEFHVDDTTGGNEKDSLMDLSFHVPTSNTQFLGDENRTAAQVLWETIMGVADVDSSEEAVVTFEGIAILTPRGRYSVELHLSFLRLQGQANDFKIQYSSIVRLFLLPKSNNPHTFVVVTLDPPIRKGQTLYPHIVIQFETEAVVERNLALTKEVLAEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRSEYHNLFNFINGKHLKIMNLGDGQGATGGVTAVLRDTDDDAVDPHLERIKNQAGDEESDEEDEDFVADKDDSGSPTDDSGGEDSDASESGGEKEKLSKKEASSSKPPVKRKPKGRDEEGSEKRKPKKKKDPNAPKRAMTPFMYFSMAERGNMKNNNPDLPTTEIAKKLGEMWQKMTGEEKQPYIQQSQVDKKRYEKESAVYRGAAAMDVDSGSGGNESD

SEQ ID NO: 16801 - protein, 643 aa, Secale cereale
MTDGHLFNNISLGGRVGNNPGQFRLYSGGLAWKKQGGGKTIEVDKADIISVTWMKIPRSYQLSVGTKEGIRYVFKGFREQDVSNLTNFIQKNTGTTPEEKQLSVSGHNWGAVDINGNMLSFNVGSKEAFEVSLSDVSQTQLQGKTDVVLEFHVDDTTGANEKDSLMDLSFHVPTSNTQFLGDEERPSAHIFWQKILAIADVGSSEEAVVSLEGIAILTPRGRYTVELHMSFLRLQGQANDFKIQYSSILRLFVLPKSNNPHTFVVITLDPPIRKGQTLYPHIVIQFVTENVVEKELSLSEEVLAEKYKDRLQSSYNGLEHEVFSKILRGLSGAKVTRPSTFRSCQDGYAVKSSLKAEDGLLYPLEKGFSFLPKPPTLILHEEIEYVEFERHGAGGASMSSHYFDLLVKLKNDQEHLFRNIQRNEYHNLFNFVSGKNLKILNLGEDGQDRTGAVAAALQSTDDDPVDPHLERIKNQAGDEESDEEDEDFVADKDDSGSPSDDSEEGSDASISDGEKEKSSKKEASSSKPPAKRKPKNVDVEGSEKRKPKKKNKKDPNAPKRAIAPFMYFSKAERANLKNINPELSTTDIAKKLGEKWQKMSAEEKQPYVEQSQVDKKRYAEETAAYRGAGAAPVDVDSADGSSD

SEQ ID NO: 16802 - protein, 641 aa, Oryza sativa
MTDGHLFNNILLGGRAGSNPGQFKVYSGGLAWKRQGGGKTIEIEKSDLTSVTWMKVPRAYQLGVRTKDGLFYKFIGFREQDVSSLTNFMQKNMGLSPDEKQLSVSGQNWGGIDINGNMLTFMVGSKQAFEVSLADVSQTQMQGKTDVLLEFHVDDTTGGNEKDSLMDLSFHVPTSNTQFLGDENRTAAQVLWETIMGVADVDSSEEAVVTFEGIAILTPRGRYSVELHLSFLRLQGQANDFKIQYSSIVRLFLLPKSNNPHTFVVVTLDPPIRKGQTLYPHIVIQFETEAVVERNLALTKEVLAEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRSEYHNLFNFINGKHLKIMNLGDGQGATGGVTAVLRDTDDDAVDPHLERIKNQAGDEESDEEDEDFVADKDDSGSPTDDSGGEDSDASESGGEKEKLSKKEASSSKPPVKRKPKGRDEEGSDKRKPKKKKDPNAPKRAMTPFMYFSMAERGNMKNNNPDLPTTEIAKKLGEMWQKMTGEEKQPYIQQSQVDKKRYEKESAVYRGAAAMDVDSGSGGNESD

SEQ ID NO: 16803 - protein, 639 aa, Sorghum bicolor
MTDGHHFNNILLGGRGGTNPGQFKVYSGGLAWKRQGGGKTIEIDKADVTAVTWMKVPRAYQLGVRIKDGLFYRFIGFREQDVSSLTNFIQKNMGVTPDEKQLSVSGHNWGGIDIDGNMLTFMVGSKQAFEVSLADVAQTQMQGKTDVLLELHVDDTTGANEKDSLMDLSFHVPTSNTQFVGDENRPPAHILWETILKFADVGSSEEPVVTFDGIAILTPRGRYSVELHLSFLRLQGQANDFKIQYSSIVRLFLLPKSNNPHTFVVITLDPPIRKGQTLYPHIVIQFETEAVVERDLALSKELLVDKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRNEYHNLFNFINGKNIKIMNLGGDGQGASGVVTDVLRDTDDDAVDPHLERIKNQAGDDESDEEDEDFVADKDDSGSPTDDSGDEDSDASDSGGEKEKSSKKEASSSKPVQKRKPKGRDDEGHEKKKAKKKKDPNAPKRAMTPFMYFSMAERGNMKSSNPDLPTTEIAKKLGEMWQKMSSEEKQPYIQQAQVDKKRYEKESAVYRGEATADVDSGNESD

SEQ ID NO: 16804 - protein, 643 aa, Brachypodium distachyon
MTDGHLFNNISLGGRVGNNPGQFKLHSGGLAWKKQGGGKTIEVDKADIISMTWMKIPRSYQLSVGTKEGIRYMFKGFREQDVSNLANFIQKSTGVAPEEKQLSVSGHNWGGVEITGNMLSFNVGSKEAFEVSLADVSQTQMQGKTDVVLEFHVDDTTGANEKDSLMDISFHIPTTNTQFPGDEDRPSAHIFWQKILAIADVGSSEEAVVTFEGIAILTPRGRYSVELHMSFLRLQGQANDFKIQYSSILRLFVLPKSNNPHTFVVITLDPPIRKGQTLYPHIVIQFQTEVVAEMDLKLSEEVLAEKYKDRLQGSYNGLEHEVFSKILRGLSGAKVTRPSTFRSCQDGYAVKSSLKAEDGLLYPLEKGFFFLPKPPTLILHEEIEYVEFERHGAGGASMSSHYFDLLVKLKNDQEHLFRNIQRNEYHNLFDFVSGKNLKIMNLGEDGQGRTGAVAAALDSTDDSLHDPHLERIKNQAGDEESDEEDEDFVADKDDSGSPSDDSDEGSDASLSGGESEKSSKKEASSSKPPVKRKPKSGDTEGSEKRKPKKKKKDPNAPKRALAPFMYFSKAERANLKSSNPVLGTTDIAKKLGEKWQKMSAEEKQPYVEQHLVDKKRYQEETAAYRDNAGAAPVDVESDDQLSD

SEQ ID NO: 16805 - protein, 639 aa, Saccharum officinarum
MTDGHHFNNILLGGRGGTNPGQFKVYSGGLAWKRQGGGKTIEIDKADVTAVTWMKVPRAYQLGVRIKDGLFYRFIGFREQDVSSLTNFIQKNMGVTPDEKQLSVSGHNWGGIDIDGNMLTFMVGSKQAFEVSLADVAQTQMQGKTDVLLELHVDDTTGANEKDSLMDLSFHVPTSNTQFVGDENRPPAHILWETILKFADVGSSEEPVVTFDGIAILTPRGRYSVELHLSFLRLQGQANDFKIQYSSIVRLFLLPKSNNPHTFVVITLDPPIRKGQTLYPHIVIQFETEAVVERDLALSKELLVDKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRNEYHNLFNFINGKNIKIMNLGGDGQGASGVVTDVLRDTDDDAVDPHLERIKNQAGDDESDEEDEDFVADKDDSGSPTDDSGDEESDASDSGGEKEKSSKKEASSSKPVQKRKPKGRDDEGHEKKKAKKKKDPNAPKRAMTPFMYFSMAERGNMKSSNPDLPTTEIAKKLGEMWQKMSSEEKQPYIQQAQIDKKRYEKESAVYRGEATADVDSGNESD

SEQ ID NO: 16806 - protein, 639 aa, Echinochloa colona
MTDGHHFNNILLGGRGGTNPGQFKVHSGGLAWKRQGGGKTIEIDKADVTSVTWMKVPRAYQLGVRIKDGLFYRFIGFREQDVSSLTNFIQKNMGVTPDEKQLSVSGHNWGGIDIDGNMLTFMVGSKQAFEVSLPDVAQTQMQGKTDVLLEFHHDDTTGANEKDSLMDLSFHVPTSNTQFIGDENRPPAHILWETILKFADVGSSEEPVVTFEGIAILTPRGRYSVELHLSFLRLQGQANDFKIQYSSIVRLFLLPKSNNPHTFVVITLDPPIRKGQTLYPHIVIQFETEAVVERDLALSKEVLAEKYKDRLEESYKGLIHEVFTKVLRGLSGAKVTRPGSFRSCQDGYAVKSSLKAEDGLLYPLEKGFFFLPKPPTLILHEEIEFVEFERHGAGGASMSSHYFDLLVKLKNDQEHLFRNIQRNEYHNLFNFINGKNMKIMNLGGDGQGTSGVVTDVLRDTDDDAVDPHLERIKNQAGDEESDEEDEDFVADKDDSGSPTDDSGDEDSDASDSGGEKEKSSKKEASSSKPVQKRKPKGKDEDGPEKKKAKKKKDPNAPKRAMTPFMYFSMAERGNMKSNNPDLPTTEIAKKLGEMWQKMSSEEKQPYIQQAQVDKKRYEKESAVYRGEAPVDVDSGNESD

SEQ ID NO: 16807 - protein, 639 aa, Echinochloa colona
MTDGHHFNNILLGGRGGTNPGQFKVHSGGLAWKRQGGGKTIEIDKTDVTSVTWMKVPRAYQLGVRIKDGLFYRFIGFREQDVSSLTNFIQKNMGVTPDEKQLSVSGHNWGGIDIDGNMLTFMVGPKQAFEVSLPDVAQTQMQGKTDVLLEFHHDDTTGANEKDSLMDLSFHVPTSNTQFIGDENRPPAHILWETILKFADVGSSEEPVVTFEGIAILTPRGRYSVELHLSFLRLQGQANDFKIQYSSIVRLFLLPKSNNPHTFVVITLDPPIRKGQTLYPHIVIQFETEAVVERDLALSKEVLAEKYKDRLEESYKGLIHEVFTKVLRGLSGAKVTRPGSFRSCQDGYAVKSSLKAEDGLLYPLEKGFFFLPKPPTLILHEEIEFVEFERHGAGGASMSSHYFDLLVKLKNDQEHLFRNIQRNEYHNLFNFINGKNMKIMNLGGDGQGTSGVVTDVLRDTDDDAVDPHLERIKNQAGDEESDEEDEDFVADKDDSGSPTDDSGDEDSDASDSGGEKEKSSKKEASSSKPVQKRKPKGKDEDGPEKKKAKKKKDPNAPKRAMTPFMYFSMAERGNMKSNNPDLPTTEIAKKLGEMWQKMSSEEKQPYIQQAQVDKKRYEKESAVYRGEAPVDVDSGNESD

SEQ ID NO: 16808 - protein, 639 aa, Setaria italica
MTDGHHFNNILLGGRGGTNPGQFKVHSGGLAWKRQGGGKTIEIDKADVTSVTWMKVPRAYQLGVRIKDGLFYRFIGFREQDVSSLTNFIQKNMGVTPDEKQLSVSGHNWGGIDIDGNMLTFMVGTKQAFEVSLPDVAQTQMQGKTDVLLEFHVDDTTGANEKDSLMDLSFHVPTSNTQFVGDENRPPAHILWETILKFADVGSSEEPVVTFEGIAILTPRGRYSVELHLSFLRLQGQANDFKIQYSSIVRLFLLPKSNNPHTFVVITLDPPIRKGQTLYPHIVIQFETEVVVERDLALSKEVLADKYKDRLEESYKGLIHEVFTKVLRGLSGAKVTRPGSFRSCQDGYAVKSSLKAEDGLLYPLEKGFFFLPKPPTLILHEEIEFVEFERHGAGGASMSSHYFDLLVKLKNDQEHLFRNIQRNEYHNLFNFINGKNIKIMNLGGDGQGTSGVVTDVLRDTDDDAVDPHLERIKNQAGDEESDEEDEDFVADKDDSGSPTDDSGDEDSDASDSGGEKEKSSKKEASSSKPVQKRKPKGRDEDGPEKKKAKKKKDPNAPKRAMTPFMYFSMAERGNMKSSNPDLPTTEIAKKLGEMWQKMSSEEKQPYIQQAQVDKKRYEKESAVYRGEAPVDVDSGNDSD

SEQ ID NO: 16809 - protein, 639 aa, Zea mays
MTDGHHFNNILLGGRGGTNPGQFKVHSGGLAWKRQGGGKTIEIDKADVTAVTWMKVPRAYQLGVRIKAGLFYRFIGFREQDVSNLTNFIQKNMGVTPDEKQLSVSGQNWGGIDIDGNMLTFMVGSKQAFEVSLPDVAQTQMQGKTDVLLELHVDDTTGANEKDSLMDLSFHVPTSNTQFVGDESRPPAHILWETILKFADVGSSEEPVVTFEGIAILTPRGRYSVELHLSFLRLQGQANDFKIQYSSIVRLFLLPKSNNPHTFVVITLDPPIRKGQTLYPHIVIQFETEAVVERDLALSKELLVEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRNEYHNLFNFINGKNIKIMNLGGDGQGASGVVTDVLRDTDDDAVDPHLERIKNQAGDEESDEEDEDFVADKDDSGSPTDDSGDEESDASDSGGEKEKSSKKEASSSKPVQKRKHKGRDDEGQEKKKPKKKKDPNAPKRAMTPFMYFSMAERGNMKSSNPDLPTTEIAKKLGEMWQKMSGEEKQPYIQQAQVDKKRYEKESAVYRGEATVDVDSGNESD

SEQ ID NO: 16810 - protein, 639 aa, Panicum virgatum
MTDGPHFNNILLGGRGGTNPGQFKVHSGGLAWKRQGGGKTIEIDKADVTSVTWMKVPRAYQLGVRIKDGLFYRFIGFREQDVSSLTNFIQKNMGVTPDEKQLSVSGHNWGGIDIDENMLTFMVGSKQAFEVSLPDVAQTQMQGKTDVLLEFHHDDTTGANEKDSLMDISFHVPTSNTQFVGDENRPPAHILWETILKFADVGSSEEPVVTFEGIAILTPRGRYSVELHLSFLRLQGQANDFKIQYSSIVRLFLLPKSNNPHTFVVITLDPPIRKGQTLYPHIVIQFETEAVVERDLALSKEILAEKYKDKLEESYKGLIHEVFTKVLRGLSGAKVTRPGSFRSCQDGYAVKSSLKAEDGLLYPLEKGFFFLPKPPTLILHEEIEFVEFERHGAGGASMSSHYFDLLVKLKNDQEHLFRNIQRNEYHNLFNFINGKNMKIMNLGGDGQGTSGVVTDVLRDTDDDAVDPHLERIKNQAGDEESDEEDEDFVADKDDSGSPTDDSGDEDSDASDSGGEKEKSSKKEASSSKPVQKRKPKGRDEDGPEKKKTKKKKDPNAPKRAMTPFMYFSMAERGNMKNSNPDLPTTEIAKKLGEMWQKMSSEEKQPYIQQAQVDKKRYEKESAVYRGEAPVDVDSGNESD

SEQ ID NO: 16811 - protein, 642 aa, Lolium multiflorum
MTDGHLFSNISLGGRVGNNPGQFRLHSGGVAWKKQGGGKTIDVDKADIISMTWMKIPRSYQLSVGTKEGIRYMFKGFREQDVSNLTNFIQKNTGIAPEEKQLSVSGHNWGAVDINGNMLSFNVGSKEAFEVSLADVSQTQLQGKTDVVLEFHVDDTTGANEKDSLMDMSFHVPTSNTQFIGDEERPSAHIFWQKILAIADVGSSEEAVAAFEGIGILTPRGRYTVELHMSFLRLQGQANDFKIQYSSILRLFVLPKSNNPHTFLVITLDPPIRKGQTLYPHIVIQFMTEAVLTTELSLSEEVLAEKYKDRLQSSYNGLEHEVFSKILRGLSGAKVTRPSTFRSCQDGYAVKSSLKAEDGLLYPLEKGFFFLPKPPTLILHEEIDYVEFERHGAGGASMSSHYFDLLVKLKNDQEHLFRNIQRNEYHNLFNFVSAKNLKIMNLGEDGVEGSGAVAAALQSTIDDPDPYLNGIKNQAGDEESDEEDEDFVADKDDSGSPSDDSEEEGSDASLSGGEKEKSSKKEVSSSKPPAKRKPKSVDAEGSEKKKAKKKKKDPNAPKRAIAPFMYFSKTERVNLKNSNPELGVTDIAKKLGEKWQKMSAEERQPYVEQSIVDKKRYAEETAVYRGAAAAPVDVDSGDDLSD

SEQ ID NO: 16812 - protein, 643 aa, Avena sativa
MADGHLFSNISLGGRVGNNPGQFRLHSGGVAWKKQGGGKTIDVDKADIISMSWMKIPRSYQLSVGTKEGIRYMFKGFREQDVSNLTNFIQKNTGITPEEKQLSVSGHNWGAVDINGNMLSFNVGSKEAFEVSLADVSQTQLQGKTDVVLEFHVDDTTGANEKDSLMDLSFHVPTSNTQFVGDEERPSAHIFWQKILAIADVGSSEEAVATFEGIGILTPRGRYVVELHMSFLRLQGQANDFKIQYSSILRLFVLPKSNNPHTFLVITLDPPIRKGQTLYPHIVIQFMTESVATTELSLSEEVLAEKYKDRLQSSYNGLEHEVFSKILRGLSGAKVTRPSTFRSCQDGYAVKSSLKAEDGLLYPLEKGFFFLPKPPTLILHEEIDYVEFERHGAGGASMSSHYFDLLVKLKNDQEHLFRNIQRNEYHNLFNFVSAKNLKIMNLGEDGLDGSGAVAAALQSTDDDPLDPYLNGIKNQAGDEESDEEDEDFVADKDDSGSPSDASEEEGSDASLSGGEKEKSSKKEVSSSKPPVKRKPKSGDVEGSEKKKAKKKKKDPNAPKRAIAPFMYFSKAERVNLKNSNPELSTTDIAKKLGEKWQKMSAEERQPYVDQSLVDKKRYAEETAKYRGAAAALVDVESADESSD

SEQ ID NO: 16813 - protein, 644 aa, Avena sativa
MADGHLFSNISLGGRVGNNPGQFRLHSGGVAWKKQGGGKTIEVDKADIISMSWMKIPRSYQLSVGTKEGIRYMFKGFREQDVSNLTNFIQKNTGITPEEKQLSVSGHNWGAVDINGNMLSFNVGSKEAFEVSLADVSQTQLQGKTDVVLEFHVDDTTGANEKDSLMDLSFHVPTSNTQFVGDEERPSAHIFWQKILAIADVGSSEEAVATFEGIGILTPRGRYVVELHMSFLRLQGQANDFKIQYSSILRLFVLPKSNNPHTFLVITLDPPIRKGQTLYPHIVIQFMTESVATTELSLSEEVLAEKYKDRLQSSYNGLEHEVFSKILRGLSGAKVTRPSTFRSCQDGYAVKSSLKAEDGLLYPLEKGFFFLPKPPTLILHEEIDYVEFERHGAGGASMSSHYFDLLVKLKNDQEHLFRNIQRNEYHNLFNFVSAKNLKIMNLGEDGLDGSGAVAAALQSTDDDPLDPYLNGIKNQAGDEESDEEDEDFVADKDDSGSPSDASEEEGSDASLSGGEKEKSSKKEVSSSKPPVKRKPKSGDVEGSEKKKAKKKKKDPNAPKRAIAPFMYFSKAERVNLKNSNPELSTTDIAKKLGEKWQKMSTEERQPYVEQSLVDKKRYAEETAVYRGAATAAPVDVESGDESSD

SEQ ID NO: 16814 - protein, 644 aa, Avena sativa
MADGHLFSNISLGGRVGNNPGQFRLHSGGVAWKKQGGGKTIEVDKADIISMSWMKIPRSYQLSVGTKEGIRYMFKGFREQDVSNLTNFIQKNTGVTPEEKQLSVSGHNWGAVDINGNMLSFNVGSKEAFEVSLADVSQTQLQGKTDVVLEFHVDDTTGANEKDSLMDLSFHVPTTNTQFVGDEERPSAHIFWQKILAIADVGSSEEAVATFEGIGILTPRGRYVVELHMSFLRLQGQANDFKIQYSSILRLFVLPKSNNPHTFLVITLDPPIRKGQTLYPHIVIQFMTESVATTELSLSEEVLAEKYKDRLQSSYNGLEHEVFSKILRGLSGAKVTRPSTFRSCQDGYAVKSSLKAEDGLLYPLEKGFFFLPKPPTLILHEEIDYVEFERHGAGGASMSSHYFDLLVKLKNDQEHLFRNIQRNEYHNLFNFVSAKNLKIMNLGEDGLDGSGAVAAALQSTDDDPLDPYLNGIKNQAGDEESDEEDEDFVADKDDSGSPSDASEEEGSDASLSGGEKEKSSKKEVSSSKPPVKRKPKSGDVEGSEKKKAKKKKKDPNAPKRAIAPFMYFSKAERVNLKNSNPELSTTDIAKKLGEKWQKMSTEERQPYVEQSLVDKKRYAEETAVYRGAATAAPVDVESGDESSD

SEQ ID NO: 16815 - protein, 624 aa, Pennisetum glaucum
RGGTNPGQFKVHSGGLAWKRQGGGKTIEIDKADVTSVTWMKVPRAYQLGVRIKDGLFYRFIGFREQDVSSLTNFIQKNMGVTPDEKQLSVSGHNWGGIDIDGNMLSFMVGSKQAFEVSLPDVAQTQMQGKTDVLLEFHVDDTTGANEKDSLMDLSFHVPTSNTQFVGDENRPPAHILWETILKFADVGSSEEPAVTFEGIGILTPRGRYSVELHLSFLRLQGQANDFKIQYSSIVRLFLLPKSNNPHTFVVITLDPPIRKGQTLYPHIVIQFETEAVVEKDLALSKEVLADKYKDRLEESYKGLVHEVFTKVLRGLSGAKVTRPGSFRSCQDGYAVKSSLKAEDGLLYPLEKGFFFLPKPPTLILHEEIEFVEFERHGAGGASISAHYFDLLVKLKNDQEHLFRNIQRNEYHNLFNFINGKNIKIMNLGGDGQGASVVTDVLRDTDDDAVDPHLERIKNQAGDEESDEEDEDFVADKDDSGSPTDDSGDEDSDASDSGGEKEKSSKKEASSSKPVQKRKPKGRDEDGPEKKKAKKKKDPNAPKRAMTPFMYFSMAERGNMKSSNPDLPTTEIAKKLGEMWQKMSSEEKQPYIQQAQVDKKRYEKESAVYRGEAPVDVDSGNESD

SEQ ID NO: 16816 - protein, 797 aa, Setaria italica
MATASDGGKGPGAAAVPPQLESFLAIGLDQRTAENALANRKVTANLTAVIAEAGVTECHKSVGNLLYTVATKYPANALVHRPDLIKYILSEKIKNSAQLDAALSFLSTLGPDSLDPVKFEEACGVGVVVSFEEIQSTVNDVLNENMEAILEQRYRINVGSLCGLVRKRQPWGDAKLVKEEIEKRLVEILGPKTEADNAKPIKKKKEKPAKVEEEKTVAAPPSEEELNPYSIFPQPEENFKVHTEIFFSDGNIWRAHNTKSILEKHLKVTGGKVMTRFPPEPNGYLHIGHAKAMFIDFGLAKERNGHCYLRFDDTNPEAEKKEYIDHIQEIVTWMGWEPYKVTYTSDYFQDLYELAICLIQKGLAYVDHQTPEEIKEYREKKMNSPWRDRPIEESLKLFEDMRHGLIAEGKATLRMKQDMQNDNKNMADLIAYRIKFTPHPHAGDKWFIYPSYDYAHCLVDSLENITHSLCTLEFDIRRPSYYWLLVALGQYQPYVWEYSRLNISNNVMSKRKLNRLVTDKWVDGWDDPRLLTLAGLRRRGVSSTAINSFIRGMGITRSDNSLIQVERLEYHIREELNKVAPRALVVLHPLKVVITNLDYGTIMNLDAKMWPNAPDSDASAHYKVPFSRTLYIEESDFRLKDSKDFYGLAPGKSVMLRHAFPIKCAEVIYGDNPDSIVEIQAEYDPSKATKPKGVLHWVAEPSPGVEPLKVEVRLFEKLFLSENPAELEDWLGDLNPQSKEVIKGAYAVPSLANAVLGDKFQFERLGYFAVDSDSTPEGLVFNRTVTLKDSFGKAGPK

SEQ ID NO: 16817 - protein, 771 aa, Echinochloa colona
GLDQRTAENALANRKVTANLTAVIAEAGVTGCDKSVGNLLYTVATKYPANALVHRPNLIKYILSEKIKNSAQLDAALSFLSNLGPDSLDSVKFEEACGVGVVVSFEEIQSTVSDVLNQNMEAIVEQRYRINVGSLCGQVRKRHPWGDAKFVKEEIEKRLVEILGPKTEADNAKPMKKKKEKPAKVEEEKTVAAPPSEEELNPYSIFPQPEENFKVHTEIFFSDGNIWRAHNTKNILEKHLKVTGGKVMTRFPPEPNGYLHIGHAKAMFIDFGLAKERNGHCYLRFDDTNPEAEKKEYIDHIQEIVTWMGWEPYKITYTSDYFQDLYELAICLIQKGLAYVDHQTPEEIKEYREKKMNSPWRDRPIEESLKLFEDMRHGLIAEGKATLRMKQDMQNDNKNMADLIAYRIKFTPHPHAGDKWFIYPSYDYAHCLVDSLENITHSLCTLEFDIRRPSYYWLLVALGQYQPYVWEYSRLNISNNVMSKRKLNRLVTDKWVDGWDDPRLLTLAGLRRRGVSSTAINSFIRGMGITRSDNSLIRIERLEYHIREELNKVAPRALVVLHPLKIVITNLDHGTIINLDAKMWPNAPDDDASAHYKVPFSRIVYIEQSDFRLKDSKDFYGLAPGKSVMLRHAFPIKCTEVIYGNNPDSIVEIRAEYDPSKATKPKGVLHWVAEPSPGVEPLKVEVRLFEKLFLSENPAELEDWLGDLNPQSKEVIKGAYAVPSLANAVLGGKFQFERLGYFAVDSDSTAEALVFNRTVTLKDSYGKAGPK

SEQ ID NO: 16818 - protein, 799 aa, Sorghum bicolor
MATASDGDKESAAPASPPPQLESFLSIGLDQRTAENALANRKVTANLTAVIAEAGVTRCDKSVGNLLYTVATKYPTNALVHRPDLIKYILSEKIKNSAQLDAALTFLSTLGPDSLDSVKFEEACGVGVVVLFEEIQSTVTDVLNENMEAIVEQRYRINVGSLCGQVRKRHPWGDAKSIKEEIEKRLVEILGPKTEEDNAKPMKKKKEKPVKVEEEKTAVAVATPEEEVNPYSIFPQPEENLKVHTEIFFSDGNIWRAHNTKSILEKHLEATGGKVMTRFPPEPNGYLHIGHAKAMFIDFGLAKERNGHCYLRFDDTNPEAEKKEYIDHIQEIVTWIGWEPYKVTYTSDYFQDLYELAICLIQKGLAYVDHQSPEEIKEYREKKMNSPWRERPFEESLKLFEDMRRGLIAEGKATLRMKQDMQNDNKNMADFIAYRIKFTPHPHAGDKWFIYPSYDYAHCLVDSLENITHSLCSLEFGIRRPSYYWLLAALGQYQPYVWEYSRLNITNNVMSKRKLNQLVTDKWVDGWDDPRLLTLAGLRRRGISAAAINSFIRGMGITRSDNSLIRIERLEYHIREELNNVCPRALVVLHPLKVVITNLDYGMVINLDAKMWPNAPDSDGSAHYKVPFSRIIYIEKSDFRLKDSKDFYGLAPGKSVLLRHAFPIKCMEVIYGDNADSIVEIRAVYDASKATKPKGVLHWVAEPSPGVEPLKVEVRLFEKLFLSENPAELDDWLGDLNPQSKEVIKGAYAVPSLASAVLGDKFQFERLGYFAVDSDSTPEELVFNRTVTLKDSYGKAGPK

SEQ ID NO: 16819 - protein, 796 aa, Oryza sativa
MGTGGGEGDKSAALPLEALLALGLDQRTAENALVNSKVTANLAAVIAEAGISGCDKTVGNLLYTVATKYPTNALVHRPVLIDYIVSTKIKNPAQLDAALSFLTNTGPDSLDTGKFEEACGVGVVVSIEEIKSTVNEVLKHNMEAILEQRYHINVGNLCGQVRKMHPWGDAKATKDEIDKKLAEILGPKTDADNVKPVKKKKEKAAKVEEKKAAVVTAASPSEEELNPYSIFPQPEENFKVHTEIFYSDGNIWRAHNSKEILEKHLKATGGKVMTRFPPEPNGYLHIGHAKAMFIDFGLAKERNGHCYLRFDDTNPEAEKKEYIDHIQEIVHWMGWEPYKVTYTSDYFQALYEHAVELIRKGLAYVDHQTAEEIKEYREKKMNSPWRDRPIEESLKLFEDMRRGLIAEGAATLRMKQDMQNDNKNMSDLIAYRIKFTPHPHAGDKWCIYPSYDYAHCMVDSLENITHSLCTLEFDIRRPSYYWLLVALGLYQPYVWEYSRLNISNTVMSKRKLNRLVTEKWVDGWDDPRLLTLAGLRRRGVSSTAINSFIRGIGITRSDNSLIRVDRLEYHIREELNKTASRAMVVLNPLKVVITNLEDEKVIDLDGKMWPDAPADDASSYYKVPFSRIVYIEKTDFRLKDSKDYYGLAPGKSALLRYAFPIKCTEVVYGDNPDEIIEIRAEYDPSKTTKPKGVLHWVAQPAPGVEPLKVEVRLFDKLFLSENPAELEDWLGDLNPNSKEVIKGAYAVPSLATAVLGDKFQFERLGYFAVDTDSTPENIVFNRTVTLRDSYGKAGPK

SEQ ID NO: 16820 - protein, 796 aa, Oryza sativa
MGTGGGEGDKSAVLPLEALLALGLDQRTAENALVNSKVTANLAAVIAEAGISGCDKTVGNLLYTVATKYPTNALVHRPVLIDYIVSTKIKNPAQLDAALSFLTNTGPDSLDTGKFEEACGVGVVVSIEEIKSTVNEVLKHNMEAILEQRYHINVGNLCGQVRKRHPWGDAKATKDEIDKKLAEILGPKTDADNVKPVKKKKEKAAKVEEKKAAVVTAAPPSEEELNPYSIFPQPEENFKVHTEIFYSDGNIWRAHNSKEILEKHLKATGGKVMTRFPPEPNGYLHIGHAKAMFIDFGLAKERNGHCYLRFDDTNPEAEKKEYIDHIQEIVHWMGWEPYKVTYTSDYFQALYEHAVELIRKGLAYVDHQTAEEIKEYREKKMNSPWRDRPIEESLKLFEDMRRGLIAEGAATLRMKQDMQNDNKNMSDLIAYRIKFTPHPHAGDKWCIYPSYDYAHCMVDSLENITHSLCTLEFDIRRPSYYWLLVALGLYQPYVWEYSRLNISNTVMSKRKLNRLVTEKWVDGWDDPRLLTLAGLRRRGVSSTAINSFICGIGITRSDNSLIRVDRLEYHIREELNKTASRAMVVLNPLKVVITNLEDEKVIDLDGKMWPDAPADDASSYYKVPFSRIVYIEKTDFRLKDSKDYYGLAPGKSALLRYAFPIKCTEVVYGDNPDDIIEIRAEYDPSKTTKPKGVLHWVAQPAPGVEPLKVEVRLFDKLFLSENPAELEDWLGDLNPNSKEVIKGAYAVPSLATAVLGDKFQFERLGYFAVDTDSTPENIVFNRTVTLRDSYGKAGPK

SEQ ID NO: 16821 - protein, 795 aa, Brachypodium distachyon
MVTGVDGEKAPALQLETLLALGLDQRTAENALVNSKVTANLAAVIAEAGISGCDKSVGNLLYAVATKYPTNALVHRPALINYIVSTKIKNPAQLDAALLFLNNIGSDSLDVGKFEEVCGVGVVVSIEEIQSTVTEILKENMEAILEQRYHINVGNLCGQVRKRHPWGDAKATKEEIEKRLAEILGPKTEADNAKPVKKKKEKPAKVEEKKAAVATSAPPSEEELNPYSIFPQPAENNKVHTEIFFSDGNIWRAHNTKEILEKHLKQTGGKVMTRFPPEPNGYLHIGHAKAMFIDFGLAKERNGHCYLRFDDTNPEAEKKEYIDHIQEIVQWMGWEPYKVTYTSDYFQALHEHAVELIRKGLAYVDHQTADQIKEYREKKMDSPWRNRPIEESLQLFEDMRRGLIAEGAATLRMKQDMQNDNKNMSDLIAYRIKFTPHPHAGDKWCIYPSYDYAHCMVDSLENITHSLCTLEFDIRRPSYYWVLVALGLYQPHVWEYSRLNISNTVMSKRKLNRLVTEKWVDGWDDPRLLTLAGLRRRGVSSTAINTFIRGIGITRSDNSLIRVDRLEYHIREELNKTASRTMVVLHPLKVVITNLEDGKVIDLDGKKWPDAPADEASSYYKVPFSKTVYIEKTDFRVKDSKDYYGLAPGKSALLRYAFPIKCTEVIYGDNPDDIVEIRAEYDPSKTSKPKGVLHWVAQPAPGVEPLKVEIRLFEKLFLSENPAELEDWLGDLNPHSKEVIKGAYAVPSLATAVLGDKFQFERLGYFAVDTDSTPEKLVFNRTVTLRDSYGKAGPK

SEQ ID NO: 16822 - protein, 792 aa, Avena sativa
MVDGEKAPALQLETLLALGLDQRTAENALVNSKVTANLAAVIAEAGISGCDKSVGNLLYAVATKYPNNALVHRPALINYIVSTKIKSPAQLDAALSFLANVGPEPLDIGKFEEACGVGVVVSIEEIHSTVAEVLKGNMEAILEQRYHINVGSLCGQVRKKHPWGDAKATKDEIEKRLAEILGPKTEADNVKPVKKKKEKPAKVEEKKVAVATAAPPSEEELNPYTIFPQPAENNKVHTEIFFSDGNIWRAHNTKEILEKHLMATGGKVMTRFPPEPNGYLHIGHAKAMFIDFGLAKERNGHCYLRFDDTNPEAEKKEYIDHIQEIVQWMGWEPYKVTYTSDYFQALYEHAVELIRKGLAYVDHQTGEQIKECREKKMDSPWRNRPIEESLQLFEDMRRGMIAEGAATLRMKQDMQNDNKNMADLIAYRIKFTPHPHAGDKWCIYPSYDYAHCMVDSFENITHSLCTLEFDIRRPSYYWLLVALGLYQPHVWEYSRLNISNTVMSKRKLNRLVTEKWVDGWDDPRLLTLAGLRRRGVSATAINSFIRGIGITRSDNSLIRVDRLEYHIREELNKTASRTMVVLHPLKVVITNLEDGKVIDLDGKKWPDAPADDASSYYKVPFSRTVYIEKTDFRLKDSKDYYGLAPGKSALLRYAFPIKCTEVVYGDNPDEIVEIRAEYDPSKTSKPKGVLHWVAEPAPGVEPLKVEIRLFEKLFLSENPAELEDWLGDLNPNSKEIVKGAYAVPSLATAVLGDKFQFERLGYFAVDTDSTPEKLVFNRTVTLRDSYGKAGPK

SEQ ID NO: 16823 - protein, 799 aa, Secale cereale
MVDGEKAPAPAPPPALLQLETLLALGLDQRTAENALVNSKVTANLAAVVAEAGITGCDKSVGNLLYAVATKYPTNALVHRPALINYIVSTKIKNPAQLDAALSFLTNTGPETLDVGKFEEACGVGVVVSIEEIQSTVAEVLKENMEAILEQRYHINVGGLCGQVRKRHPWGDAKATKEEIEKKLAEILGPKTEADNVKPVKKKKEKPAKVEEKKVAVATAAPPSEEELNPYTIFPQPAENNKVHTEIFFSDGNIWRAHNTKEILEKHLKATGGKVMTRFPPEPNGYLHIGHAKAMFIDFGLAKERNGHCYLRFDDTNPEAEKKEYIDHIQEIVKWMGWEPYKVTYTSDYFQDLYEHAVELIRKGLAYVDHQTAEQIKEYREKKMDSPWRDRPIEESLQLFEDMRCGLIAEGAATLRMKQDMQNDNKNMSDLIAYRIKFTPHPHAGDKWCIYPSYDYAHCMVDSLENITHSLCTLEFDIRRPSYYWLLVALGLYQPHVWEYSRLNISHTMMSKRKLNRLVTEKWVDGWDDPRLLTLAGLRRRGVSANAINSFIRGIGITRSDNSLIRVDRLEYHIREELNKTASRTMVVLHPLKVVITNLEDGKVIDLDGKKWPDAPADEASSYYKVPFSKTVYIEKTDFRVKDSKDYYGLAPGKSALLRYAFPIKCTEVIYGDNPDDIVEIRAEYDPSKTSKPKGVLHWVAEPAPGVEPLKVEIRLFEKLFLSENPAELEDWLGDLNPHSKEVVKNAYAVPSLATAVLGDKFQFERLGYFAVDTDSTPEKLVFNRTVTLRDSYGKAGPK

SEQ ID NO: 16824 - protein, 795 aa, Secale cereale
MVDGEKSQAPALLRLETLLALGLDQRTAENALVNSKVTANLAAVVAEAGITGCDKSVGNLLYAVATKYPNNALVHRPALISYIVSTKIKNPAQLDAALSFLTNTGPETLDVGKFEEACGVGVVVSIEEIQSTVAEVLKENMEAILEQRYHINVGGLCGQVRKRHPWGDAKATKEEIEKKLAEILGPKTEADNVKPVKKKKEKPAKVEEKKVAVATVAPPSEEELNPYTIFPQPAENNKVHTEIFFSDGNIWRAHNTKEILEKHLKATGGKVMTRFPPEPNGYLHIGHAKAMFIDFGLAKERNGHCYLRFDDTNPEAEKKEYIDHIQEIVKWMGWEPYKVTYTSDYFQALYEHAVELIRKGLAYVDHQTAEQIKEYREKKMDSPWRDRPIEESLQLFEDMRRGLIAEGAATLRMKQDMQNDNKNMSDLIAYRIKFTPHPHAGDKWCIYPSYDYAHCMVDSLENITHSLCTLEFDIRRPSYYWLLVALGLYQPHVWEYSRLNISHTMMSKRKLNRLVTEKWVDGWDDPRLLTLAGLRRRGVSATAINSFIRGIGITRSDNSLIRVDRLEYHIREELNKTASRTMVVLHPLKVVITNLEDGKVIDLDGKKWPDAPADEASSYYKVPFSKTVYIEKTDFRVKDSKDYYGLAPGKSALLRYAFPIKCTEVIYGDNPDDIVEIRAEYDPSKTSKPKGVLHWVAEPAPGVEPLKVEIRLFEKLFLSENPAELEDWLGDLNPHSKEVVKDAYAVPSLATAVLGDKFQFERLGYFAVDTDSTPERLVFNRTVTLRDSYGKAGPK

SEQ ID NO: 16825 - protein, 795 aa, Secale cereale
MVDGEKSQAPALLRLETLLALGLDQRTAENALVNSKVTANLAAVVAEAGITGCDKSVGNLLYAVATKYPNNALVHRPALISYIVSTKIKNPAQLDAALSFLTNTGPESLDVGKFEEACGVGVVVSIEEIQSTVAEVLKENMEAILEQRYHINVGGLCGQVRKRHPWGDAKATKEEIEKKLSEILGPKTEADNVKPVKKKKEKPAKVEEKKVAVATAAPPSEEELNPYTIFPQPAENNKVHTEIFFSDGNIWRAHNTKEILEKHLKATGGKVMTRFPPEPNGYLHIGHAKAMFIDFGLAKERNGHCYLRFDDTNPEAEKKEYIDHIQEIVKWMGWEPYKVTYTSDYFQALYEHAVELIRKGLAYVDHQTAEQIKDYREKKMDSPWRDRPIEESLQLFEDMRRGLIAEGAATLRMKQDMQNDNKNMSDLIAYRIKFTPHPHAGDKWCIYPSYDYAHCMVDSLENITHSLCTLEFDIRRPSYYWLLVALGLYQPHVWEYSRLNISHTMMSKRKLNRLVTEKWVDGWDDPRLLTLAGLRRRGVSATAINSFIRGIGITRSDNSLIRVDRLEYHIREELNKTASRTMVVLHPLKVVITNLEDGKVIDLDGKKWPDAPADEASSYYKVPFSKTVYIEKTDFRVKDSKDYYGLAPGKSALLRYAFPIKCTEVIYGDNPDDIVEIRAEYDPSKTSKPKGVLHWVAEPAPGVEPLKVEIRLFEKLFLSENPAELEDWLGDLNPQSKEVVKDAYAVPSLATAVLGDKFQFERLGYFAVDTDSTPERLVFNRTVTLRDSYGKAGPK

SEQ ID NO: 16826 - protein, 796 aa, Setaria italica
MGTGGDGEKAAPALPLEALLALGLDQRTAENALVNSKVTANLAAVIAEAGIKECDKSVGNLLYAVATKYPTNALVHRPVLIKYVLSIKIKNPAQLDAALSFLTNTGPDSLDVEKFEEACGVGVVVSIEEIKSTVTDVLEENMEAIKEQRYHINVGTLCGQVRKRHPWGDAKAIKEEIDKRLAEILGPKTEADNIKPVKKKKEKPAKVEEKKVAVATSAPPSEEELNPYTIFPQPEENFKVHTEIFFSNGNIWRAHNTKEILEKHLKATGGKVMTRFPPEPNGYLHIGHAKAMFIDFGLAKERNGHCYLRFDDTNPEAEKKEYIDHIQEIVHWMGWEPYKVTYTSDYFQALYEHAVELIRRGLAYVDHQTAEEIKEYREKKMNSPWRDRPIEESLKLFEDMRRGLIAEGAATLRMKQDMQNDNKNMSDLIAYRIKFTPHPHAGDKWCIYPSYDYAHCMVDSLENITHSLCTLEFDIRRPSYYWLLVALDLYQPYVWEYSRLNISNTVMSKRKLNRLVTEKWVDGWDDPRLLTLAGLRRRGVSSTAINSFIRGIGITRSDNSLIRVDRLEYHIREELNKTAPRSMVVLRPLKVVITNLEEGKVMDLDGKMWPDASDTDASSHYKVPFSRTVYIESTDFRLKDSKDYYGLAPGKSVMLRYAFPIKCTDVIYGNSPDDIVEIRAEYDPLKTSKLKGVLHWVAEPAPGIEPLKVEVRLFEKLFMSENPAELEDWLGDLNPHSKEVIKDAYAVPSLATAVLGDKFQFERLGYFAVDTDSTPEKLVFNRTVTLRDSFGKAGPK

SEQ ID NO: 16827 - protein, 795 aa, Avena sativa
MVTGVDGEKAPALQLETLLALGLDQRTAENALVNSKVTANLAAVIAEAGISGCDKSVGNLLYAVATKYPNNALVHRPALINYIVSTKIKSPAQLDAALSFLANVGPESLDIGKFEEACGVGVVVSIEEIHSTVAEVLKGNMEAILEQRYHINVGSLCGQVRKKHPWGDAKATKDEIEKRLAEMLGPKTEADNVKPVKKKKEKPAKVEEKKVAVATAAPPSEEELNPYTIFPQPAENNKVHTEIFFSDGNIWRAHNTKEILEKHLMATGGKVMTRFPPEPNGYLHIGHAKAMFIDFGLAKERNGHCYLRFDDTNPEAEKKEYIDHIQEIVQWMGWEPYKVTYTSDYFQALYEHAVELIRKGLAYVDHQTGEQIKECREKKMDSPWRNRPIEESLQLFEDMRRGMIAEGAATLRMKQDMQNDNKNMADLIAYRIKFTPHPHAGDKWCIYPSYDYAHCMVDSFENITHSLCTLEFDIRRPSYYWLLVALGLYQPHVWEYSRLNISNTVMSKRKLNRLVTEKWVDGWDDPRLLTLAGLRRRGVSATAINSFIRGIGITRSDNSLIRVDRLEYHIREELNKTASRTMVVLHPLKVVITNLEDGKVIDLDGKKWPDAPADDASSYYKVPFSRTVYIEKTDFRLKDSKDYYGLAPGKSALLRYAFPIKCTEVVYGDNPDEIVEIRAEYDPSKTSKPKGVLHWVAEPAPGVEPLKVEIRLFEKLFLSENPAELEDWLGDLNPNSKEIVKGAYAVPSLATAVLGDKFQFERLGYFAVDTDSTPEKLVFNRTVTLRDSYGKAGPK

SEQ ID NO: 16828 - protein, 795 aa, Avena sativa
MVTGVDGEKAPALQLETLLALGLDQRTAENALVNSKVTANLAAVIAEAGISGCDKSVGNLLYAVATKYPNNALVHRPALINYIVSTKIKSPAQLDAALSFLANVGPEYLDIGKFEEACGVGVVVSIEEIHSTVAEVLKGNMEAILEQRYHINVGSLCGQVRKKHPWGDAKATKDEIEKRLAEILGPKTEADNVKPVKKKKEKPAKVEEKKVAVATAAPPSEEELNPYTIFPQPAENNKVHTEIFFSDGNIWRAHNTKEILEKHLMATGGKVMTRFPPEPNGYLHIGHAKAMFIDFGLAKERNGHCYLRFDDTNPEAEKKEYIDHIQEIVQWMGWEPYKVTYTSDYFQALYEHAVELIRKGLAYVDHQTGEQIKECREKKMDSPWRNRPIEESLQLFEDMRRGMIAEGAATLRMKQDMQNDNKNMSDLIAYRIKFTPHPHAGDKWCIYPSYDYAHCMVDSFENITHSLCTLEFDIRRPSYYWLLVALGLYQPHVWEYSRLNISNTVMSKRKLNRLVTEKWVDGWDDPRLLTLAGLRRRGVSATAINSFIRGIGITRSDNSLIRVDRLEYHIREELNKTASRTMVVLHPLKVVITNLEDGKVIDLDGKKWPDAPADDASSYYKVPFSRTVYIEKTDFRLKDSKDYYGLAPGKSALLRYAFPIKCTEVVYGDNPDEIVEIRAEYDPSKTSKPKGVLHWVAEPAPGVEPLKVEIRLFEKLFLSENPAELEDWLGDLNPNSKEIVKGAYAVPSLATAVLGDKFQFERLGYFAVDTDSTPEKLVFNRTVTLRDSYGKAGPK

SEQ ID NO: 16829 - protein, 792 aa, Avena sativa
MVDGEKAPALQLETLLALGLDQCTAENALVNSKVTANLAAVIGEAGISGCDKSVGNLLYAVATKYPNNALVHRPALINYIVSTKIKSPAQLDAALSFLANVGPESLDIGKFEEACGVGVVVSIEEIHSTVAEVLKGNMEAILEQRYHINVGSLCGQVRKKHPWGDAKATKDEIEKRLAEILGPKTEADNVKPVKKKKEKPAKVEEKKVAVATAAPPSEEELNPYTIFPQPAENNKVHTEIFFSDGNIWRAHNTKEILEKHLMATGGKVMTRFPPEPNGYLHIGHAKAMFIDFGLAKERNGHCYLRFDDTNPEAEKKEYIDHIQEIVQWMGWEPYKVTYTSDYFQALYEHAVELIRKGLAYVDHQTGEQIKECREKKMDSPWRNRPIEESLQLFEDMRRGMIAEGAATLRMKQDMQNDNKNMADLIAYRIKFTPHPHAGDKWCIYPSYDYAHCMVDSFENITHSLCTLEFDIRRPSYYWLLVALGLYQPHVWEYSRLNISNTVMSKRKLNRLVTEKWVDGWNDPRLLTLAGLRRRGVSATAINSFIRGIGITRSDNSLIRVDRLEYHIREELNKTASRTMVVLHPLKVVITNLEDGKVIDLDGKKWPDAPADDASSYYKVPFSRTVYIEKTDFRLKDSKDYYGLAPGKSALLRYAFPIKCTEVVYGDNPDEIVEIRAEYDPSKTSKPKGVLHWVAEPAPGVEPLKVEIRLFEKLFLSENPAELEDWLGDLNPNSKEIVKGAYAVPSLATAVLGDKFQFERLGYFAVDTDSTPEKLVFNRTVTLRDSYGKAGPK

SEQ ID NO: 16830 - protein, 795 aa, Avena sativa
MVTGVDGEKAPALQLETLLALGLDQRTAENALVNSKVTANLAAVIAEAGISGCDKSVGNLLYAVATKYPNNALVHRPALINYIVSTKIKSPAQLDAALSFLANVGPEYLDIGKFEEACGVGVVVSIEEIHSTVAEVLKGNMEAILEQRYHINVGSLCGQVRKKHPWGDAKATKDEIEKRLAEILGPKTEADNVKPVKKKKEKPAKVEEKKVAVATAAPPTEEELNPYTIFPQPAENNKVHTEIFFSDGNIWRAHNTKEILEKHLVATGGKVMTRFPPEPNGYLHIGHAKAMFIDFGLAKERNGHCYLRFDDTNPEAEKKEYIDHIQEIVQWMGWEPYKVTYTSDYFQALYEHAVELIRKGLAYVDHQTGEQIKECREKKMDSPWRNRPIEESLQLFEDMRRGMIAEGAATLRMKQDMQNDNKNMSDLIAYRIKFTPHPHAGDKWCIYPSYDYAHCMVDSFENITHSLCTLEFDIRRPSYYWLLVALGLYQPHVWEYSRLNISNTVMSKRKLNRLVTEKWVDGWDDPRLLTLAGLRRRGVSATAINSFIRGIGITRSDNSLIRVDRLEYHIREELNKTASRTMVVLHPLKVVITNLEDGKVIDLDGKKWPDAPADDASSYYKVPFSRTVYIEKTDFRLKDSKDYYGLAPGKSALLRYAFPIKCTEVVYGDNPDEIVEIRAEYDPSKTSKPKGVLHWVAEPAPGVEPLKVEIRLFEKLFLSENPAELEDWLGDLNPNSKEIVKGAYAVPSLATAVLGDKFQFERLGYFAVDTDSTPEKLVFNRTVTLRDSYGKAGPK

SEQ ID NO: 16831 - protein, 796 aa, Panicum virgatum
MGTGGDGEKSAPALPLEALLALGLDQRTAENALVNSKVTANLAAVIAEAGIKECDKSVGNLLYAVATKYPTNALVHRPVLIKYVLSTKIKNPAQLDGALSFLSNTGPDSLDVKKFEEACGVGVVVSIEEIKSTVTDVLEENMEAIKEQRYHINVGTLCGQVRKRHPWGDAKAIKEEIDKRLAEILGPKTEADNIKPVKKKKEKPAKVEEKKDAVATSAPPSEEELNPYTIFPQPEENFKVHTEIFFSSGNIWRAHNTKEILEKHLKATGGKVMTRFPPEPNGYLHIGHAKAMFIDFGLAKERNGHCYLRFDDTNPEAEKKEYIDHIQEIVHWMGWEPYKVTYTSDYFQALYEHAIELIRKGLAYVDHQTAEEIKEYRDKKMNSPWRDRPIEESLKLFEDMRRGLIAEGAATLRMKQDMQNENKNMSDLIAYRIKFTPHPHAGDKWCIYPSYDYAHCMVDSLENITHSLCTLEFDIRRPSYYWLLVALGLYQPYVWEYSRLNISNTVMSKRKLNRLVTEKWVDGWDDPRLLTLAGLRRRGVSSTAINSFIRGIGITRSDNSLIRVDRLEYHIREELNKTAPRTMVVLRPLKVVITNLEEGKVLDLDGKMWPDASDTDASSHYKVPFSRTVYIEKTDFRLKDSKDYYGLAPGKSVMLRYAFPIKCTDVIYGDSPDDIVEIRAEYDPLKTSKLKGVLHWVAEPTPGVEPLKVEVRLFEKLFMSENPAELEDWLGDLNPNSKEVIKDAYAVPSLATAVLGDKFQFERLGYFAVDTDSTPEKLVFNRTVTLRDSFGKAGPK

SEQ ID NO: 16832 - protein, 780 aa, Triticum aestivum
ETLLALGLDQRTAENALVNSKVTANLAAVVAEAGITGCDKSVGNLLYAVATKYPNNALVHRPALINYIVSTKIKNPAQLDAALSFLTNTGPESLDIGKFEEACGVGVVVSIEEIQSTVAEVLKENMEAILEQRYHINVGGLCGQVRKRHPWGDAKATKEEIEKKLAEILGPKTEADNVKPVKKKKEKPAKVEEKKVAVATAAPPSEEELNPYTIFPQPVENNKVHTEIFFSDGNIWRAHNTKEILEKHLKATGGKVMTRFPPEPNGYLHIGHAKAMFIDFGLAKERNGHCYLRFDDTNPEAEKKEYIDHIQEIVKWMGWEPYKVTYTSDYFQDLYEHAVELIRKGLAYVDHQTAEQIKEYREKKMDSPWRDRPIEESLQLFEDMRRGLIAEGAATLRMKQDMQNDNKNMSDLIAYRIKFTPHPHAGDKWCIYPSYDYAHCMVDSLENITHSLCTLEFDIRRPSYYWLLVALGLYQPYVWEYSRLNISHTMMSKRKLNRLVTEKWVDGWDDPRLLTLAGLRRRGVSATAINSFIRGIGITRSDNSLIRVDRLEYHIREELNKTASRTMVVLHPLKVVITNLEDGKVIDLDGKKWPDAPADEASSYYKVPFSKTVYIEKTDFRVKDSKDYYGLAPGKSALLRYAFPIKCTEVIYGDNPDDIVEIRAEYDPSKTSKPKGVLHWVAQPAPGVEPLKVEIRLFEKLFLSENPAELEDWLGDLNPHSKEVVKDAYAVPSLATAVLGDKFQFERLGYFAVDTDSTPEKLVFNRTVTLRDSYGKAGPK

SEQ ID NO: 16833 - protein, 796 aa, Zea mays
MGTGGDGSKAGPALPLEALLALGLDQRTAENALVNAKVTANLASVIAEAGIKECDKSVGNLLYAVATKYPTNALVHRPVLISYVLSTKIKNPAQLDAALSFLTNTGPDSLDVVKFEEACGVGVVVSIEEIKSTVTDVLEENMEAIKEQRYHINVGTLCGQVRKRHPWGDAKAIKEEIDKRLAEILGPKTEADNIKPVKKKKEKPAKVEEKKVAVATAAPPSEEELNPYTIFPQPEENFKVHTEIFFSDGNIWRAHNTKEILEKHLKATGGKVMTRFPPEPNGYLHIGHAKAMFIDFGLAKERNGHCYLRFDDTNPEAEKKEYIDHIQEIVHWMGWEPYKVTYTSDYFQALYEHAVELIQKGLAYVDHQTAEEIKEYREKKMDSPWRGRPIEESLKLFEDMRRGLIAEGAATLRMKQDMQNENKNMSDLIAYRIKFTPHPHAGDKWCVYPSYDYAHCMVDSLENITHSLCTLEFDIRRPSYYWLLVALGLYQPYVWEYSRLNISNTVMSKRKLNRLVTEKWVDGWDDPRLLTLAGLRRRGVSSTAINSFIRGIGITRSDNSLIRVDRLEYHIREELNKTAPRTMVVLRPLKVVITNLEEGKVLDLDGKMWPDASDTDASSHYKVPFSRTVYIEKTDFRLKDSKDYYGLAPGKSVMLRYAFPIKCTDVISGDSPDDIVEIRAEYDPLKTSKLKGVLHWIAEPAPGVEPLKVEVRLFEKLFMSENPAELEDWLGDLNPHSKEVIKDAYAVPSLATAVLGDKFQFERLGYFAVDTDSTPEKLVFNRTVTLRDSFGKAGPK

SEQ ID NO: 16834 - protein, 796 aa, Zea mays
MGTGGDGDKAGPALPLEALLALGLDQRTAENALVNAKVTANLAAVIAEAGIKECDKSIGNLLYAVATKYPTNALVHRPVLISYVLSTKIKSPAQLDAALSFLTNTGPDSLDVDKFEEACGVGVVVSIEEIKSTVTDILEENMEAIKEQRYHINVGMLCGQVRKRHPWGDAKAVKEEIDKRLAEILGPKTEADSIKPVKKKKEKTAKVEEKKVAVATTAPPSEEELNPYTIFPQPEENFKVHTEIFFSDGNIWRAHNTKEILEKHLKATGGKVMTRFPPEPNGYLHIGHAKAMFIDFGLAKERNGHCYLRFDDTNPEAEKKEYIDHIQEIVHWMGWEPYKVTYTSDYFQPLYEHAVELIRKGLAYVDHQTAEEIKEYREKKMNSPWRDRPIEESLNLFEDMRRGLIAEGAATLRMKQDMQNENKNMSDLIAYRIKFTPHPHAGDNWCIYPSYDYAHCMVDSLENITHSLCTLEFDIRRPSYYWLLVALGLYQPYVWEYSRLNISNTVMSKRKLNRLVTENWVDGWDDPRLLTLAGLRRRGVSSTAINSFIRGIGITRSDNSLIRVDRLEYHIREELNKTAPRTMVVLRPLKVVITNLEEGKVLDLDGKMWPDASDTDASSHYKLPFSRTVYIEKTDFRLKDSKDYYGLAPGKSVMLRYAFPIKCTDVIYGDTPDDIVEIRAEYDPLKTSKLKGVLHWVAEPAPGVEPLKVEVRLFEKLFMSENPAELEDWLGDLNPHSKEVIKDAYAVPSLATAVLGDKFQFERLGYFAVDTDSTPEKLVFNRTVTLRDSFGKAGPK

SEQ ID NO: 16835 - protein, 781 aa, Avena sativa
LETLLALGLDQRTAENALVNSKVTANLAAVIAEAGISGCDKSVGNLLYAVATKYPNNALVHRPALINYIVSTKIKSPAQLDAALSFLTNVGPEPLDIGKFEEACGVGVVVSIEEIHSTVAEVLKANMEAIMEQRYHINVGSLCGQVRKKHPWGDAKATKDEIEKRLAEMLGPKTEADNVKPVKKKKEKPAKVEEKKVAVATAAPPTEEELNPYTIFPQPAENNKVHTEIFFSDGNIWRAHNTKEILEKHLMATGGKVMTRFPPEPNGYLHIGHAKAMFIDFGLAKERNGHCYLRFDDTNPEAEKKEYIDHIQEIVQWMGWEPYKVTYTSDYFQALYEHAVELIRKGLAYVDHQTGEQIKECREKKMDSPWRNRPIEESLQLFEDMRRGMIAEGAATLRMKQDMQNDNKNMSDLIAYRIKFTPHPHAGDKWCIYPSYDYAHCMVDSFENITHSLCTLEFDIRRPSYYWLLVALGLYQPHVWEYSRLNISNTVMSKRKLNRLVTEKWVDGWDDPRLLTLAGLRRRGVSATAINSFIRGIGITRSDNSLIRVDRLEYHIREELNKTASRTMVVLHPLKVVITNLEDGKVIDLDGKKWPDAPADDASSYYKVPFSRTVYIEKTDFRLKDSKDYYGLAPGKSALLRYAFPIKCTEVVYGDNPDKIVEIRAEYDPSKTSKPKGVLHWVTEPAPGVEPLKVEIRLFEKLFLSENPAELEDWLGDLNPNSKEIVKGAYAVPSLATAVLGDKFQFERLGYFAVDTDSTPEKLVFNRTVTLRDSYGKAGPK

SEQ ID NO: 16836 - protein, 796 aa, Sorghum bicolor
MGTGGDGDKAGPALPLEALLALGLDQRTAENALVNSKVTANLAAVIAEAGIKECDKSVGNLLYAVATKYPTNALVHRPVLISYVLSTKIKNPAQLDAALSFLTNTGPDSLDVGKFEEACGVGVVVSIEEIKSTVTDILEENMEAIKEQRYHINVGMLCGLVRKRHPWGDAKAIKEEIDKRLVEILGPKTEADNIKPVKKKKEKPAKVEEKKVAVATAAPPTEEELNPYTIFPQPEENFKVHTEIFYSDGNIWRAHNTKEILEKHLKATGGKVMTRFPPEPNGYLHIGHAKAMFIDFGLAKERNGHCYLRFDDTNPEAEKKEYIDHIQEIVHWMGWEPYKVTYTSDYFQALYEHAVELIRKGLAYVDHQTAEEIKEYREKKMNSPWRDRPIEESLKLFEDMRRGLIAEGTATLRMKQDMQNENKNMSDLIAYRIKFTPHPHAGDKWCIYPSYDYAHCMVDSLENITHSLCTLEFDIRRPSYYWLLVALGLYQPYVWEYSRLNISNTVMSKRKLNRLVTEKWVDGWDDPRLLTLAGLRRRGVSSTAINSFIRGIGITRSDNSLIRVDRLEYHIREELNKTAPRTMAVLRPLKVVITNLEEGKVLDLDGKMWPDASDTDASSHYKVPFSRTVYIEKTDFRLKDSKDYYGLAPGKSVMLRYAFPIKCTDVIYGDSPDDVVEIRAEYDPLKTSKLKGVLHWVSEPAPGVEPLKVEVRLFEKLFMSENPAELEDWLGDLNPHSKEVIRDAYAVPSLASAVLGDKFQFERLGYFAVDTDSTPEKLVFNRTVTLRDSFGKAGPK

SEQ ID NO: 16837 - protein, 775 aa, Triticum aestivum
LGLDQRTAENALVNSKVTANLAAVVAEAGITGCDKSVGNLLYAVATKYPNNALVHRPALINYIVSTKIKNPAQLDAALSFLTNTGPESLDIGKFEEACGVGVVVSIEEIQSTVAEVLKENMEAILEQRYHINVGGLCGQVRKRHPWGDAKATKEEIEKKLAEILGPKTEADNVKPVKKKKEKPAKVEEKKVAVATAAPPSEEELNPYTIFPQPAENNKVHTEIFFSDGNIWRAHNTKEILEKHLKATGGKVMTRFPPEPNGYLHIGHAKAMFIDFGLAKERNGHCYLRFDDTNPEAEKKEYIDHIQEIVKWMGWEPYKVTYTSDYFQDLYEHAVELIRKGLAYVDHQTAEQIKEYREKKMDSPWRDRPIEESLQLFEDMRRGLIAEGAATLRMKQDMQNDNKNMSDLIAYRIKFTPHPHAGDKWCIYPSYDYAHCMVDSLENITHSLCTLEFDIRRPSYYWLLVALGLYQPYVWEYSRLNISHTMMSKRKLNRLVTEKWVDGWDDPRLLTLAGLRRRGVSATAINSFIRGIGITRSDNSLIRVDRLEYHIREELNKTASRTMVVLHPLKVVITNLEDGKVIDLDGKKWPDAPADEASSYYKVPFSKTVYIEKTDFRVKDSKDYYGLAPGKSALLRYAFPIKCTEVIYGDNPDDIVEIRAEYDPSKTSKPKGVLHWVAEPAPGVEPLKVEIRLFEKLFLSENPAELKDWLGDINPHSKEVVKGAYAVPSLATAVLGDKFQFERLGYFAVDTDSTPENLVLNRTVTLRDSYGKAGPK

SEQ ID NO: 16838 - protein, 794 aa, Pennisetum glaucum
MGTGGDGEKAALPLEALLALGLDQRTAENALVNSKVTANLAAVIAEAGIKECDKSVGNLLYAVATKYPTNALVHRPVLIKYVLSTKIKNPAQLDAALSFLTNTGPDSLDIEKFEEACGVGVVVSIEEIKSTVTDVLEENMNAIKEQRYHINVGTLCGQVRKRHPWGDAKAIKEEIDKRLAEILGPKTEADSIKPVKKKKEKPAKVEEKKVAVASSAPPSEEEMNPYTIFPQPEENFKVHTEIFFSNGNIWRAHNTKEILEKHLKATGGKVMTRFPPEPNGYLHIGHAKAMFIDFGLAKERNGHCYLRFDDTNPEAEKKEYIDHIQEIVRWMGWEPYKVTYTSDYFQALYDHAVELIRRGLAYVDHQTAEEIKEYREKKMNSPWRDRPIEESLKLFEDMRRGLIAEGAATLRMKQDMQNDNKNMSDLIAYRIKFTPHPHAGDKWCIYPSYDYAHCMVDSLENITHSLCTLEFDIRRPSYYWLLVALDLYQPYVWEYSRLNVSNTMMSKRKLNRLVTEKWVDGWDDPRLLTLAGLRRRGVSATAINSFIRGIGITRSDNSLIRVDRLEYHIREELNKTAPRTMVVLRPLKVVITNLEEGKVMNLDGKMWPDGSDTDASSHYKVPFSRTVYIEKTDFRLKDSKDYYGLAPGKSVMLRYAFPIKCTDVIYGNSPDDIVEIRAEYDPLKTSKLKGVLHWVAEPAPGVEPLKVEVRLFEKLFMSENPAELEDWLGDLNPHSKEVVKDAYAVPSLATAVLGDKFQFERLGYFAVDTDSMPEKLVFNRTVTLRDSFGKAGPK

SEQ ID NO: 16839 - protein, 136 aa, Cynodon dactylon
MVKFLKPGKAVILLQGRFAGRKAVIVRVFEEGTRDRPYGHCLVAGLAKYPKKVIRKDSAKKTAKKSRVKCFMKLVNFTHLMPTRYTLDVDLKDVAAGPDALSTRDKKVAACKAAKARLEERFKTGKNRWFFTKLRF

SEQ ID NO: 16840 - protein, 137 aa, Leymus cinereus x Leymus triticoides
MVKFLKPGKAVILLQGRFAGRKAVIVRVFEEGTRDRPYGHCLVAGLAKYPKKVIRKDSAKKTAKKSRVKCFLKLVNFTHLMPTRYTLDVDFKDVASGGPDALATRDKKVASCKAAKARLEERFKTGKNRWFFTKLRF

SEQ ID NO: 16841 - protein, 137 aa, Oryza sativa
MVKFLKPGKAVILLQGRYAGRKAVIVRVFEEGTRDRPYGHCLVAGLAKYPKKVIRKDSAKKTAKKSRVKCFLKLVNFTHIMPTRYTLDVDFKDVASGGPDALATRDKKVAACKAAKARLEERFKTGKNRWFFTKLRF

SEQ ID NO: 16842 - protein, 137 aa, Brachypodium distachyon
MVKFLKPGKAVILLQGRYAGRKAVIVRVFEEGTRDRPYGHCLVAGLAKYPKKVIRKDSAKKTAKKSRVKCFLKLVNFTHLMPTRYTLDVDLKDVASGGPDALASSDKKVAAAKSAKARLEERFKTGKNRWFFTKLRF

SEQ ID NO: 16843 - protein, 137 aa, Echinochloa colona
  Sequence also found in Organisms: Panicum virgatum
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGGPDALSTRDKKVAACKAAKARLEERFKTGKNRWFFTKLRF

SEQ ID NO: 16844 - protein, 137 aa, Secale cereale
  Sequence also found in Organisms: Triticum aestivum
MVKFLKPGKAVILLQGRFAGRKAVIVRVFEEGTRDRPYGHCLVAGLAKYPKKVIRKDSAKKTAKKSRVKCFLKLVNFTHIMPTRYTLDVDFKDVASGGPDALATRDKKVASCKAAKARLEERFKTGKNRWFFTKLRF

SEQ ID NO: 16845 - protein, 137 aa, Sorghum bicolor
  Sequence also found in Organisms: Saccharum officinarum
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVATGGPDALSTRDKKVAACKTAKARLEERFKTGKNRWFFTKLRF

SEQ ID NO: 16846 - protein, 137 aa, Pennisetum glaucum
  Sequence also found in Organisms: Cenchrus ciliaris, Echinochloa colona, Setaria italica, Panicum virgatum
MVKFLKPGKAVILLQGRFAGRKAVIVRVFEEGTRDRPYGHCLVAGLAKYPKKVIRKDSAKKTAKKSRVKCFIKLVNFTHIMPTRYTLDVDFKDVASGGPDALSTRDKKVAACKAAKARLEERFKTGKNRWFFTKLRF

SEQ ID NO: 16847 - protein, 137 aa, Zea mays
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVATGGPDALSTHDKKVAACKTAKARLEERFKTGKNRWFFTKLRF

SEQ ID NO: 16848 - protein, 137 aa, Zea mays
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGGPDALSTRDKKVEACKAAKARLEERFKTGKNRWFFTKLRF

SEQ ID NO: 16849 - protein, 137 aa, Avena sativa
MVKFLKPGKAVILLQGRFAGKKAVIVRVFEEGTRDRPYGHCLVAGLAKYPKKVIRKDSAKKTAKKSRVKCFLKLVNFTHLMPTRYTLDVDLKDVATGGPDALATKDKKIASAKSAKARLEERFKTGKNRWFFTKLRF

SEQ ID NO: 16850 - protein, 137 aa, Cenchrus ciliaris
MVKFLKPGKAVILLQGRFAGRKAVIVRVFEEGTRDRPYGHCLVAGLARYPKKVIRKDSAKKTAKKSRVKCFIKLVNFTHIMPTRYTLDVDFKDVASGGPDALSTRDKKVAACKAAKARLEERFKTGKNRWFFTKLRF

SEQ ID NO: 16851 - protein, 137 aa, Zea mays
MVKFLKPGKAVILLQGRFAGRKAVIVRVFEEGTRDRPYGHCLVAGLAKYPKKVVRRDSAKKTAKKSRVKCFIKLVNFTHLMPTRYTLDVDFKDVATGGPDALSTRDKKVAACKAAKARLEERFKTGKNRWFFTKLRF

SEQ ID NO: 16852 - protein, 137 aa, Sorghum bicolor
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDLKDVASGGPDALSTRDKKVEACKTAKYRLEERFKSGKNRWFFTKLRF

SEQ ID NO: 16853 - protein, 137 aa, Cenchrus ciliaris
MVKFLKPGKAVLLLQGRFAGRKAVIVRVFEEGTRDRPYGHCLVAGLAKYPKKVIRKDSAKKTAKKSRVKCFIKLVNFTHIMPTRYTLDVDFKDVASGGPDALSTRDKKVAACKAVKARLEERFKTGKNRWFFTKLRF

SEQ ID NO: 16854 - protein, 137 aa, Avena sativa
MVKFLKPGKAVILLQGRFAGKKAVIVRVFEEGTRDRPYGHCLVAGLAKYPKKVIRKDSAKKTAKKSRVKCFLKLVNFTHLMPTRYTLDVDLKDVATGGPDALAIKDKKIESAKSAKARLEERFKTGKNRWFFTKLRF

SEQ ID NO: 16855 - protein, 137 aa, Saccharum officinarum
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGGPDALSTRDKKVEACKTAKYRLEERFKSGKNRWFFTKLRF

SEQ ID NO: 16856 - protein, 137 aa, Panicum virgatum
MVKFLKPGKAVIVLQGRFAGRKAVIVRVFEEGTRDRPYGHCLVAGLAKYPKKVIRKDSAKKTAKKSRVKCFIKLVNFTHIMPTRYTLDVDFKDVASGGPDALSTRDKKVAACKAAKYRLEERFKTGKNRWFFTKLRF

SEQ ID NO: 16857 - protein, 137 aa, Avena sativa
MVKFLKPGKAVILLQGRFAGKKAVIVRVFEEGTRDRPYGHCLVAGLAKYPKKVIRKDSAKKTAKKSRVKCFLKLVNFTHLMPTRYTLDVDFKDVSVAGPDALASTDKKVGFAKTAKARLEERFKTGKNRWFFTKLRF

SEQ ID NO: 16858 - protein, 137 aa, Avena sativa
MVKFLKPGKAVILLQGRFAGKKAVIVRVFEEGTRDRPYGHCLVAGLAKYPKKVIRKDSAKKTAKKSRVKCFLKLVNFTHLMPTRYTLDVDFKDVSVAGPDALASSDKKVGLAKAAKARLEERFKTGKNRWFFTKLRF

SEQ ID NO: 16859 - protein, 137 aa, Hordeum vulgare
MVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTTKDKKLTAAKSAKAKLEERFKTGKNRWFFTKLRF

SEQ ID NO: 16860 - protein, 137 aa, Festuca arundinacea
MVKFLKPGKAVILLQGRFAGKKAVIVRVFEEGTRDRPYGHCLVAGLAKYPKKVIRKDSAKKTAKKSRVKCFLKLVNFTHLMPTRYTLDVDLKDVASGGPEALATKDKKIESAKAAKERLEERFKTGKNRWFFTKLRF

SEQ ID NO: 16861 - protein, 134 aa, Lolium multiflorum
MVKFLKPGKAVILLQGRFAGKKAVIVRVFEEGTRDRPYGHCLVAGLAKYPKKVIRKDSAKKTAKKSRVKCFLKLVNFTHLMPTRYTLDVDLKDVASGGPDALATKDKKVESAKAAKARLEERFKTGKNRWFFTK

SEQ ID NO: 16862 - protein, 137 aa, Pennisetum glaucum
MVKFLKPGKAVLLLQGRFAGCKAVIVRVFEEGTRDRPYGHCLVAGLAKYPKKVIRKDSAKKTAKKSRVKCFIKLVNFSHIMPTRYTLDVDFKDVASSCPDALSTRDKKVAACKAAKARLEERFKTGKNRWFFTKLRF

SEQ ID NO: 16863 - protein, 137 aa, Avena sativa
MVKFLKPGKAVILLQGRFAGKKAVIVRVFEEGTRDRPYGHCLVAGLAKYPKKVIRKDSAKKTAKKSRVKCFLKLVNFTHLMPTRYTLDVDFKDVSVAGPDALSSTDKKVGFAKTAKARLEERFKTGKNRWFFTKLRF

SEQ ID NO: 16864 - protein, 137 aa, Secale cereale
MVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTTKDKKITAAKSAKAKLEERFKTGKNRWFFTKLRF

SEQ ID NO: 16865 - protein, 137 aa, Pseudoroegneria spicata
MVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTPKDKKISAAKSAKAKLEERFKTGKNRWFFTKLRF

SEQ ID NO: 16866 - protein, 137 aa, Triticum aestivum
MVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTSKDKKVGAAKAAKAKLEERFKTGKNRWFFTKLRF

SEQ ID NO: 16867 - protein, 135 aa, Avena sativa
MVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTSKDKKVGAAKAAKAKLEERFKTGKNRWFFTKL

SEQ ID NO: 16868 - protein, 136 aa, Hordeum vulgare
MVMFLKPAKAMILLPGRYAGKKAVIVRVFEEGTRDRPYGHCLVAGLAKYPKKVIRKDSAKKTAKKSRVKVFLKLVNFTHLMPTRYTLDVDLKEVASGAPDSLTTKDKKLTAAKSAKAKLEERFKTGKNRWFFTKLR

SEQ ID NO: 16869 - protein, 137 aa, Secale cereale
MVKFLKPGKAVILLQGRFAGRKAVIVRVFEEGTRDRPYGHCLVAGLAKYPKKVIRKDSAKKTAKKSRVKCFLKLVNFTHIMPTRYTLDVDFKDVASGGPDALATRDKKVASCKAAKARLGGEVQDRQEQVFFTKLRF

SEQ ID NO: 16870 - protein, 135 aa, Secale cereale
MVKFLKPGKAVILLQGRFAGRKAVIVRVFEEGTRDRPYGHCLVAGLAKYPKKVIRKDSAKKTAKKSRVKCFLKLVNFTHIMPTRYTLDVDFKDVASGGPDALATRDKKVASCKAAKARLEERVKPARQVSHQLRF

SEQ ID NO: 16871 - protein, 135 aa, Ananas comosus
MVKFLKPGKAVIVLTGRFAGRKAVIVRVFEEGTRDRPYGHCLVAGVAKYPKKVIRKDSAKKTAKKSRVKAFLKVVNFSHLMPTRYTLDVDLKDVVTLDSLQSRDKKVSACKEAKARFEERFKTGKNRWFFTKLRF

SEQ ID NO: 16872 - protein, 130 aa, Cenchrus ciliaris
GKAVLLLQGRFAGCKAVIVRVFEEGTRDRPYGHCLVAGLAKYPKKVIRKDSAKKTAKKSRVKCFIKLVNFTHIMPTRYTLDVDFKDVASSCPDALSTRDKKVAACKAAKARLEERFKTGKNRWFFTKLRF

SEQ ID NO: 16873 - protein, 135 aa, Musa acuminata
MVKFLKPNKAVIVLQGRFAGRKAVIVRAFDDGTRERPYGHCLVAGIAKYPKKVIRKDSAKKTAKKSRVKAFLKLVNYSHIMPTRYTLDVDLKDVATLDALQSRDKKVTACKETKARLEERFKTGKNRWFFTKLRF

SEQ ID NO: 16874 - protein, 135 aa, Elaeis guineensis
MVKFLKPGKAVIVLQGRFAGRKAVIVRCFDEGTRDRPYGHCLVAGILKYPKKVIRKDSAKKTAKKSRVKAFLKMVNYSHIMPTRYTLDVDLKDVVTLDVLQSRDKKVAACKETKARFEERFKTGKNRWFFTKLRF

SEQ ID NO: 16875 - protein, 135 aa, Elaeis guineensis
MVKFLKPGKAVIILQGRFAGRKAVIVRCFDEGTRDRPYGHCLVAGILKYPKKVIRKDSAKKTAKKSRVKAFLKVVNYSHIMPTRYTLDVDLKDAVTLDALQSRDKKVVACKETKARFEERFKTGKNRWFFTKLRF

SEQ ID NO: 16876 - protein, 135 aa, Sarracenia psittacina
MVKFLKPNKAVIVLQGRFAGRKAVIVRSFDDGTRDRPYGHCLVAGIAKYPKKVIRKDSAKKTAKKSRVKAFVKLVNYNHIMPTRYTLDVDLKEVVTLDALQSRDKKVAAAKGAKARFEERFKTGKNRWFFSKLRF

SEQ ID NO: 16877 - protein, 135 aa, Musa acuminata
MVKFLKPNKAVIILQGRFAGRKAVIVRAFDDGTRERPYGHCLVAGVAKYPKKVIRKDSAKKTAKKSRVKAFLKLVNYSHIMPTRYTLDVDLKDVVTADSLQSRDKKVTACKETKARLEERFKTGKNRWFFTKLRF

SEQ ID NO: 16878 - protein, 135 aa, Cocos nucifera
MVRFLKPGKAVIILQGRFAGRKAVIVRCFDEGIRDRPYGHCLVAGILKYPKKVIRKDSAKKTAKKSRVKAFLKVVNYSHIMPTRYTLDVDLKDAVTLDALQSRDKKVAACKDTKARFEERFKTGKNRWFFTKLRF

SEQ ID NO: 16879 - protein, 135 aa, Cocos nucifera
MVKFLKPGKAVIVLQGRFAGRKAVIIRCFDEGTRDRPYGHCLVAGILKYPKKVIRKDSAKKTAKKSRVKAFLKVVNYSHIMPTRYTLDVDLKDVVTLDVLQSRDKKVAACKETKARFEERFKTGKNRWFFTKLRF

SEQ ID NO: 16880 - protein, 135 aa, Platanus occidentalis
MVKFLKPNKAVVVLQGRYAGRKAVIVRSFDEGTRDRPYGHCLVAGVAKYPKKVIRKDSAKKTAKKSRVKAFIKLVNYNHIMPTRYTLDVDLKDVVTLDALQSRDKKVTAAKETKARLEDRFKTGKNRWFFTKLRF

SEQ ID NO: 16881 - protein, 135 aa, Prunus mume
MVKFLKANKAVVLLQGRYAGRKAVIVKSFEEGTRDRPYGHCLVAGIAKYPSKVIRKDSAKKTAKKSRVKAFVKLVNYQHMMPTRYNLDVDLKEVLTVDALQTRDKKVAAKKEIKARLEDRFKSGKNRWFFTKLRF

SEQ ID NO: 16882 - protein, 135 aa, Prunus persica
MVKFLKANKAVVLLQGRYAGRKAVIVKSFEEGTRDRPYGHCLVAGIAKYPSKVIRKDSAKKTAKKSRVKAFVKLVNYQHVMPTRYNLDVDLKEVLTVDALQTRDKKVAAKKEIKARLEDRFKSGKNRWFFTKLRF

SEQ ID NO: 16883 - protein, 126 aa, Hordeum vulgare
ILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTTKDKKLTAAKSAKAKLEERFKTGKNRWFFTKLRF

SEQ ID NO: 16884 - protein, 121 aa, Cenchrus ciliaris
RFAGRKAVIVRVFEEGTRDRPYGHCLVAGLAKYPKKVIRKDSAKKTAKKSRVKCFIKLVNFTHIMPTRYTLDVDFKDVASGGPDALSTRDKKVAACKAAKARLEDRFKTGKNRWFFTKLRF

SEQ ID NO: 16885 - protein, 136 aa, Amorphophallus konjac
MVKFLKPNKAVIILQGRFAGRKAVIVKNFDDGTRERPYGHCLVAGISKYPKKVIRKDSAKKTAKKSRVKAFVKVVNYNHIMPTRYTLDVDLKEVVAAPDALQARDKKVTACKEIKARFEERFKTGKNRWFFTKLRF

SEQ ID NO: 16886 - protein, 135 aa, Musa acuminata
MVKFLKPNKAVIVLQGRFAGRKAVIVRAFDDGTRERPYGHCLVAGIAKYPKKVIRKDSAKKTAKKSRVKAFLKLVNYSHIMPTRYTLDVDLKDVVTLDSLQSRDKKVTASKETKARLEERFKTGKNRWFFTKLRF

SEQ ID NO: 16887 - protein, 135 aa, Musa acuminata
MVKFLKPNKAVIILQGRFAGRKAVIVRAFDDGTRERPYGHCLVAGIAKYPKKVIRKDSAKKTAKKSRVKSFLKLVNYSHIMPTRYTLDVDLKDVVTIDSLQSRDKKVSACKETKSRLEERFKTGKNRWFFTKLRF

SEQ ID NO: 16888 - protein, 135 aa, Fagus grandifolia
MVKFLKPNKAVILLQGRYAGRKAVIVRAFDEGTRDRPYGHCLVAGISKYPSKVIRKDSAKKTAKKSRVKAFVKLVNFQHLMPTRYTLDVDLKDAVSVDCLQSKDKKVTAAKETKKRLEDRFKTGKNRWFFTKLRF

SEQ ID NO: 16889 - protein, 135 aa, Castanea mollissima
  Sequence also found in Organisms: Quercus alba
MVKFLKPNKAVILLQGRYAGRKAVIVRSFDEGTRDRPYGHCLVAGIKKYPSKVIRKDSAKKTAKKSRVKAFVKLVNFQHLMPTRYTLDVDLKDVVAVDSLQSKDKKVTAAKETKKRLEERFKTGKNRWFFTKLRF

SEQ ID NO: 16890 - protein, 135 aa, Castanea mollissima
MVKFLKPNKAVILLQGRYAGRKAVIVRSFDEGTRDRPYGHCLVAGIKKYPSKVIRKDSAKKTAKKSRVKAFIKLVNFQHLMPTRYTLDVDLKDVVAVDSLQSKDKKVTAAKETKKRLEERFKTGKNRWFFTKLRF

SEQ ID NO: 16891 - protein, 135 aa, Gossypium hirsutum
  Sequence also found in Organisms: Gossypium raimondii
MVKFLKPNKAVIVLQGRYAGRKAVIVRSFDEGTRDRPYGHCLVAGTKKYPSKVIRKDSAKKTAKKSRVKCFVKLVNYQHLMPTRYTLDVDLKDVVTADALQTKDKKVAACKATKERFQERFKTGKNRWFFTKLRF

SEQ ID NO: 16892 - protein, 135 aa, Phalaenopsis aphrodite
MVKFLKPGKAVIVLNGRFAGRKAVIVRSFDDGTRDRPYGHCLVAGIAKYPRKVIRKDSAKKTAKKSRVKAFLKLVNYTHIMPTRYTLDVDLKDVVTVDALQSRDKKVTACKETKTRFEERFKSGKNRWFFTKLRF

SEQ ID NO: 16893 - protein, 135 aa, Phalaenopsis aphrodite
MVKFLKPGKAVIILNGRFAGRKAVIIRSFDDGTRDRPYGHCLVAGIAKYPRKVIRKDSAKKTAKKSRVKAFLKVVNYTHIMPTRYTLDVDLKEIVTLDALQSRDKKVTACKETKARFEERFKTGKNRWFFTKLRF

SEQ ID NO: 16894 - protein, 135 aa, Fragaria vesca
MVKFLKPNKAVLLLQGRFAGRKAVIVKAFDEGTRDRPYGHCLVAGIAKYPSKVIRKDSAKKTAKKSRVKAFIKLVNYQHVMPTRYSLDVDLKEVATVDALQSRDKKVTAAKEIKAKLEDRFKSGKNRWFFTKLRF

SEQ ID NO: 16895 - protein, 135 aa, Cocos nucifera
MVRFLKPGKAVIILQGRFAGRKAVIVRTFDEGTRDRPYGHCLVAGILKYPKKVIRKDSAKKTAKKSRVKAFLKVVNYSHIMPTRYTLDVDLKDVVPLDVLQSRDKKVAACKETKARFEERFKTGKNRWFFSKHRF

SEQ ID NO: 16896 - protein, 135 aa, Amorphophallus konjac
MVKFLKPNKAVIVLQGRFAGRKAVIVKNFDEGTRDRPYGHCLVAGIYKYPKKVIRKDSAKKTAKKSRVKAFVKLVNYNHIMPTRYTLDVDLKDVVTVDVLQTKDKKVVACKETKARFEERFKTGKNRWFFTKLRF

SEQ ID NO: 16897 - protein, 135 aa, Arabidopsis lyrata
MVKFLKQNKAVILLQGRYAGKKAVIIKSFDDGTRDRAYGHCLVAGLKKYPSKVIRKDSAKKTAKKSRVKCFIKLVNYQHLMPTRYTLDVDLKEVATLDALQSKDKKVAALKEAKAKLEERFKTGKNRWFFTKLRF

SEQ ID NO: 16898 - protein, 135 aa, Arabidopsis thaliana
MVKFLKQNKAVILLQGRYAGKKAVIIKSFDDGNRDRPYGHCLVAGLKKYPSKVIRKDSAKKTAKKSRVKCFIKLVNYQHLMPTRYTLDVDLKEVATLDALQSKDKKVAALKEAKAKLEERFKTGKNRWFFTKLRF

SEQ ID NO: 16899 - protein, 135 aa, Fagus grandifolia
MVKFLKPNKAVVLLQGRFAGHKAVIVRSFDDGNRDRPYGHCLVAGLAKYPKKVIRKDSAKKTAKKSRVKAFVKLVNYTHLMPTRYSLDVDLKDVVTVDALQSRDKKVTASKETKARFEDRFKSGKNRWFFSKLRF

SEQ ID NO: 16900 - protein, 135 aa, Vaccinium corymbosum
MVKFLKPNKAVIVLQGRFAGRKAVIVKSFDEGTRDRPYGHCLVAGVAKYPKKVIRKDSAKKTAKKSRVKAFIKLVNYNHIMPTRYTLDVDLKDVVTVDALQSRDKKVTAAKEAKGRFEERFKTGKNRWFFSKLRF

SEQ ID NO: 16901 - protein, 135 aa, Ricinus communis
MVKFLKPNKAVILLQGRYAGRKAVIVRSFDDGTRDRPYGHCLVAGISKYPAKVIKKDSAKKTAKKSRVKAFMKVVNYSHLMPTRYTLDVDLKDVATPDALVTKDKKVTAAKEIKKRLEDRFKTGKNRWFFSKLRF

SEQ ID NO: 16902 - protein, 135 aa, Castanea mollissima
MVKFLKPNKAVILLQGRYAGRKAVIVRSFDEGTRDRPYGHCLVAGIKKYPSKVIRKDSAKKTAKKSRVKAFVKFVNFQHLMPTRYTLDVDLKDVVAVDSLQSKDKKVTAAKETKKRLEERFKTGKNRWFFTKLRF

SEQ ID NO: 16903 - protein, 135 aa, Cichorium intybus
MVKFLKPNKAVVVLNGRFAGRKAVIVRQFDDGTRDRPYGHCLVAGIAKYPKKVIRKDSAKKTAKKSRVKAFIKLVNYNHIMPTRYTLDVDLKDVVTVDALQSRDKKVTACKETKARLEERFKTGKNRWFFSKLRF

SEQ ID NO: 16904 - protein, 135 aa, Cichorium intybus
MVKFLKPNKAVVVLNGRFAGRKAVIVRQFDDGTRDRPYGHCLVAGIAKYPKKVIRKDSAKKTAKKSRVKAFIKLVNYNHIMPTRYTLDVDLKDVVTVDALQSHDKKVTACKETKARLEDRFKTGKNRWFFSKLRF

SEQ ID NO: 16905 - protein, 135 aa, Gossypium hirsutum
  Sequence also found in Organisms: Gossypium raimondii
MVKFLKPNKAVIVLQGRYAGRKAVIVRSFDDGTRDRAYGHCLVAGIKKYPSKVIRKDSAKKTAKKSRVKCFIKLVNYQHLMPTRYTLDVDLKDVVTVDALQTKDKKVAACKATKERFEERFKTGKNRWFFTKLRF

SEQ ID NO: 16906 - protein, 135 aa, Gossypium hirsutum
  Sequence also found in Organisms: Gossypium raimondii
MVKFLKSNKAVIVLQGRYAGRKAVIVRSFDDGTRDRPYGHCLVAGIKKYPSKVIRKDSAKKTAKKSRVKCFVKLVNYQHLMPTRYTLDVDLKDVVTVDALQTKDKKVAACKATKERFEERFKTGKNRWFFTKLRF

SEQ ID NO: 16907 - protein, 135 aa, Curcuma longa
MVKFLKPNKAVIILQGRFAGRKAVIVRAFDDGTRERPYGHCLVAGIAKYPKKVIRKDSAKKTAKKSRVKPFLKLVNYNHIMPTRYTLDVDLKDTVTLDALQSRDKKVSASKETKARFEERFKTGKNRWFFTKLRF

SEQ ID NO: 16908 - protein, 135 aa, Taraxacum officinale
MVKFLKPNKAVVVLNGRFAGRKAVIVKQFDDGTRDRPYGHCLVAGIAKYPKKVIRKDSAKKTAKKSRVKAFIKLVNYNHIMPTRYTLDVDLKDVVSVDALQSRDKKVTACKEAKARLEERFKTGKNRWFFSKLRF

SEQ ID NO: 16909 - protein, 135 aa, Vitis vinifera
MVKFLKQNKAVVVLQGRFAGRKAVIVRSFDDGTRDRPYGHCLVAGIAKYPKKVIRKDSAKKTAKKSRVKAFIKLVNYNHLMPTRYTLDVDLKDVVTVDALQSRDKKVTAAKETKARFEERFKTGKNRWFFTKLRF

SEQ ID NO: 16910 - protein, 135 aa, Actinidia deliciosa
MVKFLKQNKAVIVLQGRFAGRKAVIVRSFDDGTRDRPYGHCLVAGIAKYPKKVIRKDSAKKTAKKSRVKAFIKLVNYNHIMPTRYTLDVDLKDIVTVDALQSRDKKVTAAKEAKARLEERFKTGKNRWFFSKLRF

SEQ ID NO: 16911 - protein, 135 aa, Actinidia deliciosa
MVKFLKPNKAVIILQGRFAGRKAVIVRSFDDGTRDRAYGHCLVAGIAKYPKKVIRKDSAKKTAKKSRVKAFIKLVNYNHIMPTRYTLDVDLKDIVTVDALQSRDKKVTAAKEAKARLEERFKTGKNRWFFSKLRF

SEQ ID NO: 16912 - protein, 135 aa, Quercus alba
MVKFLKPNKAVILLQGRYAGRKAVIVRSFDEGTRDRPYGHCLVAGIKKYPSKVIRKDSAKKTAKKSRVKAFIKLVNFQHLMPTRYTLDVDLKDVVAVDSLQSKDKKVTAAKETKKKLEERFKTGKNRWFFTKLRF

SEQ ID NO: 16913 - protein, 135 aa, Quercus alba
MVKFLKPNKAVILLQGRYAGRKAVIVRSFDEGTRDRPYGHCLVAGIKKYPSKVIRKDSAKKTAKKSRVKAFIKLVNFQHLMPTRYTLDVDLKDVVAVDSLQSKDKKVIAAKETKKKLEERFKTGKNRWFFTKLRF

SEQ ID NO: 16914 - protein, 135 aa, Quercus alba
MVKFLKPNKAVILLQGRYAGRKAVIVRSFDEGTRDRPYGHCLVAGIKKYPSKVIRKDSAKKTAKKSRVKAFIKLVNFQHLMPTRYTLDVDLKDVVAVDSLQSKDKKVNAAKETKKKLEERFKTGKNRWFFTKLRF

SEQ ID NO: 16915 - protein, 135 aa, Petroselinum crispum
MVKFLKPNKAVIVLNGRFAGRKAVIIRAFDEGTRDRPYGHCLVAGISKYPKKVIRKDSAKKTAKKSRVKAFIKTVNYNHIMPTRYTLDVDLKDVVTPDCLQSRDKKVTAAKEAKARLEERFKTGKNRWFFTKLRF

SEQ ID NO: 16916 - protein, 135 aa, Capsicum annuum
MVKFLKPNKAVVLLQGRHAGRKAVIVRAFDDGTRDRPYGHCLVAGVAKYPKKVIRKDSAKKQAKKSRVKTFIKLVNYTHIMPTRYTLDVDLKETVTVDCLQTRDKKVTAAKEAKAKFEERFKTGKNRWFFTKLRF

SEQ ID NO: 16917 - protein, 134 aa, Platanus occidentalis
VKFLKPNKAVIILQGKFAGRKAVIIRSFDEGTRDRPYGHCLVAGIAKYPKKVIRKDSAKKTAKKSRVKAFIKLVNYNHIMPTRYTLDVDLKDVVTLDALQSRDKKVTAAKETKARLEERFKTGKNRWFFTKLRF

SEQ ID NO: 16918 - protein, 135 aa, Eutrema halophilum
  Sequence also found in Organisms: Eutrema parvulum
MVKFLKQNKAVILLQGRYAGKKAVIIRSFDDGNRERPYGHCLVAGLKKYPSKVIRKDSAKKTAKKSRVKCFIKLVNYQHLMPTRYTLDVDLKEVATLDALQSKDKKVAALKEAKAKLEERFKTGKNRWFFTKLRF

SEQ ID NO: 16919 - protein, 127 aa, Hordeum vulgare
MVKFLKPGKAVILLQGRYAGKKAVIVSVFEEGTRDRPYEHCLVAGLAKYQKKVIRKDSAKKTAKKSRVKVFLKLVNFTHLMPTRYTLDVDLKEVASGAPDSLTTKDKKLTAAKSAKAKLEERFKTGK

SEQ ID NO: 16920 - protein, 135 aa, Glycine max
MVKFLKPNKAVIVLQGRYAGRKAVIVRTFDEGTRERPYGHCLVAGIKKYPSKVIKKDSAKKTAKKSRVKAFVKLVNYQHLMPTRYTLDVDLKDAVTPDVLATKDKKVTALKETKKRLEERFKTGKNRWFFTKLRF

SEQ ID NO: 16921 - protein, 135 aa, Amborella trichopoda
MVKFLKPNKAVILLQGRFAGRKAVIIRAFDEGTRDRPYGHCLVAGIAKYPKKVIRKDSAKKTAKKSRVKVFVKLVNYNHIMPTRYTLDVDLKDIITLEALQSHDKKVTVAKDAKARFEERFKTGKNRWFFTKLRF

SEQ ID NO: 16922 - protein, 135 aa, Brassica napus
  Sequence also found in Organisms: Brassica juncea, Brassica oleracea, Brassica rapa
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALASKDKKVAALKEAKAKLEERFKTGKNRWFFTKLRF

SEQ ID NO: 16923 - protein, 135 aa, Brassica napus
  Sequence also found in Organisms: Brassica oleracea
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATVEALASKDKKVAALKEAKAKLEERFKTGKNRWFFTKLRF

SEQ ID NO: 16924 - protein, 135 aa, Fagus grandifolia
MVKFLKPNKAVILLQGRYAGRKAVIVRAFDDGTRDRPYGHCLVAGISKYPSKVIRKDSAKKTAKKSRVKAFVKLVNFQHLMPTRYTLDVDLKDVVSVDSLQSKDKKVTAAKEIKKKLEDRFKTGKNRWFFTKLRF

SEQ ID NO: 16925 - protein, 135 aa, Daucus carota
MVKFLKPNKAVIVLNGRFAGRKAVIIRAFDEGTRDRPYGHCLVAGISKYPKKVIRKDSAKKTAKKSRVKAFIKLVNYNHIMPTRYTLDVDLKDVVTPDCLQSRDKKVTAAKATKAKLEERFKTGKNRWFFTKLRF

SEQ ID NO: 16926 - protein, 135 aa, Centaurea maculosa
  Sequence also found in Organisms: Cichorium intybus, Lactuca sativa, Senecio madagascariensis, Tragopogon dubius
MVKFLKPNKAVVVLNGRFAGRKAVIVKQFDDGTRDRPYGHCLVAGIAKYPKKVIRKDSAKKTAKKSRVKAFIKLVNYNHIMPTRYTLDVDLKDVVSVDALQSRDKKVTACKETKARLEERFKTGKNRWFFSKLRF

SEQ ID NO: 16927 - protein, 135 aa, Cichorium intybus
MVKFLKPNKAVVVLNGRFAGRKAVIVRQFDDGTRDRLYGHCLVAGIAKYPKKVIRKDSAKKTAKKSRVKAFIKLVNYNHIMPTRYTLDVDLKDVVTVDALQSRDKKVTACKETKARLEERFKTGKNRWFFSKLRF

SEQ ID NO: 16928 - protein, 135 aa, Cichorium intybus
  Sequence also found in Organisms: Cynara scolymus, Lactuca sativa
MVKFLKPNKAVVVLNGRFAGRKAVIVRQFDDGTRDRPYGHCLVAGIAKYPKKVIRKDSAKKTAKKSRVKAFIKLVNYNHIMPTRYTLDVDLKDVVTVDALQSHDKKVTACKETKARLEERFKTGKNRWFFSKLRF

SEQ ID NO: 16929 - protein, 135 aa, Flaveria ramosissima
MVKFLKPNKAVVVLNGRFAGRKAVIVRQFDDGTRDRPYGHCLVAGISKYPKKVIRKDSAKKTAKKSRVKAFIKLVNYNHIMPTRYTLDVDLKDVVTLDALQSRDKKVTACKETKARLEERFKTGKNRWFFSKLRF

SEQ ID NO: 16930 - protein, 135 aa, Zingiber officinale
MVKFLKPNKAVIILQGRFAGRKAVIVRAFDDGTRERPYGHCLVAGIAKYPKNVIRKDSAKKTAKKSRVKPFLKLVNYNHIMPTRYTLDVDLKDIVSLDALQSRDKKVSASKETKARFEERFKTGKNRWFFTKLRF

SEQ ID NO: 16931 - protein, 135 aa, Vitis vinifera
MVKFLKPNKAVVLLQGRFAGRKAVIVRSFDDGTRDRPYGHCLVAGIAKYPKKVIRKDSAKKTAKKSRVKAFIKLVNYNHIMPTRYTLDVDLKDVVSPDVLQSRDKKVTAAKETKKKLEERFKTGKNRWFFSKLRF

SEQ ID NO: 16932 - protein, 135 aa, Ipomoea batatas
MVKFLKPNKAVILLQGRYAGRKAVIVRAFDEGTRDRPYGHCLVAGVSKYPKKVIRKDSAKKQAKKSRVKVFVKLVNYNHIMPTRYTLDVDLKDVVSGDCLQSRDKRVTAAKETKARFEERFKTGKNRWFFTKLRF

SEQ ID NO: 16933 - protein, 135 aa, Actinidia deliciosa
MVKFLKPNKAVIILQGRFAGRKAVIIRSFDDGTRDRAYGHCLVAGIAKYPKKVIRKDSAKKTAKKSRVKAFIKLVNYNHIMPTRYTLDVDLKDIVTVDALQSRDKKVTAAKEAKARLEERFKTGKNRWFFSKLRF

SEQ ID NO: 16934 - protein, 135 aa, Lactuca sativa
MVKFLKPNKAVVVLNGRFAGRKAVIVRQFDDGTRDRPYGHCLVAGIAKYPKKVIRKDSAKKTAKKSRVKAFIKLVNYNHIMPTRYTLDVDLKDIVTVDALQSRDKKVTACKETKARLEERFKTGKNRWFFSKLRF

SEQ ID NO: 16935 - protein, 135 aa, Petroselinum crispum
MVKFLKPNKAVIVLNGRFAGRKAVIIRAFDEGTRDRPYGHCLVAGISKYPKKVIRKDSAKKTAKKSRVKAFIKLVNYNHIMPTRYTLDVDLKDVVTSDCLASRDKKVTAAKATKAKLEERFKTGKNRWFFTKLRF

SEQ ID NO: 16936 - protein, 135 aa, Platanus occidentalis
MVKFLKPNKAVIVLQGRYAGRKAVIVRSFDEGTRDRPYGHCLVAGISKYPKKVIRKDSAKKTAKKSRVKAFIKLVNYNHIMPTRYTLDVDLKDVVTLDTLQSKDKKVTAAKETKARLEERFKTGKNRWFFTKLRF

SEQ ID NO: 16937 - protein, 135 aa, Papaver somniferum
MVKFLKPNKAVVVLQGRFAGRKAVIIRAFDEGTRERPYGHCLVAGINKYPKKVIRKDSAKKTAKKSRVKAFIKLVNYNHIMPTRYTLDVDLKDVVTPDVLTSRDKKVTAAKETKARLEERFKTGKNRWFFTKLRF

SEQ ID NO: 16938 - protein, 135 aa, Raphanus sativus
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALASNDKKVAALKEAKAKLEERFKTGKNRWFFTKLRF

SEQ ID NO: 16939 - protein, 135 aa, Raphanus sativus
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALSSKDKKVAALKEAKAKLEDRFKTGKNRWFFTKLRF

SEQ ID NO: 16940 - protein, 135 aa, Senecio madagascariensis
MVKFLKPNKAVVVLNGRFAGRKAVIVKQFDDGTRDRPYGHCLVAGIAKYPKKVIRKDSAKKTAKKSRVKAFIKLVNYNHIMPTRYTLDVDLKDVVTLDALQSRDKKVGACKETKARLEERFKTGKNRWFFSKLRF

SEQ ID NO: 16941 - protein, 135 aa, Solanum lycopersicum
  Sequence also found in Organisms: Solanum phureja
MVKFLKPNKAVILLQGKYAGRKAVIVRAFDEGTRDRPYGHCLVAGISKYPKKVIRKDSAKKQAKKSRVKAFIKLVNYNHIMPTRYTLDVDLKDVVNADVLQARDKKVTAAKETKARLEERFKTGKNRWFFTKLRF

SEQ ID NO: 16942 - protein, 135 aa, Acacia harpophylla
MVKFLKPNKAVILLQGRYAGRKAVILRNFDDGTRDRPYGHCLVAGIKKYPSKVIKKDSAKKTAKKSRVKAFVKLVNYQHLMPTRYTLDVDLKEVATIDALQSKDKKVTALKETKKRFEERFKTGKNRWFFTKLRF

SEQ ID NO: 16943 - protein, 135 aa, Ambrosia trifida
MVKFLKPNKAVVVLNGRFAGRKAVIVKQFDDGTRDRPYGHCLVAGISKYPKKVIRKDSAKKTAKKSRVKAFIKLVNYNHIMPTRYTLDVDLKDVVTVDVLQSRDKKVTACKEAKARLEERFKTGKNRWFFSKLRF

SEQ ID NO: 16944 - protein, 135 aa, Aquilegia formosa
MVKFLKPNKAVIVLQGRFAGRKAVIIRQFDEGTRDRPYGHCLVAGIAKYPKKVIRKDSAKKTAKKSRVKAFIKLVNYNHIMPTRYTLDVDLKDVANLETFQSRDKKVTAAKEIKSRLEERFKTGKNRWFFSKLRF

SEQ ID NO: 16945 - protein, 135 aa, Arabidopsis thaliana
  Sequence also found in Organisms: Arabidopsis lyrata
MVKFLKQNKAVILLQGRYAGKKAVIIKSFDDGTSDRRYGHCLVAGLKKYPSKVIRKDSAKKTAKKSRVKCFIKLVNYQHLMPTRYTLDVDLKEVATLDALKSKDKKVTALKEAKAKLEERFKTGKNRWFFTKLRF

SEQ ID NO: 16946 - protein, 135 aa, Aristolochia fimbriata
MVKFLKPGKAVVLLQGRFAGRKAVIIRSFDDGTRDRPYGHCLIAGISKYPKKVIRKDSAKKTAKKSRVKAFIKLVNYNHIMPTRYTLDVDLKDVVSIDAFQSRDKKVAAAKETKAKLEERFKTGKNRWFFSKLRF

SEQ ID NO: 16947 - protein, 135 aa, Arnica chamissonis
MVKFLKPNKAVVVLNGRFAGRKAVIVRQFDDGTRDRPYGHCLVAGISKYPKKVIRKDSAKKTAKKSRVKAFIKLVNYNHIMPTRYTLDVDLKDIVTVDALQSRDKKVTACKETKARLEERFKTGKNRWFFSKLRF

SEQ ID NO: 16948 - protein, 135 aa, Brassica napus
  Sequence also found in Organisms: Brassica juncea, Brassica oleracea, Brassica rapa, Raphanus sativus
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALSSKDKKVAALKEAKAKLEERFKTGKNRWFFTKLRF

SEQ ID NO: 16949 - protein, 135 aa, Brassica juncea
MVKFLKQNKAVILLQGRYAGKKAVIIKSFDDGNRERPYGHCLVAGLKKYPSKVIRKDSAKKTAKKSRVKCFIKVVNYQHLMPTRYTLDVDLKEVATLDALSSKDKKVAALKEAKAKLEERFKTGKNRWFFTKLRF

SEQ ID NO: 16950 - protein, 135 aa, Theobroma cacao
MVKFLKPNKAVIVLQGRYAGRKAVIVKSFDDGTRERAYGHCLVAGVKKYPSKVIRKDSAKKTAKKSRVKCFIKLVNYQHLMPTRYTLDVDLKDVVTVDALQTKDKKVAACKATKERFEERFKTGKNRWFFTKLRF

SEQ ID NO: 16951 - protein, 135 aa, Brassica napus
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALASKDKKVAALKEAKAKLEERFKSGKNRWFFTKLRF

SEQ ID NO: 16952 - protein, 134 aa, Brassica napus
VKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALASKDKKVAALKEAKAKLEERFKTGKNRWFFTKLRF

SEQ ID NO: 16953 - protein, 135 aa, Daucus carota
MVKFLKPNKAVIVLNGRFAGRKAVIIRAFDEGTRDRPYGHCLVAGISKYPKKVIRKDSAKKTAKKSRVKAFIKLVNYNHIMPTRYTLDVDLKDVVTADCLQSRDKKVTAAKATKAKLEERFKTGKNRWFFTKLRF

SEQ ID NO: 16954 - protein, 135 aa, Daucus carota
MVKFLKPNKAVIVLNGRFAGRKAVIIRAFDEGTRDRPYGHCLVAGISKYPKKVIRKDSAKKTAKKSRVKAFIKLVNYNHIMPTRYTLDVDLKDVVTVDCLQSRDKKVTAAKATKAKLEERFKTGKNRWFFTKLRF

SEQ ID NO: 16955 - protein, 135 aa, Manihot esculenta
MVKFLKPNKAVIILQGRYAGRKAVIIKSFDEGTRDRPYGHCLVAGIKKYPSKVIKKDSAKKTAKKSRVKCFVKLVNYQHLMPTRYTLDVDLKDVVSVDALQSKEKKVAACKDTKARFEERFKTGKNRWFFTKLRF

SEQ ID NO: 16956 - protein, 135 aa, Castanea mollissima
MVKFLKPNKAVVLLQGRFAGHKAVIVRNFDDGNRDRPYGHCLVAGLAKYPKKVIRKDSAKKTAKKSRVKAFLKVVNYSHIMPTRYTLDVDLKDIVSVDALQSRDKKVTAAKETKARFEDRFKSGKNRWFFSKLRF

SEQ ID NO: 16957 - protein, 135 aa, Cirsium arvense
MVKFLKPNKAVVVLNGRFAGRKAVIVRQFDDGTRDRPYGHCLVAGIAKYPKKVIRKDSAKKTAKKSRVKAFIKLVNYNHIMPTRYTLDVDLKDIVTVDALQSHDKKVTACKETKARLEERFKTGKNRWFFSKLRF

SEQ ID NO: 16958 - protein, 135 aa, Cirsium arvense
MVKFLKPHKAVVVLNGRFAGRKAVIVRQFDEGTRDRPYGHCLVAGIAKYPKKVIRKDSAKKTAKKSRVKAFIKLVNYNHIMPTRYTLDVDLKDVVTVDTLQSRDKKVTACKETKARFEERFKSGKNRWFFSKLRF

SEQ ID NO: 16959 - protein, 135 aa, Cocos nucifera
MVKFLKPNKAVSVLQGRFAGRKAVIVRTFDEGTRDRPYGHCLVAGVAKYPRKVIRKDSAKKTAKKSRVKAFLKVVNYSHLMPTRYTLDVDLKDVVTLDVLQSRDRKVTACKETKARFEERFKTGKNRWFFSKHRF

SEQ ID NO: 16960 - protein, 135 aa, Gossypium hirsutum
MVKFLKPNKAVIVLQGRYAGRKAVIVKSFDDGTRDRPYGHCLVAGIKKYPSKVILKDSAKKTAKKSRVKCFVKLVNYQHLMPTRYTLDVDLKDTVTVDALQTKDKKVATCKTIKQRLEERFKTGKNRWFFTKLRF

SEQ ID NO: 16961 - protein, 135 aa, Taraxacum officinale
MVKFLKPNKAVVVLNGRFAGRKAVIVRQFDDGTRDRPYGHCLVAGIAKYPKKVIRKDSAKKTAKKSRVKAFIKLVNYNHIMPTRYTLDVDLKDIVSVDALQSRDKKVTACKETKARFEERFKTGKNRWFFSKLRF

SEQ ID NO: 16962 - protein, 135 aa, Solanum melongena
MVKFLKPNKAVIVLQGKYAGRKAVIVRAFDEGTRDRPYGHCLVAGISKYPKKVIRKDSAKKQAKKSRVKAFIKLVNYSHIMPTRYTLDVDLKDVVNVDVLQSRDKKVTASKETKARLEERFKTGKNRWFFTKLRF

SEQ ID NO: 16963 - protein, 135 aa, Flaveria ramosissima
MVKFLKPNKAVVVLNGRFAGRKAVIVRQFDDGTRDRPYGHCLVAGISKYPKKVIRKDSAKKTAKKSRVKAFIKVVNYNHIMPTRYTLDVDLKDVVTVDALQSRDKKVTACKETKARLEERFKTGKNRWFFSKLRF

SEQ ID NO: 16964 - protein, 135 aa, Flaveria ramosissima
MVKFLKPNKAVVVLNGRFAGRKAVIVRQFDDGTRDRPYGHCLVAGISKYPKKVIRKDSAKKTAKKSRVKAFIKLVNYNHIMPTRYTLDVDLKDVVTVDALQSRDKKVTACKETKARFEERFKTGKNRWFFSKLRF

SEQ ID NO: 16965 - protein, 135 aa, Fraxinus spp
MVKFLKPNKAVIILQGRYAGRKAVIIRNFDDGTRDRPYGHCLVAGLAKYPRKVIRKDSAKKQAKKSRVKCFIKLVNYNHIMPTRYTLDVDLKDVVSIESLQSRDKKVTAAKEAKARFEERFKTGKNRWFFTKLRF

SEQ ID NO: 16966 - protein, 135 aa, Fraxinus spp
MVKFLKPSKAVIILQGRYAGRKAVIIRNFDDGTRDRPYGHCLVAGLAKYPRKVIRKDSAKKQAKKSRVKCFIKLVNYNHIMPTRYTLDVDLKDVVSLESLQSRDKKVTAAKEAKARFEERFKTGKNRWFFTKLRF

SEQ ID NO: 16967 - protein, 135 aa, Gossypium raimondii
MVKFLKPNKAVIVLQGRYAGRKAVIVKSFDDGTRDRPYGHCLVAGIKKYPSKVIRKDSAKKTAKKSRVKCFVKLVNYQHLMPTRYTLDVDLKDTVTVDALQTKDKKVATCKTIKQRMEERFKTGKNRWFFTKLRF

SEQ ID NO: 16968 - protein, 135 aa, Carpinus betulus
MVKFLKPNKVVILLQGRYAGRKAVIVRAFDEGTRDRPYGHCLVAGISKYPSKVIRKDSAKKTAKKSRVKAFVKLVNYQHLMPTRYTLDVDLKDVVSLESLQSRDKKVTAAKDTKKRLEDRFKSGKNRWFFTKLRF

SEQ ID NO: 16969 - protein, 135 aa, Ipomoea nil
MVKFLKPNKAVILLQGRYAGKKAVIVKSFDDGTRDRPYGHCLVAGIAKYPSKVIRKDSAKKQAKKSRVRTFVKLVNYNHIMPTRYTLDVDLKDAVTPDCLQSRDKRVAAAKEAKARLEDRFKTGKNRWFFSKLRF

SEQ ID NO: 16970 - protein, 135 aa, Nicotiana benthamiana
  Sequence also found in Organisms: Nicotiana tabacum
MVKFLKPNKAVIILQGKYAGRKAVIIRAFDEGTRDRPYGHCLVAGISKYPKKVIRKDSAKKQAKKSRVKAFIKLVNYNHIMPTRYTLDVDLKDVVNVDVLQSRDKKVTAAKEAKARLEERFKTGKNRWFFTKLRF

SEQ ID NO: 16971 - protein, 135 aa, Quercus alba
MVKFLKPNKAVVLLQGRFAGHKAVIVRNFDDGNRDRPYGHCLVAGLAKYPKKVIRKDSAKKTAKKSRVKAFLKVVNYSHIMPTRYTLDVDLKDIVSADALQSRDKKVTAAKETKARFEDRFKSGKNRWFFSKLRF

SEQ ID NO: 16972 - protein, 135 aa, Olea europaea
MVKFLKPSKAVIVLQGRYAGRKAVIIRNFDDGTRDRPYGHCLVAGLAKYPRKVIRKDSAKKQAKKSRVKCFIKLVNYNHIMPTRYTLDVDLKDVVSLESLQSRDKKVTAAKEAKARFEERFKTGKNRWFFTKLRF

SEQ ID NO: 16973 - protein, 135 aa, Allium cepa
MVKFLKPNKAVILLQGRFAGRKAVIVKNFDDGTRDRAYGHCLVAGILKYPKKVIRKDSAKKTAKKSRVKAFIKVVNYSHIMPTRYTLDVDLKDVATLDALLSKDKKVEACKEVKKRFEERFKTGKNRWFFTKLRF

SEQ ID NO: 16974 - protein, 135 aa, Allium cepa
MVKFLKPNKAVILLQGRFAGRKAVIVKNFDDGTRDRAYGHCLVAGILKYPKKVIRKDSAKKTAKKSRVKAFLKVVNYSHIMPTRYTLDVDLKDVVTVDALQTKDKKVETCKEVKKRFEERFKTGKNRWFFTKLRF

SEQ ID NO: 16975 - protein, 135 aa, Allium cepa
MVKFLKPNKAVILLQGRFAGRKAVIVKNFDDGTRDRAYGHCLVAGILKYPKKVIRKDSAKKTAKKSRVKAFIKVVNYSHIMPTRYTLDVDLKDIATLDALQTKDKKVEACKEVKKRFEERFKTGKNRWFFTKLRF

SEQ ID NO: 16976 - protein, 135 aa, Capsicum annuum
MVKFLKPNKAVILLQGKYAGRKAVIIRAFDEGTRDRPYGHCLVAGISKYPKKVIRKDSAKKQAKKSRVKAFIKLVNYTHIMPTRYTLDVDLKDVVNADVLSTRDKKVTAAKETKARFEERFKTGKNRWFFAKLRF

SEQ ID NO: 16977 - protein, 135 aa, Cajanus cajan
MVKFLKANKAVIVLQGRYAGKKAVIVRSFDEGTRERPYGHCLVAGIKKYPSKVIKKDSAKKTAKKSRVKAFLKLVNYQHLMPTRYTLDVDLKDAVTPDALHAKDKKVTALKETKKRLEDRFKTGKNRWFFTKLRF

SEQ ID NO: 16978 - protein, 135 aa, Platanus occidentalis
MVKFLKPNKAVILLQGRFAGRKAVIIRSFDEGTRDRPYGHCLVAGIAKYPKKVIRKDSAKKTAKKSRVRAFIRLVNYNHIMPTRYTLDVDLKDVVTLDALQSRDKKVTAAKETKTRFEERFKTGKNRWFFSKLRF

SEQ ID NO: 16979 - protein, 135 aa, Papaver somniferum
MVKFLKPNKAVVVLQGRFAGRKAVIIRAFDEGTRERPYGHCLVAGINKYPKKVIRKDSAKKTVKKSRVKAFIKLVNYNHIMPTRYTLDVDLKDVVTPDVLTSRDKKVTAAKETKARLEERFKTGKNRWFFTKLRF

SEQ ID NO: 16980 - protein, 135 aa, Rhizophora mangle
MVKFLKPNKAVILLQGRYAGRKAVIVKNFDDGTRDRAYGHCLVAGIKKYPAKVIRKDSAKKTAKKSRVKCFIKLVNYQHLMPTRYTLDVDLKDVVTLDALQTKEKKVTAAKETKARFEERFKTGKNRWFFTKLRF

SEQ ID NO: 16981 - protein, 135 aa, Carthamus tinctorius
MVKFLKPHKAVVVLNGRFAGRKAVIVRQFDEGTRDRPYGHCLVAGIAKYPKKVIRKDSAKKTAKKSRVKAFIKLVNYNHIMPTRYTLDVDLKDVVTADTLQSRDKKVTACKETKARFEERFKSGKNRWFFSKLRF

SEQ ID NO: 16982 - protein, 135 aa, Carthamus tinctorius
MVKFLKPNKAVVVLNGRFAGRKAVIVKQFDDGTRDRPYGHCLVAGIAKYPKKVIRKDSAKKTAKKSRVKAFIKLVNYNHIMPTRYTLDVDLKDVVSVDALQSRDKKVTACKETKARLEERFKTGKNRWFFSRLRF

SEQ ID NO: 16983 - protein, 135 aa, Scabiosa columbaria
MVKFLKPNKAVVILNGRFAGRKAVIIRAFDEGTRDRPYGHCLVAGISKYPKKVIRKDSAKKTAKKSRVKAFIKLVNYNHIMPTRYTLDVDLKEIVTLDALQSRDKKVTAAKETKARLEERFKTGKNRWFFSKLRF

SEQ ID NO: 16984 - protein, 135 aa, Nicotiana tabacum
MVKFLKPNKAVIILQGKYAGRKAVIIRAFDEGTRDRPYGHCLVAGISKYPKKVIRKDSAKKQAKKSRVKTFIKLVNYNHIMPTRYTLDVDLKDVVNVDVLQSRDKKVTAAKEAKARLEERFKTGKNRWFFTKLRF

SEQ ID NO: 16985 - protein, 164 aa, Oryza sativa
MRLEKCWFCSSTIYPGHGIQFVRNDAKIFRFCRSKCHKNFKMKRNPRKVKWTKAYRCLHGKDMTQDSTFEFERKRNRPERYDRNVTAQTLKAIPLITKIRHERHKKHITERQKQGKTKQRERDAKELEQDIQMLPKKDTMLSTQKTKVVVKVSQQQTEENLMEE

SEQ ID NO: 16986 - protein, 159 aa, Brachypodium distachyon
MRLEKCWFCSSTVYPGHGIQFVRNDAKVFRFCRSKCHKNFKMKRNPRKVKWTKAYRRLRGKDMTQDSTFEFERKRNRPERYDRNVTEQTLKAIPLITKIRHERQKTHITDRQKQGKSKQRQKDAKEVEQDIGMLPKKLQETKLKVEVSQQQTEDNLMEE

SEQ ID NO: 16987 - protein, 162 aa, Hordeum vulgare
MRLEKCWFCSSTVYPGHGIQFVRNDAKVFRFCRSKCHKNFKMKRNPRKVKWTKAYRRLRGKDMTQDSTFEFERKRNRPERYDRNVTEQTLKAIPLITKIRHERQKKHITERQKSGKSMVRKSDAKELEQDIGMVPKKETENYVAKQKVLVSQLKTEENLMEE

SEQ ID NO: 16988 - protein, 162 aa, Avena sativa
MRLEKCWFCSSTVYPGHGIQFVRNDAKIFRFCRSKCHKNFKMKRNPRKVKWTKAYRHLRGKDMTQDATFEFERKRNRPERYDRNVTEQTLKAIPLITKIRHERQKKHITERQKAGKSMSRKKDAKELDQDLQMLPKKDTANYVPKQKVLVSQLKTEENLMEE

SEQ ID NO: 16989 - protein, 162 aa, Avena sativa
MRLEKCWFCSSTVYPGHGIQFVRNDAKIFRFCRSKCHKNFKMKRNPRKVKWTKAYRHLRGKDMTQDSTFEFERKRNRPERYDRNVTEQTLKAIPLITKIRHDRQKKHITERQKAGKSMSRKKDAKELDQDLQMLPKKDTANYVPKQKVLVSQLKTEENLMEE

SEQ ID NO: 16990 - protein, 162 aa, Secale cereale
MRLEKCWFCSSTVYPGHGIQFVRNDAKIFRFCRSKCHKNFKMKRNPRKVKWTKAYRRLRGKDMTQDATFEFERKRNRPERYDRNVTEQTLKAIPLITKIRHERQKKHITERQKAGKSMVRKSDAKELDQDIGMVPKKETESYVAKQKVLVSQLKTEENLMEE

SEQ ID NO: 16991 - protein, 159 aa, Brachypodium distachyon
MRLEKCWFCSSTVYPGHGIQFVRNDAKVFRFCRSKCHKNFKMKRNPRKVKWTKAYRRLRGKDMTQDSTFEFERKRNRPERYDRNVTEQTLKAIPLITKIRHERQKTHISDRQKQGKSKQREKDAKEVEQDFHMLPKMLQETKVKVRVTQQQTEDNVMEE

SEQ ID NO: 16992 - protein, 162 aa, Avena sativa
MRLEKCWFCSSTVYPGHGIQFVRNDAKIFRFCRSKCHKNFKMKRNPRKVKWTKAFRHLRGKDMTQDATFEFERKRNRPERYDRNVTEQTLKAIPLITKIRHERQKKHITERQKAGKSMSRKKDAKELDQDLQMLPKKDTANYVPKQKVLVSQLKTEENLMEE

SEQ ID NO: 16993 - protein, 163 aa, Festuca arundinacea
MRLEKCWFCSSTVYPGHGIQFVRNDAKVFRFCRSKCHKNFKMKRNPRKVKWTKAYRRLRGKDMTQDTTFEFERKRNRPERYDRILTEQTLKAIPLITKIRHERQKKHITERQKGGKSMSRKKDAKELEQDLQMLPKKDTVAYEATKQKVIVSQLKTEENLMEE

SEQ ID NO: 16994 - protein, 162 aa, Avena sativa
MRLEKCWFCSSTVYPGHGIQFVRNDAKIFRFCRSKCHKNFKMKRNPRKVKWTKAFRHLRGKDMTQDATFEFERKRNRPERYDRNVTEQTLKAIPLITKIRHDRQKKHITERQKAGKSMSRKKDAKELDQDLQMLPKKDTANYVPKQKVLVSQLKTEENLMEE

SEQ ID NO: 16995 - protein, 162 aa, Triticum aestivum
MRLEKCWFCSSTVYPGHGIQFVRNDAKIFRFCRSKCHKNFKMKRNPRKVKWTKAYRRLRGKDMTQDATFEFERKRNRPERYDRNVTEQTLKAIPLITKIRHERQKKHITERQKGGKSMVRKSDAKELDQVIGMVPKKETENYVAKQKVLVSQLKTEENLMEE

SEQ ID NO: 16996 - protein, 162 aa, Avena sativa
MRLEKCWFCSSTVYPGHGIQFVRNDAKIFRFCRSKCHKNFKMKRNPRKVKWTKAYRHLRGKDMTQDSTFEFERKRNRPERYDRNVTEQTLKAIPLITKIRQERQIQHIAKRQMAGKSMSRKKDAKELEQDLQMLPKKDISHYETKTKVLVSQLKTEENLMEE

SEQ ID NO: 16997 - protein, 166 aa, Echinochloa colona
MRLEKCWFCSSTIYPGHGIQFVRNDAKIFRFCRSKCHKNFKMKRNPRKVKWTKAYRRLHGKDMTQDSTFEFERKRNRPERYDRNVTEQTLKAIPLITKVRHERLKKHITDRHKPGKTKERERDSKELEQDINILPKKLISNELSAERPKILVKVERPQTEDNMMEE

SEQ ID NO: 16998 - protein, 166 aa, Echinochloa colona
MRLEKCWFCSSTIYPGHGIQFVRNDAKIFRFCRSKCHKNFKMKRNPRKVKWTKAYRRLHGKDMTQDSTFEFERKRNRPERYDRNVTEQTLKAIPLITKVRHERLKKHITDRHKPGKTKERERDSKELEQDINILPKKLISNELTAERPKILVKVERQQTEDNMMEE

SEQ ID NO: 16999 - protein, 163 aa, Lolium multiflorum
MRLEKCWFCSSTVYPGHGIQFVRNDAKVFRFCRSKCHKNFKMKRNPRKVKWTKAYRRLRGKDMTQDTTFEFERKRNRPERYNRILTEETLKAIPLITKIRHERQKKHITERQKGGKSMSRKKDAKELEQDLQMLPKKDTVAYEAAKQKVIVSQLKTEENLMEE

SEQ ID NO: 17000 - protein, 167 aa, Setaria italica
MRLEKCWFCSSTIYPGHGIQFVRNDAKIFRFCRSKCHKNFKMKRNPRKVKWTKAYRRLHGKDMTQDSTFEFERKRNRPERYDRNVTEQTLKAIPIITKARHERLKKHISDRQKPGKKKELERDNKELEQDINMLPKKLISNEASAEKTKVKVKVKVVQQQTEDRMEE

SEQ ID NO: 17001 - protein, 162 aa, Avena sativa
MRLEKCWFCSSTVYPGHGIQFVRNDAKVFRFCRSKCHKNFKMKRNPRKVKWTKAYRHLRGKDMTQDATFEFERKRNRPERYDRNVTEQTLKAIPLITKIRHERQKTHINKRQQAGKSMSRKKDAKELDQDLQMLPKKDIAHYEPKTKVLVSQLKTEENLMEE

SEQ ID NO: 17002 - protein, 166 aa, Saccharum officinarum
MRLEKCWFCSSTIYPGHGIQFVRNDAKIFRFCRSKCHKNFKMKRNPRKVKWTKAYRQLHGKDMTKDTTFEFERKRNRPERYDRNLTEQTLKAIPLITKIRHDRLEKHISNRHKPGKRKEMEKDSKELDQDIGMLPKKLISNELAVEKTKIKVKVVQQQTEDNAMEE

SEQ ID NO: 17003 - protein, 165 aa, Panicum virgatum
MRLEKCWFCSSTIYPGHGIQFVRNDAKIFRFCRSKCHKNFKMKRNPRKVKWTKAYRALHGKDMTQDSTFEFERKRNRPERYDRNMTEQTLKAIPVIIKARHERLKKHIKDRHDPGKKKALERDNKELEQDINMLPKKLFSNEAPAKKQKVTVKVVQQQTEDRMEE

SEQ ID NO: 17004 - protein, 737 aa, Brachypodium distachyon
MRAREMHPLCCLAGAAEYCPGGGAGDRSPPPPPAPALDGAPAAVAGVLYKWTNIGSGWRPRWFAIRGGVLAYSKIRRRVAAEETPPPPRHEAAGVRLIGGAARAAGEQPVGFVHLKISSFSESKSDDKRFYIITPTKTLQLRTGCAKDRVAWIEALVSARSEYSLCGVLPCDQNDGSFSTEKLRDRLHAEGVGASIVKDCEQIVHSEFSQYHTQMKQRCESYLSFIGSLPRELEVVNSGDATIVDNLELQLFKPDCSSSGKCSEYSNTESSDDAVKQEICQVSDEDEFHFYDTRQSFSDCTASPDFKTRHLDHGNEAHKFANLLAADRTNEYSLSSSKRRSKLPEPVEKEKSVSLWSMIKDNVGKDLTRVCLPVYFNEPLSSLQKCFEDLEYSYLLDRAYECGVRGNGLMRILYVAAFAVSGYASTDSRPCKPFNPLLGETYEADYPEKGIRFFSEKVSHHPMAMACHCEGKGWKFWGDSNLKSKFWGQSIQLDPSGVLTLEFDDGETFQWSKVTTTINNLIIGRVYCHHHGTMNIRGNRQYSCKLMFKEQSFLERNPRQVQGFVKYSDGTKVASLMGKWDESMYCIISDDASKVSSHVSHQSAGTTLLWEKNEPPDNPTRYNLSSFAITLNELTPGLKEKLPPTDSRLRPDQRHLENGEYEKANAEKLRLETRQRMARNMQESGWRPRWFQRDAEDGTYRYVGGYWEAREQRRWVGCNDIFGNFTDTPKLHTGATV

SEQ ID NO: 17005 - protein, 742 aa, Setaria italica
MRAWEMHPLCCLAGEWPGSGGELAPGDRSPPPEPAEAGAEAPAVAGVLYKWTNIGKGWRPRWFAIRGGVLAYSKIRRRVAAEPHPASEAAGGVRLIGVARGAGGAGERPIGFVHLKISSFSESKSDDKRFYIITPTKTLQLRTGCAKDRATWIEALVTARSEYSLNGDLSGDQNDTSFSTEKLRNRLHTEGVGEAIIKDCEQIVHSEFSQYQTQMKQRCEEYLSFIGSLPREVEVVNSVDTTVTEKPQLELFKHDCSSSGKCSEYSNTESSDDAGKQEISELSDGDEFHFYDTRQSFSDFATSPDLTRKGLNNGNEDHKSVESLTADNANEYLLSYSKRRTKLPEPVEKEKGVSLWSMIKDNVGKDLTRVCLPVYFNEPLSSLQKCFEELEYSYLLDRAYECGLRGNGLMRILYVAAFAVSGYASTDSRPCKPFNPLLGETYEADYPEKGIRFFSEKVSHHPMVMACHCEGKGWKFWGDSNLKSKFWGQSIQVDPDGVLTLEFDDGETFQWSKVTTTINNLILGRLYCHHHGTMNISGNRQYSCKLTFKEQSFLDRNPRQVQGVVKDADGTKVATLTGKWDESVHCVISDDASKVKSHGSHHSAGATLLWKKNEPSANPTRYNLSSFAITLNELTPELKEKLPPTDSRLRPDQRHLENGEHEKANGEKLRLETRQRMARKMQESGWKPRWFQRDSEDGTFRYVGGYWEAREQRKWDGCNDIFGNLSSSPKLQSSTLYASSSI

SEQ ID NO: 17006 - protein, 730 aa, Panicum virgatum
MRAWEMHPLCCLAGEWPGSGGGLADGGRSPPPETPEAPAVAGVLYKWTNIGKGWRPRWFAIRGGVLAYSKIRRRVAAEAAGGVRLIGVARGAGGAAERPIGFVHLKISSFSESKSDDKRFYIITPTKTLQLRTGCAKDRATWIEALVTARSEYSFNEDLSGDQNDASFSTEKLRNRLHAEGVGEAVIKDCEQIVHSEFSQYQTQMKQRCEEYLSFIGSLPREVEVVNSVDTTVTEKPQLELFKHDCSSSGKCSEYSNTESDDVGKQEICELSDGDEFHFYDTRQSFSDFAASPEMRRRCLNNGNEDHVSIESLTTDKANEDLSYSKRRTKLPEPVEKEKGVSLWSMIKDNCGKDLTRVCLPVYFNEPLSSLQKCFEELEYSYLLDRAYECGLRGNGLMRIIYVAAFAVSGYASTDCRPCKPFNPLLGETYEADYPEKGIRFFSEKVSHHPMVMACHCEGKGWKFWGDSNLRSKFWGQSIQLDPDGVLTLEFDDGETFQWSKVTTTINNLILGRVYCHHHGTMNISGNRRYSCKLTFKEQSFLDRNPRQVQGVVKDADGTKVATLMGKWDESVHCIIGDDASKVKSHGSHQSTGATLLWEKNKPSANPTRYNLSSFAITLNELTPELKEKLPPTDSRLRPDQRHLENGEYEKANAEKLRLETRQRMARKMQESGWKPRWFQRDSEDGTFRYIGGYWEAREQRKWDGCNDIFGNLSSSPKLQPSTLYASSSI

SEQ ID NO: 17007 - protein, 750 aa, Sorghum bicolor
MRAWEMHPLCCLAGEWPSSGGGGGGLAPGDRSLPPAEEDADAAGEAPAVAGVLYKWTNIGKGWRPRWFAIRGGVLAYSKIRRRVAAEPHPATEAAGGGGVRLIGVARGGAGGGAGERPIGFVPLKISSFSESKSDDKRFYIITPTKTLQLRTGCAKDRATWIEALVSARSEYSFNGDLSGDQNDASFSTEKLRNRLHAEGIGEAVIKDCEQIIHSEFSQYQTQMKQRCEEYLSFIGSLPREVEVVNSVDSTVPEKPQLELFKHDCSSSGKCSEYSNTESSDDVGKQEISELSDGDEFHFYDTRQSFSEFATSPADPRKGCLNNGNEDHKSVEPLSAHKAEKCMLSHSKRRSQLPEPIEKEKGVSLWSMIKDNVGKDLTRVCLPVYFNEPLSSLQKCFEELEYSYLLDRAYECGLRGNGLMRILYVAAFAVSGYASTDSRPCKPFNPLLGETYEADYPEKGIRFFSEKVSHHPMVVACHCEGKGWKFWGDSNLKSKFWGQSIQLDPNGVLTLEFDDGETFQWSKVTTTINNLILGRVYCHHHGTMNISGNRRYSCKLTFKEQSFLDRNPRQVQGVVKDADGSKVATLMGKWDESVHCIINNDASKANSHGSQKSSGATLLWEKNEPPVNPTRYNLSAFAITLNELTPELKLPPTDSRLRPDQRHLENGEYEKANAEKLRLETRQRMARKMQESGWKPRWFQRDSEDGTYRYVGGYWEAREQRTWVGCNDIFGNLSSSQKLPPSALYTSSSI

SEQ ID NO: 17008 - protein, 713 aa, Echinochloa colona
PPEPAASEGEEAPAVAGVLYKWTNIGKGWRPRWFAIRGGVLAYSKIRRRVAAEPHPAPEAAAAGGVRLIGVARGGAGERPIGFVHLKISSFSESKSDDKRFYIITPTKTLQLRTGCAKDRAAWIEALVTARSEYSFNGDLSGDQNDTSFSTEKLRNHLHAEGVGEAIIKDCEQIVHSEFSQYQTQMKQRCEEYLSFIGSLPREVEVVNSVDTTVTEKPQFELFKHDCSSSGKCSEYSNTESSDDVGKQEISELSDGDEFHFYDTRQSFSDCALSPDLRRRCLNNGNEDHKSVEPLTADNANKYLLSYSKRRTKLPEPVEKEKGVSLWSMIKDNVGKDLTRVCLPVYFNEPLSSLQKCFEELEYSYLLDRAYECGLRGNGQMRILYVAAFAVSGYASTDSRPCKPFNPLLGETYEADYPEKGIRFFSEKVSHHPMVMACHCEGKGWKFWGDSNLKSKFWGQSIQVDPDGVLTLEFDDGETFQWRKVTTTINNLILGRLYCHHHGTMNISGNRQYSCKLTFKEQSFLDRNPRQVQGVVKDADGTKFATLTGKWDESVHCIIGDDASKVKSHGSHQSAGATLLWEKNEPPANPTRYNLSSFAITLNELTPGLKEKLPPTDSRLRPDQRHLENGEYEKANAEKLRLETRQRMARKMQESGWKPRWFQRDSEDGTFRYVGGYWEAREQRKWDGCNDIFGNLSSSPKLQSSTLYASSSI

SEQ ID NO: 17009 - protein, 737 aa, Zea mays
MRAWEMHPLCCLAAGEWPASGAARDDRSPPPEGSGEAPAVAGVLYKWTNIGKGWRPRWFAIRGGVLAYSKIRRRVAAAPPRPASEAAGGVRLIGVARGAGERPIGFVPLKMSSFSESKSDDKRFYIITPTKTLQLRTGCAKDRATWIEALVTARSEYSFNGDLSGDQNVASFSTEKLRNRLHVEGVGEAVIKDCEQIIQSEFSQYQTQMKQRCEEYLSFIGSLPREVEVVNSVDSTVPEKSQLELFKHDCSSSGKCSEYSNTESSDDVGKQEISELSDGDDFHFYDTRQSFSEFTTTPADLRKGCVNTGNEDHKSVESLTVDEAEKYMLSHPKRRSQLPEPIEKEKGVSLWSMIKDNVGKDLTRVCLPVYFNEPLSSLQKCFEELEYSYLLDRAYECGLRGNGLMRIIYVAAFAVSGYASTDSRPCKPFNPLLGETYEADYPEKGIRFFSEKVSHHPMVMACHCEGKGWKFWGDSNLKSKFWGQSIRLDPNGVLTLEFDDGETFQWSKVTTTINNLILGRVYCHHHGTMNISGNRRYSCKLTFKEQSFLDRNPRQVQGVVNDADGSKVATLMGKWDESMHYIINNDASKTNSHGSHEGSGATLLWEKNEPPVNPTRYNLSTFAITLNELTPELKEKLPPTDSRLRPDQRHLENGEYEKANAEKLRLETRQRMARKMQESGWKPRWFQRDSEDGTYRYVGGYWEAREQRTWVGCNDIFGNLSSSPKLPPSGLNTSSSI

SEQ ID NO: 17010 - protein, 1229 aa, Zea mays
MYLYSLTLQRATGAVCAVIGSFSGRDSKKSAASGSGSTQEIAVARGSTLDLLRPDPETGRLRTLLSVDVFGAIRSLAQFRLTGANKDYLVVGSDSGRLVILEYSPDRNRLDKVHQETFGKSGCRRIVPGQLLAVDPKGRALCIAALEKQKLVYVLNRDAAARLTISSPLEAHKSNTLTFALAALDCGFDNPVFAAIELEYAESDRDPTGQAANQAQKLLTFYELDLGLNHVSRKVSEPIDNGANLLVTVPGGGDGPSGVLVCCDNFVLYRNQGHPEIRAVIPRRADLPAERGVLIVAAATHKQKSMFFFLLQTEYGDIFKVDLDHNGDAVSELRIKYFDTIPVTSAVCVLRSGFLFAASEFGNHALYQFRDIGREADVESSSATLMETEEGFQPVFFQPRALKNLMRIDEIESLMPVMDMRVANLFDEETPQLFTACGRGPRSTLRILRPGLAISEMARSMLPAEPIAVWTVKKNINDMFDAYIVVSFTNVTLVLSIGETIEEVSDSQFLDTTHSLAVTLLGEDSLMQVHPNGIRHIREDGRVNEWRTPGKKTITKVGSNRLQVVIALSGGELIYFEMDMTGQLMEVEKQDMSGDVACLAIAPVPEGRQRSRFLAVGSYDNTIRILSLDPDDCLQPLSVQSVSSAPESLLFLEVQASVGGEDGADYPANLFLNAGLQNGVLFRTNVDMVTGQLSDTRSRFLGLRPPKLFPCIVSHRQAMLCLSSRPWLGYIHQGHFLLTPLSCDTLESAASFSSDQCSEGVVAVAGDALRIFTIERLGETFNETAIPLRYTPRKFVILPKKKYIAVIESDKGAFSAEEREAAKKECLDASGAAENGNANNGDPMENGDGQDGAEEGNTFPDEQYGYPKAESERWVSCIRILDPRSRDTTCLLELQDNEAAVSICTVNFHDKEHGTLLAIGTAKGLQFWPRRTLAGGFIHVYKFVDEGRSLELLHKTQVEEVPLALCQFQGRLLAGVGSVLRLYDLGKRKLLRKCENKLFPRTLVSIHTYRDRIYVGDMQESFHYCKYRRDENQLYIFADDSVPRWLTTAQHIDFDTMAGADKFGNIYFARLPQDISDEIEEDPTGGKIKWEQGKLNGAPNKVEEIVQFHVGDVVTCLQKASLIPGGGECLIYGTVMGSVGALLAFTSREDVDFFSHLEMHLRQEHPPLCGRDHMAYRSAYFPVKDVIDGDLCEQYPSLPADMQRKIADELDRTPGEILKKLEDIRNKII

SEQ ID NO: 17011 - protein, 1230 aa, Setaria italica
MYLYSLTLQRATGAVCAVIGSFSGRDTKKSAASGSASTQEIAVARGSTLDLLRPDPETGRLRTLLSVDVFGAIRSLAQFRLTGATKDYLVVGSDSGRLVILEYSPDRNRFDKVHQETFGKSGCRRIVPGQLLAVDPKGRALCIAALEKQKLVYVLNRDAAARLTISSPLEAHKSNTLTFSLTALDCGFDNPIFAAIELEYAESDRDPTGQAANQAQKLLTFYELDLGLNHVSRKASEPIDNGANLLVTVPGGGDGPSGVLVCCDNFVLYRNQGHPEVRAVIPRRADLPAERGVLIVAAATHRQKNLFFFLLQTEYGDIFKVDLEHSGETVTELRIKYFDTIPVTSATCVLRSGFLFAASEFGNHALYQFRDIGRDADVESSSATLMETEEGFQPVFFQPRPLKNLMRIDEIESLMPVMDMRVANLFDEETPQLFTACGRGPRSTLRILRPGLAISEMARSMLPAEPIAVWTVKKNINDMFDAYIVVSFANVTLVLSIGETIEEVSDSQFLDTTHSLAVTLLGEDSLMQVHPSGIRHIREDGRVNEWRTPGKKTITKVGSNRLQVVIALSGGELIYFEMDMTGQLMEVEKQDMSGDVACLAIAPVPEGRQRSRFLAVGSYDNTIRILSLDPDDCLQPLSVQSVSSAPESLLFLEVQASVGGEDGGDYPANLFLNAGLQNGVLFRTNVDMVTGQLSDTRSRFLGLRPPKLFPCMVSHRQAMLCLSSRPWLGYIHQGHFLLTPLSCDTLESAASFSSDQCSEGVVAVAGDALRIFTIERLGETFNETAIPLRYTPRKFVILPKKKYIAVIESDKGAFSAEEREAAKKECLEASGAAENGNANNGDPMENGDGQEDGAEEGNTFPDEQYGYPKAESERWVSCIRILDPRSRDTTCLLELQDNEAAVSICTVNFHDKEHGTLLAVGTAKGLQFWPKRTLAAGFIHIYKFVSDGRSLELLHKTQVEEVPLALCQFQGRLLAGVGSVLRLYDLGKRKLLRKCENKLFPKTIVSIHTYRDRIYVGDMQESFHYCKYRRDENQLYIFADDSVPRWVTAAQHIDFDTMAGADKFGNIYFARLPQDISDEIEEDPTGGKIKWEQGKLNGAPNKVEEIVQFHVGDVVTSLQKASLIPGGGECLIYGTVMGSVGALLAFTSREDVDFFSHLEMHLRQEHPPLCGRDHMAYRSAYFPVKDVIDGDLCEQYPSLPADMQRKIADELDRTPGEILKKLEDIRNKII

SEQ ID NO: 17012 - protein, 1234 aa, Oryza sativa
MYLYSLTLQRATGAVCAVIGSFSGRDSKKSAASGSSSSSSSTQEIAVARGTTLELLRPDPETGRLRTLLSVDVFGAIRSLAQFRLTGATKDYLVVGSDSGRLVILEYSPDRNRLDKVHQETFGKSGCRRIVPGQLLAVDPKGRALCIAALEKQKLVYVLNRDAAARLTISSPLEAHKSNTLTFSLTALDCGFDNPVFAAIELEYAESDRDPTGQAAEQAQKHLTFYELDLGLNHVSRKASEPIDNGANLLVTVPGGGDGPSGLLVCCDNFVLYRNQGHPEVRAVIPRRADLPAERGVLIVAAATHRQKSLFFFLLQTEYGDIFKVDLEHSNDTVTELRIKYFDTIPVTSAICVLRSGFLFAASEFGNHALYQFRDIGRDVDVESSSATLMETDEGFQPVFFQPRALKNLYRIDEIESLMPIMDMRVANLFDEETPQVFTACGRGPRSTLRILRPGLAISEMARSMLPAEPIAVWTVKKNINDMFDAYIVVSFANVTLVLSIGETIEEVSDSQFLDTTHSLAVSLLGEDSLMQVHPNGIRHIREDGRVNEWRTPGKKTITKVGSNRLQVVIALSGGELIYFEMDMTGQLMEVEKQDMSGDVACLAIAPVPEGRQRSRFLAVGSFDNTIRILSVDPDDCLQPLSVQSVSSAPESLMFLEVQASVGGEDGADHPANLFLNAGLQNGVLFRTNVDMVTGQLSDTRSRFLGLRPPKLFPCIVSHRQAMLCLSSRPWLGYIHQGHFLLTPLSCDTLESAASFSSDQCSEGVVAVAGDALRIFTIEHLGETFNETAIPLRYTPRKFVILPKKKYLAVIESDKGALSAEEREAAKKECLEAAGVTENGNANNGDQMENGDGQEDGAEDRNTLPDEQYGYPKAESERWVSCIRILDPKSRDTTCLLELQDNEAAVSICTVNFHDKEHGTLLAVGTAKGLQFWPKRNLSAGFIHIYKFVDEGRSLELLHKTQVEEVPLALCQFQGRLLAGVGSVLRLYDLGKRKLLRKCENKLFPRTIVSIHTYRDRIYVGDMQESFHYCKYRRDENQLYIFADDSVPRWLTAANHIDFDTMAGADKFGNIYFARLPQDLSDEIEEDPTGGKIKWEQGKLNGAPNKVEEIVQFHVGDVVTCLQKASLIPGGGECLIYGTVMGSVGALLAFTSREDVDFFSHLEMHLRQEHPPLCGRDHMAYRSAYFPVKDVIDGDLCEQFPSLPADMQRKIADELDRTPGEILKKLEDIRNKII

SEQ ID NO: 17013 - protein, 1230 aa, Setaria italica
MYLYSLTLQRATGAVCAVIGSFSGRDAKKAASGSASTQEIAVARGSTLDLLRLDPETGRLRTLLSVDVFGAIRSLAQFRLTGASKDYLVVGSDSGRLVILEYSPDRNRLDKVHQETFGKSGCRRIVPGQLLAVDPKGRALCIAALEKQKLVYVLNRDAAARLTISAPLEAHKSNTLTFSLTALDCGFDNPIFAAIELEDAESDRDPTGQAANQAQKVLTFYELDLGLNHVSRKASEPIDNGANLLVTVPGGGDGPSGVLVCCDNFVLYRNQGHPEVRAVIPRRADLPAERGVLIVAAATHRQKTLFFFLLQTEYGDIFKVDLEHSGDTVTGLRIKYFDTVPVTSAICVLRSGFLLFAASEFGNHALYQFRDIGRDADVETSSATLMETEEGFQPVFFQPRALKNLMRIDDIESLMPVMDMRVANLFDEETPQIFTACGHGPRSTLRILRPGLAISEMARSVLPAEPIAVWTVKKNINDMLDSYIVVSFANATLVLSIGETIEEVSDSQFLDTTHSLSVTLLGEDSLMQVHPNGIRHIREDGRVNEWRTPGKKTITKVGSNRLQVVIALSGGELIYFEMDMTGQLMEVEKQDMSGDVACLAIAPVPEGRQRSRFLAVGSYDNTIRILSLDPDDCLQPLSVQNVSSAPESLLFLEVQASVGGEDGADYPANLFLNAGLQNGVLFRTNVDMVTGQLSDTRSRFLGLRPPKLFPCIVSHRQAMLCLSSRPWLGYIHQGHFLLTPLSCDTLESAASFSSDQCSEGVVAVAGDALHIFTIERLGETFNETAIPLRYTPRKFVILPKKKYIAVIESDKGAFNAEEREAAKKECLEASGAVEDGNANNADPMENGDGQENGAEDGNTFPDEQYGYPKAESERWVSCIRILDPRSRDTTCLLELQDNEAAVSICTVNFHDKEHGTLLAVGTAKGLQFWPKRTLAGGFIHIYKFVEDGRSLELLHKTQVEEVPLALCQFQGRLLAGVGSVLRLYDLGKRKLLRKCENKLFLKTIVSIHTYRDRIYVGDMQESFHYCKYRRDENQLYIFADDSVPRWLTAAQHIDFDTMAGADKLGNIYFARLPKDISDEIEEDPTGGKIKWEQGKLNGAPNKVEEIVQFHVGDVVTCLQKACLIPGGGECLIYGTVMGSVGALLAFTSREDVDFFSHLEMHLRQEHPPLCGRDHMAYRSAYFPVKDVIDGDLCEQYPTLPADMQRKIADELDRTPGEILKKLEDIRNKII

SEQ ID NO: 17014 - protein, 1228 aa, Brachypodium distachyon
MYLYSLTLQRATGAVCAVIGSFSGRDTKKSGAAGSSTQEIAVARGGTLDLLRPDPETGRLRTLLSVDVFGAIRSLAQFRLTGATKDYLVVGSDSGRLVILEYSPDRNRFDKVHQETFGKSGCRRIVPGQLLTVDPKGRALCIAALEKQKLVYVLNRDASARLTISSPLEAHKSHTLTFALTALDCGFDNPVFGAIELEYGDSDRDPTGQAASHAQKLLTFYELDLGLNHVSRKVSEPIDNGANLLVTVPGGGDGPSGLLVCCDNFVLYRNQGHPEVRAVIPRRVDLPAERGVLIVAAATHRQKSLFFFLLQTEYGDIFKVDLEHNGDSVSELRIKYFDTIPVASAICVLRSGFLFAASEFGNHALYQFRDIGRDVDVESSSATLMETEEGFQPVFFQPRALKNLVRIDEIESLMPIMDMRIANLFDEETPQVYTACGRGSRSTMRILRPGLAISEMARSMLPAEPIAVWTVKKNINDMFDAYIVVSFANVTLVLSIGETIEEVSDSQFLDTTHSLAVSLLGEDSLMQVHPNGIRHIREDGRVNEWRTPGKKTITKVGSNRLQVVIALSGGELIYFEMDMTGQLMEVEKQDMSGDVACLAIAPVPEGRQRSRFLAVGSYDNTIRILSLDPDDCLQPLSVQSVSSAPESLLFLEVQASVGGEDGADYPANLFLNAGLQNGVLFRTNVDMVTGQLSDTRSRFLGLRPPKLFPCIVSHRQAMLCLSSRPWLGYIHQGHFLLTPLSCDTLESAASFSSDQCSEGVVAVAGDALRIFTIERLGETFNETAIPLRYTPRKFVILPKKKYLAVIESDKGAFSAEQREAAKRECLEASGAVENGNGNGDQMENGDGQEDGAEESNTLPDEQYGYPKAESEKWVSCIRILDPRSRDTTCLLELQDNEAAVSICTVNFHDKEHGTLLAVGTTKGLQFWPKRSLASGFIHIYKFVDEGKSLELLHKTQVEEVPLSLCQFQGRLLAGVGSVLRLYDLGKRKLLRKCENKLFPRTIVSIHTYRDRIYVGDMQESFHYCKYRRDENQLYIFADDSVPRWLTAANHIDFDTMAGADKFGNIYFARLPQDLSDEIEEDPTGGKIKWEQGKLNGAPNKVEEIVQFHVGDVVTCLQKASLIPGGGECLIYGTVMGSVGALLAFTSREDVDFFSHLEMHLRQEHPPLCGRDHMAYRSAYFPVKDVIDGDLCEQYPSLPADMQRKIADELDRTPGEILKKLEDIRNKII

SEQ ID NO: 17015 - protein, 1227 aa, Hordeum vulgare
MYLYSLTLQRATGAVCAVIGSFSGRDSKKSNAAGSSTQEIAVARGGTLDLLRPDPETGRLRTLLSVDVFGAIRSLAQFRLTGATKDYLVVGSDSGRLVILEYSPDRNRFDKVHQETFGKSGCRRIVPGQLLSVDPKGRALCIAALEKQKLVYVLNRDASARLTISSPLEAHKSHTLTFALTALDCGFDNPVFGAIELEYGDSDRDPTGQAASHAQKLLTFYELDLGLNHVSRKVSEPIDNGANMLVTVPGGADGPSGLLVCCDNFVLYRNQGHPEVRAVIPRRVDLPAERGVLIVAAATHRQKSLFFFLLQTEYGDIFKVDLDHHGDTVSELRIKYFDTIPVASAICVLRSGFLFAASEFGNHALYQFRDIGRDVDVESSSATLMETEEGFQPVFFQPRALKNLVRIDEIESLMPIMDMRIANLFDEETPQVYTACGRGSRSTLRILRPGLAISEMARSMLPAEPIAVWTVKKNINDMFDAYIVVSFANVTLVLSIGETIEEVSDSHFLDTTHSLAVSLLGEDSLMQVHPNGIRHIREDGRVNEWRTPGKKTITKVGSNRLQVVIALSGGELIYFEMDMTGQLMEVEKQDMSGDVACLAIAPVPEGRQRSRFLAVGSYDNTIRILSLDPDDCLQPLSVQSVSSAPESLLFLEVQASVGGEDGADYPANLFLNAGLQNGVLFRTNVDMVTGQLSDTRSRFLGLRPPKLFPCIVSHRQAMLCLSSRPWLGYIHQGHFLLTPLSCDTLESAASFSSDQCSEGVVAVAGDALRIFTIERLGETFNETSIPLRYTPRKFVILPKKKYLAVIESDKGAFSAEQREAAKKECLEAAGSAENGNGNGDQMENGDGQEDGEESNTLPDEQYGYPKAESEKWVSCIRILDPRSRDTTCLLELQDNEAAVSICTVNFHDKEHGTLLAVGTTKGLQFWPKRSLASGFIHIYKFVNEGKSLELLHKTQVEEVPLSLCQFQGRLLAGVGSVLRLYDLGKRKLLRKCENKLFPRTIVSIHTYRDRIYVGDMQESFHYCKYRRDENQLYIFADDSVPRWLTAANHIDFDTMAGADKFGNIYFARLPQDLSDEIEEDPTGGKIKWEQGKLNGAPNKVEEIVQFHVGDVVTCLQKASLIPGGGECLIYGTVMGSVGALLAFTSREDVDFFSHLEMHLRQEHPPLCGRDHMAYRSAYFPVKDVIDGDLCEQYPSLPADMQRKIADELDRTPGEILKKLEDIRNKII

SEQ ID NO: 17016 - protein, 1227 aa, Triticum aestivum
MYLYSLTLQRATGAVCAVIGSFSGRDSKKSNAAGSSTQEIAVARGGTLDLLRPDPETGRLRTLLSVDVFGAIRSLAQFRLTGATKDYLVVGSDSGRLVILEYSPDRNRFDKVHQETFGKSGCRRIVPGQLLSVDPKGRALCIAALEKQKLVYVLNRGASARLTISSPLEAHKSHTLTFALTALDCGFDNPVFGAIELEYGDSDRDPTGQAASHAQKLLTFYELDLGLNHVSRKVSEPIDNGANMLVTVPGGADGPSGLLVCCDNFVLYRNQGHPEVRAVIPRRVDLPAERGVLIVAAATHRQKSLFFFLLQIEYGDIFKVDLDHHGDTVSELRIKYFDTIPVASAICVLRSGFLFAASEFGNHALYQFRDIGRDVDVESSSATLMETEEGFQPVFFQPRALKNLVRIDEIESLMPIMDMRIANLFDEETPQVYTACGRGSRSTLRILRPGLAISEMARSMLPAEPIAVWTVKKNINDMFDAYIVVSFANVTLVLSIGETIEEVSDSQFLDTTHSLAVSLLGEDSLMQVHPNGIRHIREDGRVNEWRTPGKKTITKVGSNRLQVVIALSGGELIYFEMDMTGQLMEVEKQDMSGDVACLAIAPVPEGRQRSRFLAVGSYDNTIRILSLDPDDCLQPLSVQSVSSAPESLLFLEVQASVGGEDGADYPANLFLNAGLQNGVLFRTNVDMVTGQLSDTRSRFLGLRPPKLFPCIVSHRQAMLCLSSRPWLGYIHQGHFLLTPLSCDTLESAASFSSDQCSEGVVAVAGDALRIFTIERLGETFNETSIPLRYTPRKFVILPKKKYLAVIESDKGAFSAEQREAAKKECLEAAGAAENGNGNGDQMENGDGQEDGEESNALPDEQYGYPKAESEKWASCIRILDPRSRDTTCLLELQDNEAAVSICTVNFHDKEHGTLLAVGTTKGLQFWPKRSLASGFIHIYKFVNEGKSLELLHKTQVEEVPLSLCQFQGRLLAGVGSVLRLYDLGKRKLLRKCENKLFPRTIVSIHTYRDRIYVGDMQESFHYCKYRRDENQLYIFADDSVPRWLTAANHIDFDTMAGADKFGNIYFARLPQDLSDEIEEDPTGGKIKWEQGKLNGAPNKVEEIVQFHVGDVVTCLQKASLIPGGGECLIYGTVMGSVGALLAFTSREDVDFFSHLEMHLRQEHPPLCGRDHMAYRSAYFPVKDVIDGDLCEQYPALPADMQRKIADELDRTPGEILKKLEDIRNKII

SEQ ID NO: 17017 - protein, 1223 aa, Triticum aestivum
SLTLQRATGAVCAVIGSFSGRDSKKSNAAGSSTQEIAVARGGTLDLLRPDPETGRLRTLLSVDVFGAIRSLAQFRLTGATKDYLVVGSDSGRLVILEYSPDRNRFDKVHQETFGKSGCRRIVPGQLLSVDPKGRALCIAALEKQKLVYVLNRDASARLTISSPLEAHKSHTLTLALTALDCGFDNPVFGAIELEYGDSDRDPTGQAASHAQKLLTFYELDLGLNHVSRKVSEPIDNGANMLVTVPGGADGPSGLLVCCDNFVLYRNQGHPEMRAVIPRRVDLPAERGVLIVAAATHRQKSLFFFLLQTEYGDIFKVDLDHHGDTVSELRIKYFDTIPVASAICVLRSGFLFAASEFGNHALYQFRDIGRDVDVESSSATLMETEEGFQPVFFQPRALKNLVRIDEIESLMPIMDMRIANLFDEETPQVYTACGRGSRSTLRILRPGLAISEMARSMLPAEPIAVWTVKKNINDMFDAYIVVSFANVTLVLSIGETIEEVSDSQFLDTTHSLAVSLLGEDSLMQVHPNGIRHIREDGRVNEWRTPGKKTITKVGSNRLQVVIALSGGELIYFEMDMTGQLMEVEKQDMSGDVACLAIAPVPEGRQRSRFLAVGSYDNTIRILSLDPDDCLQPLSVQSVSSAPESLLFLEVQASVGGEDGADYPANLFLNAGLQNGVLFRTNVDMVTGQLSDTRSRFLGLRPPKLFPCIVSHRQAMLCLSSRPWLGYIHQGHFLLTPLSCDTLESAASFSSDQCSEGVVAVAGDALRIFTIERLGETFNETSIPLRYTPRKFVILPKKKYLAVIESDKGAFSAEQREAAKKECLEAAGAAENGNGNGDQMENGDGQEDGEESNALPDEQYGYPKAESEKWVSCIRILDPRSRDTTCLLELQDNEAAVSICTVNFHDKEHGTLLAVGTTKGLQFWPKRSLASGFIHIYKFVNEGKSLELLHKTQVEEVPLSLCQFQGRLLAGVGSVLRLYDLGKRKLLRKCENKLFPRTIVSIHTYRDRIYVGDMQESFHYCKYRRDENQLYIFADDSVPRWLTAANHIDFDTMAGADKFGNIYFARLPQDLSDEIEEDPTGGKIKWEQGKLNGAPNKVEEIVQFHVGDVVTCLQKASLIPGGGECLIYGTVMGSVGALLAFTSREDVDFFSHLEMHLRQEHPPLCGRDHMAYRSAYFPVKDVIDGDLCEQYPALPADMQRKIADELDRTPGEILKKLEDIRNKII

SEQ ID NO: 17018 - protein, 1161 aa, Panicum virgatum
FGVIRSLAQFRLTGANKDYLVVGSDSGRLVILEYSPDRNRFDKVHQETFGKSGCRRIVPGQLLAVDPKGRALCIAALEKQKLVYVLNRDAAARLTISSPLEAHKSNTITFSLTALDCGFDNPIFAAIELEYAESDRDPTGQAANQAQKLLTFYELDLGLNHVSRKASEPIDNGANLLVTVPGGGDGPSGVLVCCDNFVLYRNQGHPEVRAVIPRRADLPAERGVLIVAAATHRQKSMFFFLLQTEYGDIFKVDLEHSGETVTELRIKYFDTIPVASATCVLRSGLLFAASEFGNHALYQFRDIGRDADVESSSATLMETEEGFQPVFFQPRPLKNLIRIDEIESLMPVMDMRIANLFDEETPQLFTACGRGPRSTLRILRPGLAISEMARSMLPAEPIAVWTVKKNINDMFDAYIVVSFANVTLVLSIGETIEEVSDSQFLDTTHSLAVTLLGEDSLMQVHPNGIRHIREDGRVNEWRTPGKKTITKVGSNRLQVVIALSGGELIYFEMDMTGQLMEVEKQDMSGDVACLAIAPVPEGRQRSRFLAVGSYDNTIRILSLDPDDCLQPLSVQSVSSAPESLLFLEVQASVGGEDGADYPANLFLNAGLQNGVLFRTNVDMVTGQLSDTRSRFLGLRPPKLFPCIVSHRQAMLCLSSRPWLGYIHQGHFLLTPLSCDTLESAASFSSDQCSEGVVAVAGDALRIFTIERLGETFNETAIPLRYTPRKFVILPKKKYIAVIESDKGAFSAEEREAAKKECLEASGATENGNANNGDPMENGDGQEDGAEEGNTFPDEQYGYPKAESERWVSCIRILDPRSRDTTCLLELQDNEAAVSICTVNFHDKEHGTLLAVGTAKGLQFWPKRTLAGGFIHIYKFVDEGKSLELLHKTQVEEVPLALCQFQGRLLAGVGSVLRLYDLGKRKLLRKCENKLFPRTIISIHTYRDRIYVGDMQESFHYCKYRRDENQLYIFADDSVPRWLTAAQHIDFDTMAGADKFGNIYFARLPQDISDEIEEDPTGGKIKWEQGKLNGAPNKVEEIVQFHVGDVVTSLQKASLIPGGGECLIYGTVMGSVGALLAFTSREDVDFFSHLEMHLRQEHPPLCGRDHMAYRSAYFPVKDVIDGDLCEQYPSLPADMQRKIADELDRTPGEILKKLEDIRNKII

SEQ ID NO: 17019 - protein, 1112 aa, Secale cereale
TFGKSGCRRIVPGQLLSVDPKGRALCIAALEKQKLVYVLNRDASARLTISSPLEAHKSHTLTFALTALDCGFDNPVFGAIELEYGDSDRDPTGQAASHAQKLLTFYELDLGLNHVSRKVSEPIDNGANMLVTVPGGADGPSGLLVCCDNFVLYRNQGHPEVRAVIPRRVDLPAERGVLIVAAATHRQKSLFFFLLQTEYGDIFKVDLDHHGDTVSELRIKYFDTIPVASAICVLRSGFLFAASEFGNHALYQFRDIGRDVDVESSSATLMETEEGFQPVFFQPRALKNLVRIDEIESLMPIMDMRIANLFDEETPQVYTACGRGSRSTLRILRPGLAISEMARSMLPAEPIAVWTVKKNINDMFDAYIVVSFANVTLVLSIGETIEEVSDSQFLDTTHSLAVSLLGEDSLMQVHPNGIRHIREDGRVNEWRTPGKKTITKVGSNRLQVVIALSGGELIYFEMDMTGQLMEVEKQDMSGDVACLAIAPVPEGRQRSRFLAVGSYDNTIRILSLDPDDCLQPLSVQSVSSAPESLLFLEVQASVGGEDGADYPANLFLNAGLQNGVLFRTNVDMVTGQLSDTRSRFLGLRPPKLFPCIVSHRQAMLCLSSRPWLGYIHQGHFLLTPLSCDTLESAASFSSDQCSEGVVAVAGDALRIFTIERLGETFNETSIPLRYTPRKFVILPKKKYLAVIESDKGAFSAEQREAAKKECLEAAGAAENGNGNGDQMENGDGQEDGEESNTLPDEQYGYPKAESEKWVSCIRILDPRSRDTTCLLELQDNEAAVSICTVNFHDKEHGTLLAVGTTKGLQFWPKRSLASGFIHIYKFVNEGKSLELLHKTQVEEVPLSLCQFQGRLLAGVGSVLRLYDLGKRKLLRKCENKLFPRTIVSIHTYRDRIYVGDMQESFHYCKYRRDENQLYIFADDSVPRWLTAANHIDFDTMAGADKFGNIYFARLPQDLSDEIEEDPTGGKIKWEQGKLNGAPNKVEEIVQFHVGDVVTCLQKASLIPGGGECLIYGTVMGSVGALLAFTSREDVDFFSHLEMHLRQEHPPLCGRDHMAYRSAYFPVKDVIDGDLCEQYPALPADMQRKIADELDRTPGEILKKLEDIRNKII

SEQ ID NO: 17020 - protein, 1221 aa, Ananas comosus
MYLYSLTLQRATGVVCATIGSFVGGGKSQEIVVGRGKTLDLLRPDENGKIQTLHSVEVFGAIRSLAQFRLTGSQKDYVVVGSDSGRIVILEYSRERNCFDKVHQETFGKSGCRRIVPGQYLAVDPKGRAVMIAACEKQKLVYVLNRDTAARLTISSPLEAHKSHTVTYSVVGVDCGFDNPVFAAIELDYSEADRDASGQAAAEAQKHLTFYELDLGLNHVSRKWSEPVDNGANLLVTVPGGGDGPSGVLVCAENFIIFRNQGHPEVRAVIPRRADLPAERGVLIVSAATHRQKSMFFFLLQTEYGDIFKVTLEHEGDRVSELKIKYFDTVPVTSAICVLRAGFLFAASEFGNHMLYQFKAIGDGEDVESSSATLMETEEGFQPVFFQPRPLRNLLKIEHMESLMPIMDMRVVNLFEEETPQIFTLCGRGPRSSLRILRPGLAVSEMAVSQLPGIPNAVWTVKKNVNDEFDAYIVVSFANATLVLSIGETVEEVSNSKFLDTTPSLAVSLLGDDSLMQVHPSGIRHIREDGRVNEWKTPGKKTIVKVGLNRLQVVIALSGGELIYFEMDMTGQLMEVDKHEMPGDVACLDIAPVPEGRQRSRFLAVGSYDNTIRILSLDPDDCMHVLSVQSVSSPPESLLLLEVRASTGGDDGAAHPGSVFLNAGLQNGVLFRTVVDMVTGQLSDPRSRFLGLRAPKLFSTVVRGRQAMLCLSSRPWLGYIHQGHFLLTPLSYETLEYAASFSSDQCAEGVVAVAGDALRVFTIERLGETFNETVIPLRYTPRKFVLLTKRKYLAIIESDQGAFTADERETARKECLAAARMNENGNTNNRDQKENGARADNEEEAEEEDPFPDEQYGYPKAESDKWVSCIRILDPRIGNTTCLLELQENEAAFSICTVNFHDKEYGTLLAVGTAKGLNFWPKRCLTSGFIHIYKFVEEGKSLELVHKTQVEEVPLALCQFQGRLLAGIGPVLRLYDLGKRKLLRKCENKLFPRTIVSIHTYRDRIYIGDIQESFHYCKYRRDENQLYIFADDSVPRWLTASHHIDFDTMAGADKFGNVYFVRLPQDVSDEIEEDPTGGKIKWEQGKLNGAPNKVEEIVQFHVGDVVTCLQKASLIPGGGDCIIFGTVMGSLGALLAFTSREDVDFFSHLEMHMRQEHPPLCGRDHMAFRSAYFPVKDVIDGDLCEQFPALPPDLQRKIADELDRTPGEILKKLEDIRNKII

SEQ ID NO: 17021 - protein, 1217 aa, Musa acuminata
MYLYSLTLQRPGGVVCATNGNFVGGKTQEIVVARGKTLDLLRPDESGKLQTLLSVEVFGAIRSLAQFRLTGSQKDYVVVGSDSGRLVILEYSRERNVFHKVHQETFGKSGCRRIVPGQFLAVDPKGRAAMVAACEKQKLVYVLNRDAAARLTISSPLEAHKSHTITYSVTGVDCGFDNPVFAAIELDYSEADIDPTGQAAADAQKHLTFYELDLGLNHVSRKWSEPVDNGANLLVTVPGGGDGPSGVLVCAENFVIYKNQGHPDVRAVIPRRADLPAERGVLVVSAATHRQKSMFFFLLQTEYGDIFRVTLEHEGDRVTELKIKYFDTIPVTSSMSVLKTGFLFAASEFGNHALYQFQAIGEAEDVEASSATLMETEEGFQPVFFQPRGLKNLVRIDQVESLMPIMDMRVMNLFEEETPQVFTLCGRGPRSSLRILRPGLAINEMAVSQLPGTPSAVWTVKKNVNDEFDAYIVVSFVNATLVLSIGETIEEVSDSGFLDTTPSLSVSLLGDDSLMQVHPNGIRHIREDGRINEWKTPGKKTIVKVGLNRLQVVIALSGGELIYFEMDMTGQLMEVEKHEMPGDVACLDIAPVPEGRHRSRFLAVGSYDNTIRILSLDPDDCMQILSVQSVSSPPESLLLLEVQASTGGEDGADHPASVFLNAGLQNGVLFRTVVDMVTGQLSDTRSRFLGLRAPKLFSATVRGRQAMLCLSSRPWLGYIHQGHFLLTPLSYETLEYAASFSSDQCAEGVVAVAGEALRIFTIERLGETFNETVVPLRYTPRKFVLQPRCKHLVIIESDQGAFTAEEREAARKECLEAAKMGENGNANNRQQMENGGGAGDDDEDDALSDEQYGYPKAESDKWVSCIRVLDPRTGNTTCLLELQENEAAFSLCTVNFHDKEYGTLLAVGTAKGLQFWPKRSLAAGFIHIYRFVEEGKSLELVHKTQVEGVPLTLCQYQGRLLAGIGSVLRLYDLGKRRLLRKCENKLFPNTIVSMHTYRDRIYVGDIQESFHYCKYRRDENQLYIFADDSVPRWLTASHHIDFDTMAGADKFGNIYFVRLPQDLSDEIEEDPTGGKIKWEQGKLNGAPNKMEEIVQFHVGDVVTCLQKASLIPGGGECVIYGTVMGSLGALLPFTSREDVDFFSHLEMHMRQEHPPLCGRDHMAFRSAYFPVKDVIDGDLCEQFPTLPPDLQRKIADELDRTPGEILKKLEDVRNKII

SEQ ID NO: 17022 - protein, 1214 aa, Manihot esculenta
MYLYSLTLQRATGIISAINGSFSGGKTQEIVVARGKVLDLLRPDENGKLQTLLSVEIFGAIRSLAQFRLTGSQKDYIAVGSDSGRIVILEYNKERNVFDKIHQETFGKSGCRRIVPGQYLAIDPKGRAVMIGACEKQKLVYVLNRDTAARLTISSPLEAHKSHTIVYSICGVDCGFDNPIFAAIELDYSEADQDSTGQAASEAQKHLTFYELDLGLNHVSRKWSEQVDNGANMLVTVPGGGDGPSGVLVCAENFVIYKNEGHPDVRAVIPRRADLPAERGVLVVSAATHKQKSMFFFLLQTEYGDIFKVTLDHENDKVKELKIKYFDTIPVTASMCVLKSGFLFAASEFGNHALYQFQAIGEEADVEASSATLMETEEGFQPVFFQPRGLKNLVRIDQVESLMPIMDMKVFNLFDEETPQIFSLCGRGPRSSLRILRPGLAISEMAVSQLPGVPSAVWTVKKNVNDEFDAYIVVSFNNATLVLSIGETVEEVSDSGFLDTTPSLAVSLIGDDSLMQVHPNGIRHIREDGRINEWRTPGKRTIVKVGSNRLQVVIALSGGELIYFEVDVTGQLMEVEKHEMSGDVACLDIAPVPEGRQRSRFLAVGSYDNTIRILSLDPDDCMQILSVQSVSSPPESLLFLEVQASVGGEDGADHPASLFLNAGLQSGVLFRTVVDMVTGQLSDSRSRFLGLRAPKLFSIIVRDRRAMLCLSSRPWLGYIHQGHFLLTPLSYETLEFAASFSSDQCAEGVVAVAGDALRIFTIERLGETFNETAIPLRYTPRKFVVLPKKKLLVVIESDQGAYAAEEREAAKKECFEAAGMGENGSANADQMENGGDDEDKDDPLSDEQYGYPKAESEKWVSCIRVLDPRTASTTCLLELQDNEAAFSVCTVNFHDKEHGTLLAVGTAKGLQFWPKRSLVAGFIHIYKFVDDGRTLELLHKTQVEGVPLALCQFQGRLLAGIGPVLRLYDLGKKRLLRKCENKLFPNTIVSIHTYRDRIYVGDIQESFHFCKYRRDENQLYIFADDCVPRWLTATSHIDFDTVAGADKFGNIYFVRLPQDVSDEIEEDPTGGKIKWEQGKLNGAPNKVEEIVQFHVGDVITSLHKASLIPGGGECIIYGTVMGSLGALLPFTSRDDVDFFSHLEMHLRQDHPPLCGRDHMAFRSAYFPVKDVIDGDLCEQFPTLPLDAQRKIADELDRTPGEILKKLEEIRNKII

SEQ ID NO: 17023 - protein, 1213 aa, Manihot esculenta
MYLYSLTLQRATGIVSAINGSFSGGKTQEIVVARGKVLDLLRPDENGKLQTILSVEIFGAIRSLAQFRLTGAQKDYIVVGSDSGRIVILEYNKERNVFDKIHQETFGKSGCRRIVPGQFLAIDPKGRAVMIGACEKQKLVYVLNRDTAARLTISSPLEAHKSHTIVYSICGVDCGFDNPIFAAIELDYSEADQDSTGQAASEAQKHLTFYELDLGLNHVSRKWSEQVDNGANMLVTVPGGGDGPSGVLVCAENFVIYKNEGHPDVRAVIPRRADLPAERGVLIVSAATHKQKSMFFFLLQTEYGDIFKVTLDHENDKVKELKIKYFDTIPVTSSMCVLKSGFLFAASEFGNHALYQFQAIGEEADVEASSATLMETEEGFQPVFFQPRGLKNLVRIDQVESLMPIMDMKVANLFDEETPQIFSLCGRGPRSSLRILRPGLAISEMAVSQLPGVPSAVWTVKKNVNDEFDAYIVVSFNNATLVLSIGETVEEVSDSGFLDTTPSIAVSLIGDDSLMQVHPNGIRHIREDGRINEWRTPGKRTIVKVGSNRLQVVIALSGGELIYFEVDVTGQLMEVEKHEMSGDVACLDIAPVPEGRQRSRFLAVGSYDNTIRILSLDPDDCMQILSVQSVSSPPESLLFLEVQASVGGEDGADHPASLFLNAGLQSGVLFRTVVDMVTGQLSDSRSRFLGLRAPKLFSIIVRGRRAMLCLSSRPWLGYIHQGHFLLTPLSYETLEFAASFSSDQCAEGVVAVAGDALRIFTIERLGETFNETAIPLRYTPRKFVLQPKKKLLIIIESDQGAYTAEEREAAKKECFEAAGMGENGSANDQMENGGDDEDKDDPLSDEQYGYPKTESEKWVSCIRVLEPRTASTTCLLELQDNEAAFSVCTVNFHDKEHGTLLAVGTAKGLQFWPKRSLVAGFIHIYKFVDDGRTLELLHKTQVEGVPLALCQFQGRLLAGIGSVLRLYDLGKKRLLRKCENKLFPNSIVSIHTYRDRIYVGDIQESFHFCKYRRDENQLYIFADDCVPRWLTASYHIDFDTMAGADKFGNVYFVRLPQDVSDEIEEDPTGGKIKWEQGKLNGAPNKVEEIVQFHVGDVITSLHKASLIPGGGECIIYGTVMGSLGALLPFTSRDDVDFFSHLEMHLRQDHPPLCGRDHMAYRSAYFPVKDVIDGDLCEQFPTLPLDMQRKIADELDRTPGEILKKLEEVRNKII

SEQ ID NO: 17024 - protein, 1213 aa, Populus trichocarpa
MYLYSLTLQRATGIVSAINGNFSGGKAQEIVVARGKVLDLLRPDENGKLQTVLSVEIFGAIRSLAQFRLTGAQKDYIVVGSDSGRIVILEYNKERNVFDKIHQETFGKSGCRRIVPGQYLAVDPKGRAVMIGACEKQKLVYVLNRDTVARLTISSPLEAHKSHTICYSVCGVDCGFDNPIFAAIELDYSEADQDSTGQAAGEAQKNLTFYELDLGLNHVSRKWSEQVDNGANMLVTVPGGGDGPSGILVCAENFVIYKNQGHPDVRAVIPRRADLPAERGVLIVSAATHKQKSMFFFLLQTEYGDIFKVTLDHENDKVKELKIKYFDTIPVTSSICVLKSGFLFAASEFGNHALYQFQAIGEEEDVEASSATLMETEEGFQPVFFQPRGLKNLVRIDQVESLMPVMDMKVANIFDEETPQIFSLCGRGPRSSLRILRPGLAISEMAVSQLPGVPSAVWTVKRNANDEFDAYIVVSFNNATLVLSIGETVEEVSDSGFLDTTPSLAVSLIGDDSLMQIHPNGIRHIREDGRINEWRTPGKRTIVKVGSNRLQVVIALSGGELIYFEVDMTGQLMEVEKHEMSGDVACLDIAPVPEGRQRSRFLAVGSYDNTIRVLSLDPDDCMQILSVQSVSAPPESLLFLEVQASIGGEDGADHPASLFLNAGLQTGVLFRTVVDMVTGQLSDSRSRFLGLRAPKLFAINVRGRRAMLCLSSRPWLGYIHQGHFLLTPLSYETLEYAASFSSDQCAEGVVAVAGDALRIFTIERLGETFNETAIPLRYTPRKFVLQPKRKLLVIIESDQGAYTAEEREAAKKECFEAAGMGENGSANAEKMENGDDDDKDDPLSDEQYGYPKAEADRWVSCIRVLDPRSATTTCLLELQDNEAAFSVCTVNFHDKEHGTLLAVGTAKGLQFWPKRSLIAGFIHIYKFVDDGKSLELLHKTQVEGVPLALCQFQGRLLAGIGSVLRLYDLGKKRLLRKCENKLFPNSIVSIHTYRDRIYVGDIQESFHFCKYRRDENQLYIFADDSVPRWLTASYHVDFDTMAGADKFGNIYFVRLPQDVSDEIEEDPTGGKIKWEQGKLNGAPNKVEEIVQFHIGDVVNSLQKASLIPGGGECIMYGTVMGSVGALLPFTSRDDVDFFSHLEMHLRQDHPPLCGRDHMAYRSAYFPVKDVIDGDLCEQFPTLPLDAQRKIADELDRTPGEILKKLEEVRNKII

SEQ ID NO: 17025 - protein, 1213 aa, Populus trichocarpa
MYLYSLTLQRATGIISAINGNFSGGKAQEIVVARGKVLDLLRPDENGKLQTVLSVEIFGAIRSLAQFRLTGAQKDYIVVGSDSGRIVILEYNKERNVLDKIHQETFGKSGCRRIVPGQYLAVDPKGRAVMIGACEKQKLVYVLNRDTVARLTISSPLEAHKSHTICYSVCGVDCGFDNPIFAAIELDYSEADQDSTGQSASEAQKNLTFYELDLGLNHVSRKWSEQVDNGANMLVTVPGGGDGPSGVLVCVENFVIYKNQGHPDVRAVIPRRADLPAERGVLIVSAATHKQKSMFFFLLQTEYGDIFKVMLDHENDKVKELKIKYFDTIPVTSSMCVLKSGFLFAASEFGNHALYQFQAIGEEEDVEASSATLMETEEGFQPVFFQPRGLKNLVRIDQVESLMPIMDMKVANLFDEETPQIFSLCGRGPRSSLRILRPGLAISEMAVSQLPGVPSAVWTVKKNIYDEFDAYIVVSFNNATLVLSIGETVEEVSDSGFLDTTPSLAVSLIGDDSLMQIHPNGIRHIREDGRINEWRTPAKRTIVKVGSNRLQVVIALSGGELIYFEVDMTGQLMEVEKHEMSGDVACLDIAPVPEGRQRSRFLAVGSYDNTIRVLSLDPDDCMQILSVQSVSAPPESLLFLEVQASIGGEDGADHPASLFLNAGLQTGVLFRTVVDMVTGQLSDSRSRFLGLRAPKLFSINVRGRRAMLCLSSRPWLGYIHQGHFLLTPLSYETLEYAASFSSDQCAEGVVSVAGDALRIFTIERLGETFNETAIPLRYTPRKFVLQPKRKLLVIIESDQGAYTAEEREAAKKECFEASGMGENGSASAEQMENGDDDDKDDPLSDEQYGYPKAESDKWVSCIRVLDPRSAATTCLLELQDNEAAFSLCTVNFHDKEHGTLLAVGTAKGLQFWPKRSLVTGFIHIYKFVDDGKSLELLHKTQVEGVPLALCQFQGRLLAGIGSVLRLYDLGKKRLLRKCENKLFPNTIVSIHTYRDRIYVGDIQESFHFCKYRRDENQLYIFADDSVPRWLTSSYHVDFDSMAGADKFGNIYFARLPQDVSDEIEEDPTGGKIKWEQGKLNGAPNKVEEIVQFHIGDVVNSLQKASLIPGGGECIIYGTVMGSVGALLPFTSRDDVDFFSHLEMHLRQDHPPLCGRDHMSYRSAYFPVKDVIDGDLCEQFPTLPLDAQRKIADELDRTPGEILKKLEEVRNKII

SEQ ID NO: 17026 - protein, 1214 aa, Vitis vinifera
MYLYSLTLQQATGIVCAINGNFSGGKSQEIVVARGKVLDLLRPDENGKIQTILSVEIFGAIRSLAQFRLTGSQKDYIVVGSDSGRIVILEYNKEKNVFDKIHQETFGKSGCRRIVPGQYLAIDPKGRAVMIGACEKQKLVYVLNRDTVARLTISSPLEAHKSHTIVYSITGVDCGFDNPIFAAIELDYSEADQDSTGQAASEAQKHLTFYELDLGLNHVSRKWSEQVDNGANMLVTVPGGGDGPSGVLVCAENFVIYKNQGHPDVRAVIPRRADLPAERGVLIVSAATHRQKSMFFFLLQTEYGDVFKVTLEHENDRISELKIKYFDTIPVTSSMCVLKSGFLFAASEFGNHGLYQFQAIGDDADVESSSASLMETEEGFQPVFFQPRGLKNLVRIDQVESLMPIMDMKVSNLFEEETPQIFALCGRGPRSSIRILRPGLAISEMAVSQLPGVPSAVWTVKKNVNDEFDAYIVVSFANATLVLSIGETVEEVSDSGFLDTTPSLAVSLIGDDSLMQVHPSGIRHIREDGRINEWRTPGKRTIVKVGSNRLQVVIALSGGELIYFEVDMTGQLMEVEKHEMSGDVACLDIAPVPEGRQRSRFLAVGSYDNTIRILSLDPDDCMQILSVQSVSSPPESLLFLEVQASVGGEDGADHPASLFLNAGLQNGVLFRTVVDMVTGQLSDARSRFLGLRAPKLFSVIVRGRRAMLCLSSRPWLGYIHQGHFLLTPLSYETLEFAASFSSDQCAEGVVAVAGDALRVFTIERLGETFNETVIPLRYTPRKFVLQPKRKLLVVIESDQGAFAAEEREAAKKECFEAAGMGENGNGNVEQMENGGDDEDKDDPLSDEQYGYPKAESDKWVSCIRILDPRTATTTCLLELQDNEAAFSICTVNFHDKEYGTLLAVGTAKSLQFWPKRSFDAGYIHIYRFLEDGKSLELLHKTQVEGVPLALCQFQGRLLAGIGSVLRLYDLGKRRLLRKCENKLFPNTIVSIHTYRDRIYVGDIQESFHYCKYRRDENQLYIFADDSVPRWLTASYHIDFDTMAGADKFGNIYFVRLPQDVSDEVEEDPTGGKIKWEQGKLNGAPNKVEEIVQFHVGDVVTCLQKASLIPGGGECIIYGTVMGSLGALLAFTSRDDVDFFSHLEMHMRQEHPPLCGRDHMAYRSAYFPVKDVIDGDLCEQFPTLPLDLQRKIADELDRTPGEILKKLEEVRNKII

SEQ ID NO: 17027 - protein, 1211 aa, Nicotiana benthamiana
MYLYSLTLQKPTGILCAINGSFSGGKVQEIAVARGKVLDLLRPDDNGKLQTLLSVEIFGAIRSLAQFRLTGAQKDYIVVGSDSGRIVILEYNKEKNVFDKVHQETFGKSGCRRIVPGQYVGIDPKGRAVMIGACEKQKLVYVLNRDTAARLTISSPLEAHKSHTITFSICGVDCGFDNPIFAAIELDYAEADQDPTGQAANEAQKHLTFYELDLGLNHVSRKWSEQVDNGANLLVTVPGGGDGPSGVLVCAENFVIYKNQGHPDVRAVIPRRVDLPAERGVLIVSAAMHKQKSMFFFLLQTEYGDIFKVTLDHDNDRVKELKIKYFDTIPVSSSLCVLKSGFLFAASEFGNHALYQFQAIGDDPDVEASSSTLMETEEGFQPVFFQPRKLKNLVRIDQIESLMPIMDMKIVNLFEEETPQIFSLCGRGPRSSLRILRPGLAVSEMAVSQLPGVPSAVWTVKKNVNDEFDAYIVVSFANATLVLSIGETVEEVSDSGFLDTTPSLAVSLIGDDSLMQVHPSGIRHIREDGRINEWRTPGKRIIVKVGSNRLQVVIALSGGELIYFEVDMTGQLMEVEKHEMSGDVACLDIAPVPEGRQRSRFLAVGSYDNTIRILSLDPDDCMQVLSLQSVSSPPESLLFLEVQASIGGEDGADHPASLFLNAGLQNGVLFRTVVDMITGQLSDARSRFLGLRAPKLFSIVVRGRRAMLCLSSRPWLGYIHQGHFLLTPLSYETLEFAASFSSDQCAEGVVAVAGDALRVFTIERLGETFNETAIPLRYTPRRFVLQPKRKMVIMIESDQGAYTAEEREAAKKECFETAGNGENGNAEQVENGEDEDGNDPLSDEQYGYPKSESGRWVSCIRVLDPRSTQTTCLLELQDNEAAFSICTVNFHDKEHGALLAVGTAKGLQFWPKKSFEAAYIHIYKFKEDGKVLELLHKTQVDGVPLALCQFQGRLLAGVGSVLRLYDLGKKRLLRKCENKLFPNSITSIHTYRDRIYVGDMQESFHYCKYRRDENQLYIFADDMVPRWLTAAQHVDFDTVAGADKFGNIYFVRLPQDVSDEIEEDPTGGKIKWEQGKLNGAPNKVEEIVQFHVGDVVSCLQRASLIPGGGECVIYGTVMGSVGAMLPFTSRDDVDFFSHLEMHLRQEFPPLCGRDHMAYRSAYFPVKDVIDGDLCEQFPTLPMDMQRKIADELDRTPGEILKKLEEIRNKII

SEQ ID NO: 17028 - protein, 1214 aa, Cucumis sativus
MYLYSLTLQRATGIVSAINGNFSGGKTQEIVVARGKVLDLIRPDDSGKIQTLLSVEIFGAIRSLAQFRLTGSQKDYIVVGSDSGRIVILEYNKDKNVFDKIHQETFGKSGCRRIVPGQYLAIDPKGRAVMIGACEKQKLVYVLNRDTAARLTISSPLEAHKSHTIVYSICGIDCGFDNPIFAAIELDYSEADQDSTGVAASEAQKHLTFYELDLGLNHVSRKWSEPVDNGANMLVTVPGGGDGPSGVLVCAENFVIYKNQGHPDVRAVIPRRADLPAERGVLIVSAAMHKQKTMFFFLLQTEYGDIFKVTLEHNNDSVKELKIKYFDTIPVTASMCVLKSGFLFAASEFGNHSLYQFQAIGEDADVESSSATLMETEEGFQPVFFQPRRLKNLMRIDQVESLMPIMDMKIINLFEEETPQIFTLCGRGPRSSLRILRPGLAISEMAVSELPGVPSAVWTVKKNINDEFDAYIVVSFANATLVLSIGETVEEVSDSGFLDTTPSLAVSLIGDDSLMQVHPNGIRHIREDGRINEWRTPGKRTIVKVGSNRLQVVIALSGGELIYFEVDMTGQLMEVEKHEMSGDVACLDIAPVPEGRQRSRFLAVGSYDNTIRILSLDPDDCMQILSVQSVSAAPESLLFLEVLASVGGEDGADHPASLFLNAALHSGVLFRTVVDMVTGQLSDSRSRFLGLRAPKLFSVVLRGRRAILCLSSRPWLGYIHQGHFLLTPLSYETLEYASSFSSDQCAEGVVAVAGNFLRVFTIERLGETFNETVIPLRYTPRKFVLQPRRKLLVVIESDQGAFTAEEREAAKKECFEAAGAGENGNGTMDQMENGGDDEDKDDPLSDEHYGYPKAESEKWVSCIRVLDPRSATTTCLLELQDNEAAFSVCTVNFHDKEYGTLLAVGTAKGLQFFPKRSLVAGYIHIYRFLEDGKSLELLHKTQVEGVPLALAQFQGRLLAGLGSVLRLYDLGKRRLLRKCENKLFPNTIVSIQTYRDRIYVGDIQESFHYCKYRRDENQLYIFADDSVPRWLTASYHVDFDTMAGADKFGNIYFVRLPQDVSDEIEEDPTGGKIKWEQGKLNGAPNKVEEIIQFHIGDVVTSLQKASLIPGGGECILYGTVMGSLGALHAFTSRDDVDFFSHLEMHMRQEHPPLCGRDHMGYRSAYFPVKDVIDGDLCEQFPSLPLDMQRKIADELDRTPGEILKKLEEVRNKII

SEQ ID NO: 17029 - protein, 1215 aa, Nicotiana benthamiana
MYLYSLTLQKPTGILCAINGSFSGGKVQEIAVARGKVLDLLRPDDNGKLQTLLSVEIFGAIRSLAQFRLTGAQKDYIVVGSDSGRIVILEYNKEKNVFDKIHQETFGKSGCRRIVPGQYVGIDPKGRAVMIGACEKQKLVYVLNRDTAARLTISSPLEAHKSHTITFSICGVDCGFDNPIFAAIELDYAEADQDPTGQAANEAQKHLTFYELDLGLNHVSRKWSEQVDNGANLLVTVPGGGDGPSGVLVCAENFVIYKNQGHPDGHPDVRAVIPRRVDLPAERGVLIVSAAMHKQKSMFFFLLQTEYGDIFKVTLDHDNDRVKELKIKYFDTIPVSSSLCVLKSGFLFSASEFGNHALYQFQAIGDDPDVEASSSTLMETEEGFQPVFFQPRKLKNLVRIDQIESLMPIMDMKIVNLFEEETPQIFSLCGRGPRSSLRILRPGLAVSEMAVSQLPGVPSAVWTVKKNVNDEFDAYIVVSFANATLVLSIGETVEEVSDSGFLDTTPSLAVSLIGDDSLMQVHPSGIRHIREDGRINEWRTPGKRIIVKVGSNRLQVVIALSGGELIYFEVDMTGQLMEVEKHEMSGDVACLDIAPVPEGRQRSRFLAVGSYDNTIRILSLDPDDCMQVLSLQSVSSPPESLLFLEVQASIGGEDGADHPASLFLNAGLQNGVLFRTVVDMITGQLSDARSRFLGLRAPKLFSIVVRGRRAMLCLSSRPWLGYIHQGHFLLTPLSYETLEFAASFSSDQCAEGVVAVAGDALRVFTIERLGETFNETAIPLRYTPRRFVLQPKRKMVIMIESDQGAYTAEEREAAKKECFETAGNGENGNAEQVENGEDEDGNDPLSDEQYGYPKSESGRWVSCIRVLDPRSTQTTCLLELQDNEAAFSICTVNFHDKEHGALLAVGTAKGLQFWPKKSLEAAYIHIYKFKEDGKVLELLHKTQVDGVPLALCQFQGRLLAGVGSVLRLYDLGKKRLLRKCENKLFPNSITSIHTYRDRIYVGDMQESFHYCKYRRDENQLYIFADDMVPRWLTAAQHVDFDTVAGADKFGNIYFVRLPQDVSDEIEEDPTGGKIKWEQGKLNGAPNKVEEIVQFHVGDVVSCLQRASLIPGGGECVIYGTVMGSVGAMLPFTSRDDVDFFSHLEMHLRQEFPPLCGRDHMAYRSAYFPVKDVIDGDLCEQFPTLPMDMQRKIADELDRTPGEILKKLEEIRNKII

SEQ ID NO: 17030 - protein, 1214 aa, Ricinus communis
MYLYNLTLQRATGIITAINGNFSGGKTQEIVVARGKVLDLLRPDENSGKLQTILSVEIFGAIRSLAQFRLTGSQKDYIVVGSDSGRIVILEYNKERNVFDKIHQETFGKSGCRRIVPGQYLAIDPKGRAVMIGACEKQKLVYVLNRDTAARLTISSPLEAHKSHTIVYSICGVDCGFDNPIFAAIELDYSEADLDSTGQAANEAQKVLTFYELDLGLNHVSRKWSEQVDNGANMLVTVPGGGDGPSGVLVCAENFVIYKNEGHPDVRAVIPRRADLPAERGVLIVSAATHRQKSMFFFLLQTEYGDIFKVTLDHENDKVKELKIKYFDTIPVTSSMCVMKLGFLFAASEFGNHALYQFQAIGEEADVEASSATLMETEEGFQPVFFQPRGLKNLVRIDQVESLMPIMDMKIANLFDEETPQIFSLCGRGPRSSLRILRPGLAISEMAVSQLPGVPSAVWTVKKNVNDEFDAYIIVSFNNATLVLSIGETVEEVNNSGFLDTTPSLAVSLIGDDSLMQVHPNGIRHIREDGRINEWRTPGKRTIVKVGSNRVQVVIALSGGELIYFEVDITGQLMEVEKHEMSGDVACLDIAPVPEGRQRSRFLAVGSFDNTIRILSLDPDDCMQILSVQSVSSPPESLLFLEVQASVGREDVADHPASLFLNAGLQSGVLFRTLVDMVTGQLSDSRSRFLGLRAPKLFSILVRGRRAMLCLSSRPWLGYIHQGHFLLTPLSYETLEFAASFSSDQCAEGVVAVAGDALRIFTIERLGETFNETAIPLRYTPRKFVLQPKKKLLVIVESDQGAYTAEEREAAKKECFEAAGMGENGSANAEQMENGDDEDKDDPLSDEQYGYPKAEAEKWVSCIRVLDPRTAATTCLLELQDNEAAFSVCTVNFHDKEHGTLLAVGTAKGLQFWPKRSLSAGFIHIYKFVDDGRALELLHKTQVEGVPLALSQFQGRLLAGIGPVLRLYDLGKKRLLRKCENKLFPNSIVSIQTYRDRIYVGDIQESFHFCKYRRDENQLYIFADDCVPRWLTASHHVDFDTMAGADKFGNIYFVRLPQDVSDEIEEDPTGGKIKWEQGKLNGAPNKVEEIVQFHIGDVVTSLSKASLIPGGGECIIYGTVMGSVGALLPFTSRDDVDFFSHLEMHLRQDHPPLCGRDHMAYRSAYFPVKDVIDGDLCEQFPTLPLDAQRKIADELDRTPGEILKKLEEVRNKII

SEQ ID NO: 17031 - protein, 1213 aa, Eucalyptus grandis
MYLYNLTLQKATGIVCAINGNFSGGKSQEIVVARGKILDLLRPDDSGKIQTVLSVEIFGAVRSLAQFRLTGAQKDYIVVGSDSGRIVILEFNREKNVFDKVHQETFGKSGCRRIVPGQYLAIDPKGRAVMIGACEKQKLVYVLNRDTAARLTISSPLEAHKSHTITYSICGVDCGFDNPIFAAIELDYLEADQDSTGQAASEAQKHLTFYELDLGLNHVSRKWSEPVDNGANMLVTVPGGGDGPSGVLVCAENFVIYKNQGHPDVRAVIPRRADLPAERGVLIISAATHKQKSMFFFLLQTEYGDIFKATLEHDGEHVQELKIKYFDTIPVTSSMCVLKSGFLFAASEFGNHALYQFQAIGEEADVEASSATLMETEEGFQPVFFQPRGLKNLVRIDQVESLMPIMDMKVENLFEEETPQIFTLCGRGPRSSLRILRPGLAISEMAVSQLPGVPSAVWTVKKNAIDEFDAYIVVSFANATLVLSIGETVEEVSDSGFLDTTPSLAVSLIGDDSLMQVHPSGIRHIREDGRINEWRTPGKRTIVKVGSNRLQVVIALSGGELIYFEVDLTGQLMEVEKLEMSGDVACLDIAPVPEGRQRSRFLAVGSYDNTVRILSLDPDDCLQILSVQSVSAAPESLLFLEVQASIGGEDGADHPASLFLNAGLSNGVLFRTVVDMVTGQLSDSRSRFLGLRAPKLFSIVIRGRRAMLCLSSRPWLGYIHQGHFLLTPLSYEALEFAASFSSDQCAEGVVAVAGDALRVFTIERLGETFNETAIPLRYTPRKFVFHKKKSLIIIESDQGAFTAEEREAGKKEFFEGADMGENGNNNGDQMENGGDDEDKNDALSDEQYGYPKAESDKWVSCIRVLDPKTSNTTCLLELQDNEAAYSVCTVNFREKEYGTLLAVGTAKGLQFWPKRSVASGFIHIYRFVDDGRALELLHKTQVEGVPLALCQFQGRLLAGIGSVLRLYDLGKKRLLRKCENKLFPNTIVSIQTYRDRIYVGDMQESFHYCKYRRDENQLYVFADDSVPRWVTASHHIDFDTMAGADKFGNVYFVRLPQDVSDEIEEDPTGGKIKWEQGKLNGAPNKVEEIVQFHVGDVVTCLQKASLIPGGGDSVIYGTVMGSLGALLPFTSRDDVDFFSHLEMHLRQEYPPLCGRDHMAYRSAYFPVKDVIDGDLCEQFPTLPMDLQRKIADELDRTPAEILKKLEEVRNKII

SEQ ID NO: 17032 - protein, 1214 aa, Gossypium raimondii
MYLYNLTLQQATGIVSAINGNFSGGKIQEIVVARGKILSLLRPDDLGKLQTLLSVEIFGCIRSLAQFRLTGAQKDYIVVGSDSGRIVILEYNKEKNVFDKVHQETFGKSGCRRIVPGQYLAIDPKGRAVMIGACEKQKLVYVLNRDTAARLTISSPLEAHKSHTIVYSICGVDCGFDNPIFAAIELDYSEADQDSTGVAAGEAQKHLTFYELDLGLNHVSRKWSEQVDNGANMLVTVPGGGDGPSGVLVCAENFVIYKNQGHPDVRAVIPRRADLPEERGVLIVSAATHKQKSMFFFLLQTEYGDIFKVTLEHGNEGVSELKIKYFDTIPVTSSMCVLKTGFLFAASEFGNHALYQFQAIGDDPDVESSSSTLMETEEGFQPVFFQPRGLKNLVRIDQAESLMPIMDMKIANLFEEETPQIFSLCGRGPRSSLRILRPGLAISEMAVSQLPGVPSAVWTVKKNVNDAFDAYIVVSFANATLVLSIGETVEEVSDSGFLDTTPSLAVSLIGDDSLMQVHPNGIRHIREDGRINEWRTPGKRTIVKVGSNGLQVVIALSGGELIYFEVDMTGQLMEVEKHEMSGDVACLDIAPVPEGRQRSRFLAVGSYDNTIRILSLDPDDCMQVLSVQSVSSPPESLLFLEVKASVGGEDGADHPANLFLNAGLQNGVLFRTVVDMVTGQLSDSRSRFLGLRAPKLFSVKVRGRPAMLCLSSRPWLGYIHQGHFLLTPLSYETLEFAASFSSDQCAEGVVAVAGDALRVFTIERLGETFNETAIPLRYTPRRFVLQPKRKLLVIIESDQGSYTAEEREAARKECFEAAGMGENGNGNMNQMENGGDDEDKEDPLSDEQYGYPKAESNKWVSCIRVLDPRTASTTCLLELQDNEAAFSVCTVNFHDKEYGTLLAVGTAKGLQFWPKRSLTAGFIHIYRFLEDGRSLELLHKTQVEGVPLALCQFQGRLLAGIGSVLRLYDLGKRRLLRKCENKLFPNTIISIQTYRDRIYVGDIQESFHFCKYRRDENQLYIFADDVVPRWLTASYHIDFDTMAGADKFGNVYFVRLPQDVSDEIEEDPTGGKIKWEQGRLNGAPNKVEEIVQFHVGDVVTSLQKASLIPGGGECVLYGTVMGSLGALLPFTSRDDVDFFSHLEMHMRQEHPPLCGRDHMAYRSAYFPVKDVIDGDLCEQFPTLPLDLQRKIADELDRTPGEILKKLEEARNKII

SEQ ID NO: 17033 - protein, 1211 aa, Solanum phureja
MYLYSLTLQQPTGVICAINGNFSGGKVQEIVVARGKVLDLLRPDDNGKLQTLLSVEIFGAIRSLAQFRLTGAQKDYIVVGSDSGRIVILEYNKEKNCFDKVHQETFGKSGCRRIVPGQYLAIDPKGRAVMIGACEKQKLVYVLNRDTAARLTISSPLEAHKSHTITFSICGVDCGFDNPIFAAIELDYSEADQDPTGQAANEAQKHLTFYELDLGLNHVSRKWSEQVDNGANLLVTVPGGGDGPSGVLVCAENFVIYKNQGHPDVRAVIPRRVDLPAERGVLIVSAAMHKQKTMFFFLLQTEYGDIFKVTLDHDNDRVKELKIKYFDTIPVTSSLCVLKSGFLFASSEFGNHALYQFQAIGDDPDVEASSSTLMETEEGFQPVFFQPRKLKNLVRIDQIESLMPIMDMKIVNLFEEETPQIFSLCGRGPRSSLRILRPGLAVSEMAVSQLPGVPSAVWTVKKNVNDEFDAYIVVSFANATLVLSIGETVEEVSDSGFLDTTPSLSVSLIGDDSLMQVHPSGIRHIREDGRINEWRTPGKRTIVKVGSNRLQVVIALSGGELIYFEVDMTGQLMEVEKHEMSGDVACLDIAPVPEGRQRSRFLAVGSYDNTIRILSLDPDDCMQVLSLQSVSSPPESLLFLEVQASVGGEDGADHPASLFLNAGLQNGVLFRTVVDMNGGQLSDARSRFLGLRAPKLFSIVVRGRRAMLCLSSRPWLGYIHQGQFLLTPLSYESLEFAASFSSDQCAEGVVAVAGDALRVFTIERLGETFNETAIPLRYTPRRFVLQPKKKMVIMIESDQGAYTAEEREAAKKECFEAAGNGENGSAEQMENGEDEDGSDPLSDEQYGYPKSESGRWVSCIRVLDPRTTQTTCLLELQDNEAAFSICTVNFHDKEHGALLAVGTAKGLQFWPKKSFEAAYIHIYKFKEDGKVLELLHKTQVDGVPLALCQFQGRLLAGIGSVLRLYDLGKKRLLRKCENKLFPNSITAIHTYRDRIYVGDMQESFHYCKYRRDENQLYIFADDTVPRWLTAAQHVDFDTVAGADKFGNIYFVRLSQDVSDEIEEDPTGGKIKWEQGKLNGAPNKLEEIVQFHVGDVVSCLQKASLIPGGGECIIYGTVMGSVGAMLPFTSRDDVDFFSHLEMHLRQEFPPLCGRDHMAYRSAYFPVKDVIDGDLCEQFPTLPMDMQRKIADELDRTPGEILKKLEEIRNKII

SEQ ID NO: 17034 - protein, 1211 aa, Solanum lycopersicum
MYLYSLTLQQPTGIICAINGSFSGGKVQEIVVARGKVLDLLRPDDNGKLQTLLSVEIFGAIRSLAQFRLTGAQKDYIVVGSDSGRIVILDYNKEKNCFDKVHQETFGKSGCRRIVPGQYLAIDPKGRAVMIGACEKQKLVYVLNRDTAARLTISSPLEAHKSHTITFSICGVDCGFDNPIFAAIELDYSEADQDPTGQAANEAQKHLTFYELDLGLNHVSRKWSEQVDNGANLLVTVPGGGDGPSGVLVCAENFVIYKNQGHPDVRAVIPRRVDLPAERGVLIVSAAMHKQKTMFFFLLQTEYGDIFKVTLDHDNDRVNELKIKYFDTIPVTSSLCVLKSGFLFASSEFGNHALYQFQAIGDDPDVEASSSTLMETEEGFQPVFFQPRKLKNLVRIDQIESLMPIMDMKIVNLFEEETPQIFSLCGRGPRSSLRILRPGLAVSEMAVSQLPGVPSAVWTVKKNVNDEFDAYIVVSFANATLVLSIGETVEEVSDSGFLDTTPSLSVSLIGDDSLMQVHPSGIRHIREDGRINEWRTPGKRTIVKVGSNRLQVVIALSGGELIYFEVDMTGQLMEVEKHEMSGDVACLDIAPVPEGRQRSRFLAVGSYDNTIRILSLDPDDCMQVLSLQSVSSPPESLLFLEVQASVGGEDGADHPASLFLNAGLQNGVLFRTVVDMNGGQLSDARSRFLGLRAPKLFSIVVRGRRAMLCLSSRPWLGYIHQGHFLLTPLSYESLEFAASFSSDQCAEGVVAVAGDALRVFTIERLGETFNETAIPLRYTPRRFVLQPKKKMVIMIESDQGAYTAEEREAAKKECFEAAGNGENGNAEQMENGEDEDDSDPLSDEQYGYPKSESGRWVSCIRVLDPRTMQTTCLLELQDNEAAFSICTVNFHDKEHGALLAVGTAKGLQFWPKKSFEAAYIHIYKFKEDGKVLELLHKTQVDGVPLALCQFQGRLLAGIGSVLRLYDLGKKRLLRKCENKLFPNSITAIHTYRDRIYVGDMQESFHYCKYRRDENQLYIFADDTVPRWLTAAQHVDFDTVAGADKFGNIYFARLSQDVSDEIEEDPTGGKIKWEQGKLNGAPNKLEEIVQFHVGDVVSCLQKASLIPGGGECIIYGTVMGSVGAMLPFTSRDDVDFFSHLEMHLRQEFPPLCGRDHMAYRSAYFPVKDVIDGDLCEQFPTLPMDMQRKIADELDRTPGEILKKLEEIRNKII

SEQ ID NO: 17035 - protein, 1211 aa, Mimulus guttatus
MYLYSLTLQKATGIICAINGNFSGGKSQEIVVARGKVLDLLRPDENGKLQSLLSVEIFGAIRSLAQFRLTGAQKDYIVVGSDSGRIVILEYNKEKNTFEKIHQETFGKSGCRRIVPGQYLAVDPKGRAVMIGACEKQKLVYVLNRDTSARLTISSPLEAHKSHTIVYSICGVDCGFDNPIFAAIELDYSEADQDPTGQAANEAQKLLTFYELDLGLNHVSRKWSEQVDNGANLLVTVPGGGDGPSGVLVCAENFVIYKNQGHPDVRAVIPRREDLPAERGVLIVSAAMHKQKTMFFFLLQTEYGDIFRVTLDHDNDRVKELKIKYFDTIPVTSSLCVLKSGFLFAASEFGNHALYQFQAIGDDPDVEASSATLMETEEGFQPVFFQPRKLKNLVRIDQVESLMSMMDMKVSNLFEEETPQIFTLCGRGPRSSLRILRPGLAISEMAVSQLPGVPSAVWTVKKNVNDEFDAYIVVSFANATLVLSIGETVEEVSDSGFLDTTPSLSVSLIGDDSLMQVHPSGIRHIREDGRINEWRTPGKRTIVKVGSNRLQVVIALSGGELIYFEVDMTGQLMEVEKHEMSGDVACLDIAPVPEGRQRSRFLAVGSYDNTIRILSLDPDDCMQILSLQSVSSPPESLLFLEVQASIGGEDGADHPASLFLNAGLQNGVLFRTVVDMVTGQLSDARSRFLGLRAPKLFSIAVRGRRAMLCLSSRPWLGYIHQGHFLLTPLSYETLEFAASFSSDQCAEGVVAVAGDALRVFTIERLGESFNETAIPLRYTPRKFVLHPKRKLLVTIESDQGAFTAEEREAAKKESFEAAGMGENGNANQIENGDDEDNSDPLSDEQYGYPKAESGKWVSCIRVLDPRTAQTTCLLELQDNEAAFSMCTVNFHDKEYGTLLAVGTAKGLQFWPKRSFEAGFIHIYRFKEDGKVLELLHKTQVEGVPLALCQFQGRLLAGIGPILRLYDLGKRRLLRKCENKLFPNSITSIHTYRDRIFVGDMQESFHYCKYRRDENQLYIFADDTVPRWLTAAHHIDFDTMAGTDKFGNVFFVRLPQDVSDEIEEDPTGGKIKWEQGKLNGAPNKVEEIVQFHVGDVVSCLYKATLIPGGGECILYGTVMGSLGAFLPFASRDDVDFFSHLEMHMRQEHPPLCGRDHMAYRSSYFPVKDVIDGDLCEQFPTLPMDMQRKIADELDRTPGEILKKLEEIRNKII

SEQ ID NO: 17036 - protein, 1214 aa, Phaseolus vulgaris
MYLYSLTLQRPTGIICAINGSFSGGKSQEIVVARGKVLDLLRPDDNGRIQTILSVEIFGVIRSLAQFRLMGAQKDYIVVGSDSGRIVILEYNKEKNVFDKVHQETFGKSGCRRIVPGQYLAIDPKGRAVMIGACEKQKLVYVLNRDTAARLTISSPLEAHKSHTLVFSICGVDCGFENPIFAAIELDYSEADQDSTGTAASEAQKHLTFYELDLGLNHVSRKWSEQVDNGANLLVTVPGGGDGPSGVLVCAENFVIYKNQGHPDVRAVIPRRDDLPAERGVLIVSAAMHKLKSMFFFLLQTEYGDIFKVTLEHSNDRVSELKIKYFDTIPVTASMCVLKSGFLFAASEYGNHALYQFKSIGDEDDVEASSSTLMETEEGFQPVFFQPRRLKNLVRIDQVESLMPIIDMKVSNLFEEETPQIFTLCGRGPRSSLRILRTGLAVSEMAVSKLPGVPSAVWTVKKNVIDEFDAYIVVSFTNATLVLSIGETVEEVSDSGFLDTTPSLAVSLIGDDSLMQVHPNGIRHIREDGRINEWRTPGKRTISKVGSNRLQVVIALSGGELIYFEVDVTGQLMEVEKHEMSGDVACLDIAPVPEGRQRSRFLAVGSYDKTIRILSLDPDDCMQALSVQSVSSPPESLLFLEVQASVGGEDGADHPASLFLNAGLQNGVLFRTVVDMVTGQLSDSRSRFLGLRAPKLFPIIVRGKRAMLCLSSRPWLGYIHQGHFLLTPLSYETLEYAASFSSDQCVEGVVAVAGEALRIFTIERLGETFNETVIPLRYTPRKFVLQPKRKLLVMIESDQGALTAEEREAARKECFEAAQAGENGTGSADQMENGGDDEDKDDPLSDEHYGYPKAESEKWVSCIRVLDPRTGNTTCLLELQENEAAFSICTVNFHDKEYGTLLAVGTAKGLQFLPKRTVTAGFIHIYRFVEDGRSLELLHKTQVEGVPLALCQFQGRLLAGIGPVLRLYDLGKRRLLRKCENKLFPNTIVSIQSYRDRIYVGDVQESFHYCKYRRDENQLYIFADDCVPRWLTASYHIDFDTMAGADKFGNIYFVRLPQDVSDEIEEDPTGGRIKWEQGKLNGAPNKVEEIVQFHVGDVVTCLQKASLIPGGGECIVFGTVMGSVGALHAFTSRDDVDFFSHLEMHMRQDHPPLCGRDHMAYRSAYFPVKDVIDGDLCEQFPTLPMDLQRKIADELDRTPGEILKKLEEVRNKII

SEQ ID NO: 17037 - protein, 1214 aa, Gossypium raimondii
MYLYNLTLQQATGIVSAINGNFSGGKVQEIVVARGKILSLLRPDDLGKLQTLHSVEIFGCIRSLAQFRLTGAQKDYIVVGSDSGRIVILEYNKEKNVFDKVHQETFGKSGCRRIVPGQYLAIDPKGRAVMIGACEKQKLVYVLNRDTAARLTISSPLEAHKSHTIVYSICGVDCGFDNPIFASIELDYSEADQDSTGQAANEAQKHLTFYELDLGLNHVSRKWSEQVDNGANMLVTVPGGGDGPSGVLVCAENFVIYKNQGHPDVRAVIPRRADLPAERGVLIVSAATHKQKSMFFFLLQTEYGDIFKVTLEHGNEGVTELKIKYFDTIPVTASMCVLKTGFLFAASEFGNHALYQFQAIGDDPDVESSSSTLMETEEGFQPVFFQPRGLKNLVRIDQAESLMPIMDMKISNLFEEETPQIFSLCGRGPRSSLRILRPGLAISEMAVSQLPGVPSAVWTVKKNVSDAFDAYIVVSFANATLVLSIGETVEEVSDSGFLDTTPSLAVSLIGDDSLMQVHPNGIRHIREDGRINEWRTPGKRTIVKVGSNGLQVVIALSGGELIYFEVDMTGQLMEVEKHEMSGDVACLDIAPVPEGRQRSRFLAVGSYDNTIRILSLDPDDCMQILSVQSVSSPPESLLFLEVKASVGGEDGADHPANLFLNAGLQNGVLFRTVVDMVTGQLSDSRSRFLGLRPPKLFSVKVRGRPAMLCLSSRPWLGYIHQGHFLLTPLSYETLEFAASFSSDQCAEGVVAVAGDALRVFTIERLGETFNETAIPLRYTPRRFVMQPKRKLLVIIESDQGSYTAEEREAARKECFEAAGMGENGNGNVNEMENGGDDEDKEDPLSDEQYGYPKAESNKWVSCIRILDPRTATTTCLLELQDSEAAFSVCTVNFHDKEYGALLAVGTAKGLQFWPKKSLVAGFIHIYRFLEDGRSLELLHKTQVEGVPLALCQFQGRLLAGIGSVLRLYDLGKKRLLRKCENKLFPNTIVSIHTYRDRIYVGDIQESFHFCKYRRDENQLYIFADDVVPRWLTASYHIDFDTMAGADKFGNVYFVRLPQDVSDEIEEDPTGGKIKWEQGRLNGAPNKVEEIVQFHIGDVVTCLQKASLIPGGGECVLYGTVMGSLGALLPFTSRDDVDFFSHLEMHMRQEHPPLCGRDHMAYRSAYFPVKDVIDGDLCEQFPTLPLDLQRKIADELDRTPGEILKKLEEIRNKII

SEQ ID NO: 17038 - protein, 1214 aa, Glycine max
MYLYSLTLQRPTGIICAINGNFSGGKSQEIVVARGKVLDLLRPDDNGRIQTILSVEIFGAIRSLAQFRLMGAQKDYIVVGSDSGRIIILEYNKEKNVFDKIHQETFGKSGCRRIVPGQYLAIDPKGRAVMIGACEKQKLVYVLNRDTAARLTISSPLEAHKSHTLVYSICGVDCGFENPIFAAIELDYSEADQDSTGQAASEAQKHLTFYELDLGLNHVSRKWSEQVDNGANLLVTVPGGGDGPSGVLVCAENFVIYKNQGHPEVRAVIPRRADLPAERGVLIVSAAMHKLKNMFFFLLQTEYGDIFKVTLEHNNDRVSELKIKYFDTIPVTASMCVLKSGFLFAASEFGNHALYQFKSIGDDDDVEASSATLMETEEGFQPVFFQPRRLKNLVRIDQVESLMPIMDMKVSNLFEEETPQIYTLCGRGPRSSLRILRTGLAVSEMAVSKLPGIPSAVWTVKKNVIDEFDAYIVVSFTNATLVLSIGETVEEVSDSGFLDTTPSLAVSLIGDDSLMQVHPNGIRHIREDGRINEWRTPGKRSISKVGSNTLQVVIALSGGELIYFEMDVTGQLMEVEKHEMSGDVACLDIAPVPEGRQRSRFLAVGSYDKTIRILSLDPDDCMQALSVQSVSSAPESLLFLEVQASVGGEDGADHPASLFLNAGLQNGVMFRTVVDMVTGQLSDSRSRFLGLRAPKLFPIIVRGKRAMLCLSSRPWLGYIHQGHFLLTPLSYETLEYAASFSSDQCVEGVVAVAGEALRIFTIERLGETFNETVIPLRYTPRKFVLQPKRKLLVMIESDQGALTAEEREAARKECFEAAQAGENGTGSADQMENGGDDEDKDDPLSDEHYGYPKAESDKWASCIRVLDPRTSNTTCLLELQENEAAFSICTVNFHDKEYGTLLAVGTAKGLQFLPKRTVTAGFIHIYRFVEDGRSLELLHKTQVEGVPLALCQFQGRLLAGIGPVLRLYDLGKKRLLRKCENKLFPNTIISIHAYRDRIYVGDVQESFHYCKYRRDENQLYIFADDCVPRWLTASYHIDFDTMAGTDKFGNIYFVRLPQDVSDEIEEDPTGGRIKWEQGKLNGAPNKVEEIVQFHVGDVVTCLQKASLIPGGGECIVFGTVMGSVGALHAFTSRDDVDFFSHLEMHMRQDHPPLCGRDHMAYRSAYFPVKDVIDGDLCEQYPTLPMDLQRKIADELDRTPGEILKKLEEVRNKII

SEQ ID NO: 17039 - protein, 1216 aa, Lotus japonicus
MYLYSLTLQRPTGIVCAINGNFSGGKVQEIAVARGKVLDLLRPDDNGRIQTILSVEVFGAIRSLAQFRLTGAQKDYIVVGSDSGRIVILDYNKEKNVFDKVHQETFGKSGCRRIVPGQYLAVDPKGRAVMIGACEKQKLVYVLNRDTAARLTISSPLEAHKSHTLVFSICGVDCGFENPIFAAIELDYSEADQDSTGMAASEAQKHLTFYELDLGLNHVSRKWSDQVDNGANLLVTVPGGADGPSGVLVCAENFVIYKNQGHPDVRAVIPRRADLPAERGVLIVSAAMHKLKTMFFFLLQTEYGDIFKVTLDNDGDHVSELKIKYFDTIPVTASMCVLKSGFLFAASEFGNHALYQFKAIGDDDDVEASSATLMETEEGFQPVFFQPRRLKNLVRIDQVESLMPVMDMKVSNLFEEETPQIFTLCGRGPRSTLRILRTGLAVSEMAVSRLPGVPSAVWTVKRTVFDEFDVYIVVSFTNATLVLSIGETVEEVDDSGFLDTTPSLAVSLIGEDSLMQVHPNGIRHIRSDRRVNEWRTPGKRTISKVGSNRLQVVIALSGGELIYFEVDVTGTGQLLEVDKHEMSGDVACLDIAPVPEGRQRSRFLAVGSYDKTIRILSLDPDDCMQTLSVQGVSSPPESLLFLEVQASVGGEDGADHPASLFLNAGLQNGVLFRTVVDMVTGQLSDSRSRFLGLRAPKLFPIVVRGKRAMLCLSSRPWLGYIHQGHFLLTPLSYETLEYAASFSSDQCVEGVVSVAGEALRIFTIERLGETFNETVIPLRYTPRKFVLQPKRKLLVMIESDQGAFTAEEREAARRECFEAAQAGENGNGNADQMENGGEDEDRDDPLSDEHYGYPKAESDKWVSCIRVLDPRSGTTTCLLELQENEAAFSICTVNFHDKEYGTLLAVGTAKGLQFLPKKSLAAGFIHIYRFVDEGRSLELLHKTQVEGVPLALCQFQGRLLAGIGPVLRLYDLGKRRLLRKCENKLFPNTIVSIQTYRDRIYVGDIQESFHYCKYRRDENQLYIFADDCVPRWLTASYHIDFDTMAGADKFGNIYFVRLPQDVSDEIEEDPTGGRIKWEQGKLNGAPNKMEEIVQFNVGDVVTSLQKASLIPGGGECIVYGTIMGSIGALHAFTSRDDVDFFSHLEMHLRQDYPPLCGRDHMAYRSAYFPVKDVIDGDLCEQFPTLPMDLQRKIADELDRTPAEILRKLEEVRNKII

SEQ ID NO: 17040 - protein, 1211 aa, Ocimum basilicum
MYLYSLTLQQSTGIICAINGSFSGGKSQEIAVARGKVIDLLRPDDNGKLQSLLSVEIFGAIRSLAQFRLTGAQKDYIVVGSDSGRIVILEYNKEKNTLDKIHQETFGKSGCRRIVPGQYLAIDPKGRAVMIGACEKQKLVYVLNRDTSARLTISSPLEAHKSHTIVYSICGVDCGFDNPIFAAIELDYSEADQDPTGQAANEAQKHLTFYELDLGLNHVSRKWSEQVDNGANMLVTVPGGGDGPSGVLVCAENFVIYKNQGHPDVRAVIPRRVDLPAERGVLIVSAAMHKQKSMFFFLLQTEYGDIFKVTLDHENDRVKELKIKYFDTIPVTSSLCVLKSGFLFAASEFGNHALYQFQAIGDDPDVEASSATLMEVEEGFHPVFFQPRKLKNLVRIDQVESLMPIMDMKVVNLFEEETPQIFSLCGRGPRSSLRILRPGLAISEMAVSQLPGVPSAVWTVKKNVNDEFDAYIVVSFANATLVLSIGETVEEVSDSGFLDTTPSLAVSLIGDDSLMQVHPNGIRHIREDGRINEWRTPGKRTIVKVGSNRLQVVIALSGGEIIYFEVDMTGQLMEVGKHEMSGDIACLDIAPVPEGRQRSRFLAVGSYDNTIRILNLDHDDIMAILSLQSVSSPPESLLFLEVQASLGGEDGADHPANLFLNAGLQNGVLFRTVVDMVTGTLSDNRSRFLGLRAPKLFSIVVRGRQAMLCLSSRPWLGYIHQGHFLLTPLSYETLEYAASFSSDQCAEGVVAVAGDALRVFTIERLGESFNETAIPLRYTPRKFVVQPKRKLLVMIESDQGAFTAEEREAAKKESFEAAGMGENGTDAHMENGDDEENNDPLSDEQYGYPKAEAGRWVSCIRVLDPRTTQTTCLLELQDNEAAFSICTVNFHDKEYGTLLAVGTAKGLQFWPKRSFEAGYIHIYRFKEDGKVLELLHKTQVEGVPLALAQFQGRLLAGIGPVLRLYDLGKRRLLRKCENKLFPNSITSIQTYRDRIYVGDMQESFHYCKYRRDENQLYIFADDTVPRWLTAAQHVDFDTMAGADKFGNVYFVRLPQDVSDEIEEDPTGGKIKWEQGKLNGAPNKVEEIVQFHVGDVVSCLQKASLIPGGGECLIYGTVMGSLGAFLPFTSRDDVDFFSHLEMHLRQEHPPLCGRDHMAFRSSYFPVKDVIDGDLCEQFPTLPMDMQRKIADELDRTPGEIMKKLEEIRNKII

SEQ ID NO: 17041 - protein, 1214 aa, Theobroma cacao
MYLYNLTLQQATGIVSAINGNFSGGKIQEIVVARGKILSLLRPDDLGKLQTLHSVEIFGSIRSLAQFRLTGAQKDYIVVGSDSGRIVILEYNKEKNVFDKIHQETFGKSGCRRIVPGQYLAVDPKGRAVMIGACEKQKLVYVLNRDTAARLTISSPLEAHKSHTIVYSICGVDCGFDNPIFAAIELDYLEADQDSTGLAAGEAQKHLTFYELDLGLNHVSRKWSEQVDNGANMLVTVPGGGDGPSGVLVCAENFVIYKNQGHPDVRAVIPRRADLPAERGVLIVSAATHKQKSMFFFLLQTEYGDIFKVTLDYGNDGVTELKIKYFDSIPVTSSMCVLKTGFLFAASEFGNHGLYQFQAIGDEPDVESSSSTLMETEEGFQPVFFQPRGLKNLVRIDQAESLMPIMDMKIANLFEEETPQIFSLCGRGPRSSLRILRPGLAISEMAVSQLPGVPSAVWTVKKNVNDAFDAYIVVSFANATLVLSIGETVEEVSDSGFLDTTPSLAVSLIGDDSLMQVHPNGIRHIREDGRINEWRTPGKRTIVKVGSNGLQVVIALSGGELIYFEVDMTGQLMEVEKHEMSGDVACLDIAPVPEGRQRSRFLAVGSYDNTIRILSLDPDDCMQILSVQSVSSPPESLLFLEVKASVGGEDGADHPASLFLNAGLQNGVLFRTVVDMVTGQLSDSRSRFLGLRAPKLFSIKVRGRPAMLCLSSRPWLGYIHQGHFLLTPLSYETLEFAASFSSDQCAEGVVAVAGDALRVFTIERLGETFNETAIPLRYTPRKFVLQPKRKLLVIIESDQGSYTAEEREVARKECFEAAGMGENGNGNVDQMENGGDDEDKEDPLSDEQYGYPKAESDKWVSCIRVLDPRTATTTCLLELQDNEAAFSVCTVNFHDKEYGTLLAVGTAKGLQFWPKRSLVTGFIHIYRFLEDGRSLELLHKTQVEGVPLALCQFQGRLLAGIGSVLRLYDLGKKRLLRKCENKLFPNTIVCIHTYRDRIYVGDIQESFHFCKYRRDENQLYIFADDVVPRWLTASYHIDFDTMAGADKFGNVYFVRLPQDVSDEIEEDPTGGKIKWEQGRLNGAPNKVEEIVQFHIGDVVTSLQKASLIPGGGECVLYGTVMGSLGALLPFTSRDDVDFFSHLEMHMRQEHPPLCGRDHMAYRSAYFPVKDVIDGDLCEQFPTLPMDLQRKIADELDRTPGEILKKLEEVRNKII

SEQ ID NO: 17042 - protein, 1212 aa, Prunus mume
MYLYSLTLQRATGIVCAINGNFSGGKAQEIVVARGKVLDLIRPDENGKIQTLLSVEIFGVIRSLAQFRLTGSQKDYIVVGSDSGRIVILEYNKEKNVFDKVHQETFGKSGCRRIVPGQYLAIDPKGRAVMVGACEKQKLVYVLNRDTSARLTISSPLEAHKSHTIVYSICGVDCGFDNPIFAAIELDYSEADQDSTGQAANEAQKHLTFYELDLGLNHVSRKWSDQVDNGANLLVTVPGGGDGPSGVLVCAENFVIYKNQDKPDLRAVIPRRADLPAERGVLIVSAAMHKQKSMFFFLLQTEYGDIFKVTLDHDNDKVSELKIKYFDTIPVTTSMCVLKSGFLFAASEFGNHSLYQFRAIGEDPDVESSSATLMETEEGFQPLFFQPRRLKNLVRIDQVESLMPIMDMKVNNLFEEETPQIFTLCGRGPRSSLRILRPGLAISEMAVSELPGVPSAVWTVKKNVSDEFDAYIVVSFANATLVLSIGETVEEVSDSGFLDTTPSLAVSLIGDDSLMQVHPNGIRHIREDGRINEWRTPGKRTIVKVGSNRLQVVIALSGGELIYFEVDMTGQLMEVEKHEMSGDVACLDIAPVPEGRQRSRFLAVGSYDNTIRILSLDPDDCMQILSVQSVSSIPESLLFLEVQASIGGEDGADHPASLFLNAGLRTGILFRTVVDMVTGQLSDSRSRFLGLRAPKLFSVSVRGKHAMLCLSSRPWLGYIHQGHFLLTPLSYETLEYAASFSSDQCAEGVVAVAGNALRVFTIERLGETFNETVVPLRYTPRKFVVQLKRKLLVIIESDQGAFTAEEREAAKKECFEAAGIGENGNGNVDQMENGGDNEDDPLSDEHYGYPKAESEKWVSCIRVLDPKTATTTCLLELQDNEAAFSICTVNFHDKEYGTLLAVGTAKGLQFWPKRSVTAGYIHIYRFLDDGKSLELLHKTQVDGVPLALCQFQGRLLAGIGPVLRLYDLGKKRLLRKCENKLFPNSIISIQTYRDRIYVGDIQESFHYCKYRRDENQLYIFADDCVPRWLTASYHIDFDTMAGADKFGNVYFVRLPQDVSDEIEEDPTGGRIKWEQGKLNGAPNKVEEIVQFHVGDVVSCVQKASLIPGGGECIIYGTVMGSLGALLAFTSRDDVDFFSHLEMYMRQEHPPLCGRDHMAYRSAYFPVKDVIDGDLCEQFPTLPMDLQRKIADELDRTPGEILKKLEEIRNKII

SEQ ID NO: 17043 - protein, 1212 aa, Prunus persica
MYLYSLTLQRATGIVCAINGNFSGGKAQEIVVARGKVLELIRPDENGKIQTLLSVEIFGVIRSLAQFRLTGSQKDYIVVGSDSGRIVILEYNKEKNVFDKVHQETFGKSGCRRIVPGQYLAIDPKGRAVMVGACEKQKLVYVLNRDTSARLTISSPLEAHKSHTIVYSICGVDCGFDNPIFAAIELDYSEADQDSTGQAANEAQKHLTFYELDLGLNHVSRKWSDQVDNGANLLVTVPGGGDGPSGVLVCAENFVIYKNQDKPDLRAVIPRRADLPAERGVLIVSAAMHKQKSMFFFLLQTEYGDIFKVTLDHDNDKVSELKIKYFDTIPVTTSMCVLKSGFLFAASEFGNHSLYQFRAIGEDPDVESSSATLMETEEGFQPLFFQPRRLKNLVRIDQVESLMPIMDMKVNNLFEEETPQIFTLCGRGPRSSLRILRPGLAISEMAVSELPGVPSAVWTVKKNVSDEFDAYIVVSFANATLVLSIGETVEEVSDSGFLDTTPSLAVSLIGDDSLMQVHPNGIRHIREDGRINEWRTPGKRTIVKVGSNRLQVVIALSGGELIYFEVDMTGQLMEVEKHEMSGDVACLDIAPVPEGRQRSRFLAVGSYDNTIRILSLDPDDCMQILSVQSVSSIPESLLFLEVQASIGGEDGADHPASLFLNAGLRTGILFRTVVDMVTGQLSDSRSRFLGLRAPKLFSVSVRGKHAMLCLSSRPWLGYIHQGHFLLTPLSYETLEYAASFSSDQCAEGVVAVAGNALRVFTIERLGETFNETVVPLRYTPRKFVVQLKRKLLVIIESDQGAFTAEEREAAKKECFEAAGIGENGNGNVDQMENGGDNEDDPLSDEHYGYPKAESEKWVSCIRVLDPKTATTTCLLELQDNEAAFSICTVNFHDKEYGTLLAVGTAKGLQFWPKRSVTAGYIHIYRFLDDGKSLELLHKTQVDGVPLALCQFQGRLLAGVGPVLRLYDLGKKRLLRKCENKLFPNSIISIQTYRDRIYVGDIQESFHYCKYRRDENQLYIFADDCVPRWLTASYHIDFDTMAGADKFGNVYFVRLPQDVSDEIEEDPTGGRIKWEQGKLNGAPNKVEEIVQFHVGDVVSCVQKASLIPGGGECIIYGTVMGSLGALLAFTSRDDVDFFSHLEMYMRQEHPPLCGRDHMAYRSAYFPVKDVIDGDLCEQFPTLPMDLQRKIADELDRTPGEILKKLEEIRNKII

SEQ ID NO: 17044 - protein, 1215 aa, Allium cepa
MYLYNLTLQDSTGILSAINGNFSGTKTQEILVARGKSLSLLRPDDSGKLQTLLSIQIFGAIRSLAHFRLTGSQKDFIIVGSDSGRIVILEYFKDRNVFDKLHQETFGKSGCRRIVPGQYLAVDPKGRAVMIAACEKQKLVYVLNRDTAARLTISSPLEAHKSHNITYSVVGVDCGFDNPVFAAIELDYSEADMDPTGDAASEAQKCLTFYELDLGLNHVSRKWSEPVDNGANMLVTVPGGGDGPSGVLVCAENFVIYKNQGHPDVRCLIPRRADLPAERGVLIVSAATHKMKSMFFFLLQTEYGDIFKATLVYEGDRVSELKIKYFDTIPVTSSMCLMKTGYLFAASEFGNHGLYQFQAIGDGDDVEASSESLMETEEGFQPVFFQPRGLKNLLRIDQVASLMPIMDMRITNFFDEETSQIYALCGRGPRSSLRILRPGLAISEMAVERLPDVPNAVWTVKKNVTDEFDAYIVVSFPTATLVLSIGETVEEVSDSGFLDTTTSLAVSLLGDDSLMQVHPNGIRHIREDGRINEWKTPGKKTIVKVGSNRLQVVIALSGGELIYFEMDMTGQLMEVEKHEMPGDVACLDIAPVPEGKQRSRFLAVGSYDNTIRILSLDPDDCMQVLSVQSVSSSPESLLLLEVQASVGGEDGADHPASVFLNAGLQNGVLFRTVVDMVTGQLSDTRSRFLGLRAPKLFSATVRGRQAMLCLSSRPWLGYIHQGHFLLTPLSYETLEFAASFSSDQCAEGVVAVAGDALRVFTIERLGETFNETVIPLRYTPRKFVLIPKKKLAVIIESDQGAFNAEEREAARKECFEAADGVGENGNANNVENMENGEEEEKEDPLIDEQYGYPKAESDKWASCIRVLDPRSGNTTCLLELQDNEAAFSLCTVNFHDKEYGTLLAVGTAKGLQFFPKRTFTAGFIHIYRFVEDGKSLELLHKTQVEGVPLALCQFQGRLLAGIGPVLRLYDLGKKRLLRKCENKLFPKTIVSIHTYRDRIYVGDIQESFHYCKYRRDENQLYIFADDSVPRWLTAAYHVDFDTMAGADKFGNIYFARLPQDLSDEIEEDPTGGKIKWEQGKLNGAPNKIEEIVQFHVGDVVTSLQKASLVPGGGECIIYGTVMGSLGALLAFTSREDVDFFNHLEMHMRQEHPPLCGRDHMAYRSAYFPVKDVIDGDLCEQFPTLPPDLQRKIAEELDRTPGEILKKLEDARNKII

SEQ ID NO: 17045 - protein, 1214 aa, Glycine max
MYLYSLTLQRPTGIICAINGNFSGGKSQEIVVARGKVLDLLRPDDNGRIQTILSVEIFGAIRSLAQFRLMGAQKDYIVVGSDSGRIVILEYNKEKNVFDKIHQETFGKSGCRRIVPGQYLAIDPKGRAVMIGACEKQKLVYVLNRDTAARLTISSPLEAHKSHTLVYSICGVDCGFENPIFAAIELDYSEADQDSTGLAASEAQKHLTFYELDLGLNHVSRKWSEQVDNGANLLVTVPGGGDGPSGVLVCAENFVIYKNQAHPEVRAVIPRRTDLPAERGVLIVSAAMHKLKNMFFFLLQTEYGDIFKVTLEHNNDRVSELKIKYFDTIPVTASMCVLKSGFLFAASEFGNHALYQFKSIGDEDDVEASSATLMETEQGFQPVFFQPRRLKNLVRIDQVESLMPIMDMKVSNLFEEETPQIYTLCGRGPRSSLRILRTGLAVSEMAVSKLPGIPSAVWTVKKNAIDEFDAYIVVSFTNATLVLSIGETVEEVSDSGFLDTTPSLAVSLIGDDSLMQVHPNGIRHIREDGRINEWRTPGKRTISKVGSNRLQVVIALSGGELIYFEVDVTGQLMEVEKHEMSGDVACLDIAPVPEGRQRSRFLAVGSYDKTIRILSLDPDDCMQALSVQSVSSAPESLLFLEVQASVGGEDGADHPASLFLNAGLQNGVMFRTVVDMVTGQLSDSRSRFLGLRAPKLFPIIVRGKRAMLCLSSRPWLGYIHQGHFLLTPLSYETLEYAASFSSDQCVEGVVAVAGEALRIFTIERLGETFNETVIPLRYTPRKFVLQPKRKLLVMIESDQGALTAEEREAARKECFESAQAGENGTESADQMENGGEDEDKDDPLSDEHYGYPKAESDKWASCIRVLDPRTGNTTCLLELQENEAAFSICTINFHDKEYGTLLAVGTAKGLQFLPKRTITAGFIHIYRFVEDGRSLELLHKTQVEGVPLALCQFQGRLLAGIGPVLRLYDLGKRRLLRKCENKLFPNTIVSIHAYRDRIYVGDVQESFHYCKYRRDENQLYIFADDCVPRWLTASYHIDFDTMAGADKFGNIYFVRLPQDVSDEIEEDPTGGRIKWEQGKLNGAPNKVEEIVQFHIGDVVTCLQKASLIPGGGECIVFGTVMGSVGALHAFTSRDDVDFFSHLEMHMRQDHPPLCGRDHMAYRSAYFPVKDVIDGDLCEQYPTLPMDLQRKIADELDRTPGEILKKLEEVRNKII

SEQ ID NO: 17046 - protein, 1212 aa, Lactuca sativa
MYLYNLTLQQATGIVCAINGSFSGGNKSQEIVVARGKVLELLRPDENGKIQTILSVDVFGAIRSLAQFRLTGAQKDYIVVGSDSGRIVILEYNKEKNVFDKIHQETFGKSGSRRIVPGQYLAIDPKGRAVMIGACEKQKLVYVLNRDTAARLTISSPLEAHKSHTITYSIAGVDCGFDNPIFAAIELDYSEADQDSTGQAANEAQKHLTFYELDLGLNHVSRKWSEQVDNGANMLVTVPGGGDGPSGVLVCAENFVIYKNQGHPDVRAVIPRRADLPAERGVLIVSATMHKQKSMFFFLLQTEYGDVFKVTLDHDNERVTELKIKYFDTIPVSSSMCVMKLGFLFAASEFGNHALYQFQAIGADPDVESSSATLMETDEGFQPVFFKPRGLKNLVRIDQVESLMPIMDMKVVNLFEEETPQIFTLCGRGPRSSLRILRPGLAISEMAVSQLPGVPSAVWTVKKNVNDEFDAYIVVSFANATLVLSIGETVEEVSDSGFLDTTPSLAVSLIGDDSLMQVHPSGIRHIREDGRINEWRTPGKRTIVKVGSNRLQVVIALSGGEIIYFEVDMTGQLMEVEKNEMSGDVACLDIAPVPEGRQRSRFLAVGSYDKTIRILSLDPDDCMQVLSLQSVSSPPESLLFLEVQASIGGEDGADHPASLFLNAGLQSGVLFRTVVDMVTGQLSDARSRFLGLRAPKLFSILVRGRRAMLCLSSRPWLGYVHQGHFLLTPLSYETLEYAASFSSDQCAEGVVAVAGDALRVFTIERLGETFNETSIPLRYTPRKFVFHPKKKLLVTIESDQGAFPAELRESAKKECFEAAGQGQNGKMESENGNDDEDKDDPLSDEQYGYPKAEADKWVSCIRVLDPKSTETTCLLELQDDEAAFSLCTVNFHDKEYGTLLAVGTAKGLQFWPKKSLVAGYIHIYRFVKDGRSLELLHKTQVDGVPLALCQFQGRLLAGIGSILRLYDLGKRRLLRKCENKLFPNTINSIHTYRDRIYVGDIQESFHYCKYRRDENQLYVFADDSVPRWLTAAYHVDFDTMAGADKFGNIYFVRLPQDVSDEIEEDPTGGKIKWEQGKLNGAPNKVEEIVQFHVGDVVTCLQKASLIPGGVECVMYGTVMGSLGALLAFSSRDDVDFFSHLEMHMRQEHPPLCGRDHMAYRSAYFPVKDVIDGDLCEQFPTLPLDIQRKIADELDRTPGEIMKKLEEVRNKIV

SEQ ID NO: 17047 - protein, 1214 aa, Amborella trichopoda
MYLYGLTLQQATGVVCATYGNFVGGKSQEIIVARGKVLDLLRPDDRGKLQTLLSVEVFGAIRSLVQFRLTGSQKDYIVVGSDSGRIVILEYNKEKNIFEKIHQETFGKSGCRRIVPGQYLAVDPKGRAVMIGACEKQKLVYVLNRDTSARLTISSPLEAHKSHTVVYSIAGVDCGFDNPIFAAIELDYSEADQDSTGQAASEAQKHLTFYELDLGLNHVSRRWSEPIDNGANMLVTVPGGGDGPSGVLVCAENFVIYKNQGHPDVRAVIPRRADLPAERGVLIVSAATHRIKSIFFFLLQTEYGDIFKVTLEHDNDRVSELKIKYFDTIPVTTAMCLLKSGFLFAASEFGNHALYQFQGIGDGDDVEASSATIMETDEGFQPVFFQPRGLKNLIKIDQVESLMPIMDMKVINLFEEETPQIFTLCGRGPRSSLRILRPGLAVSEMAVSQLPGVPSAVWTVKKSASDEFDAYIVVSFANATLVLSIGETVEEVSNSGFLDTTPSLAVSLLGEDSLMQVHPGGIRHIREDGRINEWKTPGKKTIVKVGSNRSQVVIALSGGELIYFEMDETRQLMEVEKHEMTGDVACLDIAPVPEGRKRSRFLAVGSYDSTIRILSLDPDDCMQVLSMQSVSSPPESLLLLEVQASVGGEDGADRPASVFLNAGLQNGVLYRTEVDMVTGNLSDTRSRFLGLRPPKLFACMVRGRRAMLCLSSRPWLGYIHRGHFLLTPLSYETLEYAASFSSDQCAEGVVAVAGDALRVFTIERLGETFNETVVPLRYTPRKFVLHPKKKHLVIVESDQGAFTAEEREAARKECLEAAGLGENGNANADQMQENGDDEEKEDPLPDEQYGYPKAESDKWVSCIRVLDPRSGNTTCLLELQDNEAAFSVCTVNFSDKEYGTLVAVGTAKGLQFWPKRQVSVGFIHIYRFVEDGKALELLHKTQVDGVPLALCQFQGKLLAGIGPVLRLYDLGKRKLLRKCENKLFPNTIVSIHSYRDRIYVGDIQESFHYVKYRRDENQLYIFADDSVPRWLTASYHIDFDTMAGSDKFGNIYFVRLPQDVSDEIEEDPTGGKIKWEQGRLNGAPNKMEEIVQFHVGDVVTCLQKASLIPGGGECIIYGTVMGSLGALLAFTSREDVDFFAHLEMHMRQEHPPLCGRDHMAYRSAYFPVKDVIDGDLCEQFPTLAPDLQRKIADELDRTPGEILKKLEDVRNRII

SEQ ID NO: 17048 - protein, 1213 aa, Citrus clementina
  Sequence also found in Organisms: Citrus sinensis
MYLYSLTLQQPTGIIAAINGNFSGTKTPEIVVARGKVLELLRPENSGRIETLVSTEIFGAIRSLAQFRLTGSQKDYIVVGSDSGRIVILEYNPSKNVFDKIHQETFGKSGCRRIVPGQYLAVDPKGRAVMIGACEKQKLVYVLNRDTAARLTISSPLEAHKSHTIVYSICGIDCGFDNPIFAAIELDYSEADQDSTGQAASEAQKNLTFYELDLGLNHVSRKWSEPVDNGANMLVTVPGGGDGPSGVLVCAENFVIYKNQGHPDVRAVIPRRADLPAERGVLIVSAATHRQKTLFFFLLQTEYGDIFKVTLEHDNEHVSELKIKYFDTIPVTASMCVLKSGYLFAASEFGNHALYQFQAIGADPDVEASSSTLMETEEGFQPVFFQPRGLKNLVRIEQVESLMPIMDMRIANLFEEEAPQIFTLCGRGPRSSLRILRPGLAVSEMAVSQLPGVPSAVWTVKKNVNDEFDAYIVVSFNNATLVLSIGETVEEVSDSGFLDTTPSLAVSLIGDDSLMQVHPSGIRHIREDGRINEWRTPGKRTIVKVGSNRLQVVIALSGGELIYFEVDMTGQLLEVEKHEMSGDVACLDIASVPEGRKRSRFLAVGSYDNTIRILSLDPDDCMQILSVQSVSSPPESLLFLEVQASVGGEDGADHPASLFLNAGLQNGVLFRTVVDMVTGQLSDSRSRFLGLRPPKLFSVVVGGRAAMLCLSSRPWLGYIHRGRFLLTPLSYETLEYAASFSSDQCVEGVVSVAGNALRVFTIERLGETFNETALPLRYTPRRFVLQPKKKLMVIIETDQGALTAEEREAAKKECFEAAGMGENGNGNMDQMENGDDENKYDPLSDEQYGYPKAESDKWVSCIRVLDPRSANTTCLLELQDNEAAFSICTVNFHDKEHGTLLAVGTAKGLQFWPKRNIVAGYIHIYRFVEEGKSLELLHKTQVEGIPLALCQFQGRLLAGIGPVLRLYDLGKKRLLRKCENKLFPNTIVSINTYRDRIYVGDIQESFHFCKYRRDENQLYIFADDSVPRWLTAAHHIDFDTMAGADKFGNIYFVRLPQDVSDEIEEDPTGGKIKWEQGKLNGAPNKMEEIVQFHVGDVVTSLQKASLVPGGGESVIYGTVMGSLGAMLAFSSRDDVDFFSHLEMHMRQEHPPLCGRDHMAYRSAYFPVKDVIDGDLCEQFPTLSLDLQRKIADELDRTPGEILKKLEEIRNKIV

SEQ ID NO: 17049 - protein, 1212 aa, Echinacea purpurea
MYLYNLTLQQATGIVCAINGSFSGGNKSQEIVVARGKVLELLRPDENGKIQTILSVDVFGAIRSLAQFRLTGAQKDYIVVGSDSGRIIILEYNKEQNVFHQVHKETFGKSGCRRIVPGQYLAIDPKGRAVMIGACEKQKLVYVLNRDTAARLTISSPLEAHKSHTITYSIAGVDCGFDNPIFAAIELDYSEADQDSTGQAANEAQKHLTFYELDLGLNHVSRKWSEQVDNGANMLVTVPGGGDGPSGVLVCAENFVIYKNQGHPDVRAVIPRRADLPAERGVLIVSATMHKQKSMFFFLLQTEYGDVFKVTLDHDNERVTELKIKYFDTIPVTSAMCVMKLGFLFAASEFGNHALYQFQAIGADPDVESSSATLMETDEGFQPVFFKPRGLKNLVRIDQVESLMPIMDMKVVNLFEEETPQIFTLCGRGPRSSLRILRPGLAISEMAVSQLPGVPSAVWTVKKNVNDEFDAFIVVSFANATLVLSIGETVEEVSDSGFLDTTPSLAVSLIGDDSLMQVHPSGIRHIREDGRVNEWRTPGKRTIVKVGYNRLQVVVALSGGELIYFEVDMTGQLMEVEKNEMSGDVACLDIAPIPKDKKRSRFLAVGSYDNTIRILSLDPGDCMQVLSLQSVSSPPESLLFLEVLASSGGEDGAAHPASLFLNAGLQSGVLFRTVVDMVTGQLSDARSRFLGLRAPKLFSIMVRGRQAMLCLSSRPWLGYVHQGHFLLTPLSYETLEFAASFSSDQCAEGVVAVAGDALRVFTIERLGETFNETAIPLRYTPRKFVFHPKKKLLVTIESDSGAFPAELRESAKKECFEAAGQGENGKMEIENGGDDEDKDDPLSDEQYGYPKAESDKWVSCIRVLDPKSTETTCLLELQDNEAAFSICTVNFHDKEYGTLLAVGTAKGLQFWPKRSLTAGYIHIYRFVKDGKSLELLHKTQVDGVPLALCQFQGRLLAGIGSILRLYDLGKKRLLRKCENKLFPNTINSIHTYRDRIYVGDIQESFHYCKYRRDENQLYVFADDSVPRWLTAAHHVDFDTMAGADKFGNIYFVRLPQDVSDEIEEDPTGGKIKWEQGKLNGAPNKVEEIVQFHVGDVVTCMQKASLIPGGSECVMYGTVMGSLGALLAFTSRDDVDFFSHLEMHMRQEHPPLCGRDHMAYRSAYFPVKDVIDGDLCEQFPTLSLDMQRKIADELDRTPAEILKKLEEVRNKIV

SEQ ID NO: 17050 - protein, 1211 aa, Daucus carota
MYLYNLTLQQATGIVCAINGSFTGGKSQEIVVARGKVLDLLRPDDNGKIQTILSVEIFGAIRSLAQFRLTGAHKDYIVVGSDSGRIVILEYNKEKNVFDKIHQETFGKSGCRRIVPGQYLGIDPKGRAVMVGACEKQKLVYVLNRDTSARLTISSPLEAHKSHTIVYSIVGVDCGFDNPIFAAIELDYSEADQDSTGQAASEAQKHLTFYELDLGLNHVSRKWSEQVDNGANMLVTVPGGGDGPSGVLVCAENFVIYKNQGHPDVRAVIPRRADLPAERGVLIVSAAMHKQKSMFFFLLQTEYGDVFKVTLDHDNERVSELKIKYFDTIPVTSSLCVLKLGFLFAASEFGNHGLYQFQAIGDDPDVESSSATLMETEEGFQPVFFQPRGLKNLVRIDQVESLMPIMDMKVTNLFEEETPQIFSLCGRGPRSSLRILRPGLAISEMAVSQLPGVPSAVWTVKKNVNDEFDAYIVVSFTNATLVLSIGETVEEVSDSGFLDTTPSLDVSLIGDDSLMQVHPTGIRHIREDGRINEWRTPGKRTIVKVGSNRLQVVVALSGGELIYFEVDMTGQLMEVEKHEMSGDIACLDIAPVPEGRQRSRFLAVGSYDNTIRILSLDPDDCMQVLSLQSVSSPPDSLLFLEVQASIGGEDGADHPASLFLNAGLQSGVLFRTVVDMVTGQLSDARSRFLGLRAPKLFSVAVRGRRAMLCLSSRPWLGYIHQGHFLLTPLSYETLEYAASFSSDQCAEGVVAVAGDALRVFTIERLGETFNETTIPLRYTPRKFVIQNKRKLLVIIESDQGAFAAEDREAARKECFEAAGMGENGKTETENGADDEDKDDPLSDEQYGYPKAESDKWVSCIRVLDPRTTETTCLLELQDNEAAFSICTVNFHDKEYGTLLAVGTAKSLQFWPKRSFSAGYIHIYRFLKDGKSLELLHKTQVDGVPLALSQFQGRLLAGIGPVLRLYDLGKRRLLRKCENKLFPNTINSIHTYRDRIYVGDIQESFHYCKYRRDENQLYIFADDSVPRWLTASYHIDFDTMAGGDKFGNIYFVRLPQDVSDEIEEDPTGGKIKWEQGKLNGAPNKVEEIVQFHVGDVVTCLQKASLIPGGQESLIYGTVMGSLGALLAFSSRDDVDFFNHLEMHMRQEHPPLCGRDHMAYRSAYFPVKDVVDGDLCEQFPTLPMDLQRKIADELDRTPGEILKKLEEIRNKIV

SEQ ID NO: 17051 - protein, 1213 aa, Lupinus angustifolius
MYLYNLTLQQPTGIVCAINGSFSGGKSQEIVVARGKVLDLLRPDDNGRIQTILSVEIFGSIRSLAQFRLTGAQKDYIVVGSDSGRIVILDYNKEKNVFDKIHQETFGKSGSRRIVPGQFIAIDPKGRAVMIGACEKQKLVYVLNRDTAARLTISSPLEAHKSHTLVYSICGVDCGFENPIFAAIELDYSEADLDSTGQAASEAQKHLTFYELDLGLNHVSRKWSEQVDNGANLLVTVPGGGDGPSGVLVCAENFVIYKNQGHQEVRAVIPRRADLPSERGVLIVSAAMHKLKSMFFFLLQTEYGDIFKVTLEHDGDRVSELKIKYFDTIPVTASMCVLKSGFLFAASEFGNHALYQFKAIGDDDDVEVSSATLEETQDGFKPVYFRPRRLKNLIRIDQVESLMPIMDMKVSNLFEEETPQIFTLCGRGPRSSLRILRTGLAVSEMAVSRLPGIPSAVWTVKKNVIDEFDAYIVVSFTNATLVLSIGETVEEVSDSGFLDTTPSLAVSLIGDDSLMQVHPNGIRHIREDGRINEWRTPGKRTIAKVGYNRLQVVIALSGGELIYFEVDVTGQLMEVEKHEMSGDVACLDIAPVPEGRQRSRFLAVGSYDKTIRILSLDPDDCMQALSVQSVSSAPESLLFLEVQASVGGEDGADHPASLFLNAGLQNGVLFRTVVDMVTGQLSDSRSRFLGLRAPKLFPIIVRGKRAMLCLSSRPWLGYIHQGHFLLTPLSYETLEYAASFSSDQCVEGVVAVAGEALRIFTIERLGETFNETVIPLRYTPRKFVLHPKRKLLVIVESDQGALTAEERESARKECFEATQAGENGTGSDPMENGGEDEDKDDALSDEHYGYPKTESDKWVSCIRVLDPRTGNTTCLLELQENEAAFSVCTVNFHDKEYGTLLAVGTAKGLQFLPRRTLTAGYIHIYRFVEDGRSLELLHKTQVEGVPLALCQFQGRLLAGIGPVLRLYDLGKRRLLRKCENKLFPNTIVSIHAYRDRIYVGDMQESFHYCKYRRDENQLYIFADDCVPRWLTASYHIDFDTMAGADKFGNVYFVRLPQDVSDEIEEDPTGGRIKWEQGKLNGAPNKVEEIVQFHVGDLITSLQKASLIPGGGECILYGTTMGSIGALHAFTSRDDVDFFSHLEMHLRQDHPPLCGRDHMAYRSAYFPVKDVIDGDLCEQYPTLPMDLQRKIADELDRTPGEILKKLEEVRNKII

SEQ ID NO: 17052 - protein, 1213 aa, Aquilegia formosa
MYLYSLTLQQATGIVCATNGNFIGGKSQEIVVARGKVLDLLRPDENGKLQTILSVEVFGAIRSLSHFRLTGSQKDYIVVGSDSGRIVILEYNKEKNVFDQIHQETFGKSGCRRIVPGQYIAVDPKGRAVMIAACEKQKLVYVLNRDSTARLTISSPLEAHKSHTIVYSIAGVDCGFDNPIFASIELDYLEADQDSTGQSANEAQKHLTFYELDLGLNHVSRKWSEPIDNGANMLVTVPGGGDGPSGILVCAENFVIYKNQGHPDVRAVIPRRADLPAERGVLIVSAATHRHRATFFFLLQTEYGDVFKCTLEHDNDRVTELKIKYFDTIPVTISMCVLKTGFLFAASEFGNHGLYQFRAIGEEADVESSSSTLMETEEGFQPVFFQPRGLKNLIRIDQVDSLMPIMDMKVANLFEEETPQIFTLCGRGPRSSLRILRPGLAVSEMAVSQLPGIPIAVWTVKKNINDEFDAYIVVSFASATLVLSIGETVEEVSDSGFLDTTPSLAVSLLGDDSLMQVHPKGIRHIREDGRIIQWETPGKRTIVKVATNRVQVVIALSGGELVYFEMDITGKLMEVEKHEMSGDVACLDIAPVPEGRQRSRFLAVGSYDNTIRILSLDPDDCMQVLSLQSVSSPPESLLLLEVQASVGGEDGADHPASVFLNAGLQNGVLFRTVVDMVTGQLSDTRSRFLGLRAPKLFSAVVRGRRAMLCLSSRPWLGYIHQGHFLLTPLSYETLEYAASFSSDQCAEGVVAVAGDALRVFTIERLGETFNETVIPLRYTPRKFVLHPKRKLLIVIESDQGAFTAEEREAARKECLEAAGMEENGNGNIDEMENGAENEENDPLSDEQYGYPKAEAEKWVSCIRVFEPRTTTTTCLLELQDNEAAFSVCTVNFSDKEYGTLLAVGTAKSLKFWPKRSFAAGFIHIYRFIEDGKGLQLLHKTQVEGIPLALCQFQGKLLAGIGSVLRLYDLGKRKLLRKCENKLFPNTIISLHTYRDRIYVGDIQESFHYCKYRRDENQLYIFADDSVPRWLTASYHIDFDTMAGADKFGNVYFMRLPQDLSDEIEEDPTGGKIKWEQGKLNGAPNKVEEIVQFHVGDVVTCLQKTSLIPGGGECLIYGTVMGCLGALLAFTSREDVDFFSHLEMHMRQEHPPLCGRDHIAYRSAYFPVKDVIDGDLCEQFPTLPADLQKKIADELDRTPGEIMKKLEDVRNRII

SEQ ID NO: 17053 - protein, 1212 aa, Chrysanthemum coronarium
MYLYNLTLQQATGIVTAITGTFSGQSKSQEIIVARGKSLTLLRPDENGKIQTILSHDVFGSIRSLAQFRLTGGSKDYIVVGSDSGRVVILEYNKEKNVFDKVHQETFGKSGSRRIVPGQYLAVDPKGRAVMIGACEKQKLVYVLNRDTAARLTISSPLEAHKSHTICFCICGVDVGFDNPVFAAIELDYSEADLDSSGAAVHEAQKVLTFYELDLGLNHVSRKWSESVDNGANLLVTVPGGGDGPSGVLVCAENFVIYKNQGHPDVRAVIPRRVDLPAERGVLIVSATMHKQKSMFFFLLQTEYGDVFKVTLEHDNERVSELKIKYFDTIPVTSAMCVMKLGFLFAASEFGNHALYQFQAIGADPDVESSSATLMETEDGFQPVFFKPRGLKNLVRIDQVESLMPIMDMKVVNFFEEETPQIFTLCGRGPRSTLRILRPGLAISEMAVSQLPGVPSAVWTVKKNVNDEFDAYIVVSFANATLVLSIGETVEEVSDSGFLDTTPSLAVSLIGDDSLMQVHPSGIRHIREDGRINEWRTPGKRTIVKVGSNRLQVVIALSGGEIIYFEVDMTGQLMEVEKNEMSGDVACLDIAPVPEGRQRSRFLAVGSYDNTIRILSLDPDDCMQVLSLQSVTAAPESLLFLEVQASVGGEDGADHPASLFLNAGLQNGVLFRTVVDMVTGQLSDARSRFLGLRAPKLFSILVRGRRAMLCLSSRPWLGYVHQGHFLLTPLSYETLEYAASFTSDQCAEGVVAVAGDALRVFTIERLGETFNETAIPLRYTPRKFVFHPKKKLLVTIESDQGAFTAELRESAKKECFEDAGQGENGRMEIENGGDDEDKEDPLSDEQYGYPKAEADKWVSCIRVLDPRSAETTCLLELQDNEAAFSICTVNFHDKEYGTLLAVGTAKGLQFWPKRSLVAGYIHIYRFVKDGRSLELLHKTQVDGVPLALCQFQGRLLAGIGPILRLYDLGKKRLLRKCENKMFPNTINSIHTYRDRIYVGDIQESFHYCKYRRDENQLYIFADDSVPRWLTAAYHVDFDTMAGADKFGNIYFVRLPQDVSDEIEEDPTGGKIKWEQGKLNGAPNKVDEIVQFHVGDVVTCMQKASLIPGGVECVMYGTVMGSLGALLAFSSRDDVDFFSHLEMHMRQEYPPLCGRDHMAYRSSYFPVKDVIDGDLCEQYPTLPLDAQRKIADELDRSPAEILKKLEDVRNKIV

SEQ ID NO: 17054 - protein, 1213 aa, Aquilegia formosa
MYLYSLTLQQATGIVCATNGNFIGGKSQEIVVARGKVLDLLRPDENGKLQTILSVEVFGAIRSLSHFRLTGSQKDYIVVGSDSGRIVILEYNKEKNVFDQIHQETFGKSGCRRIVPGQYIAVDPKGRAVMIAACEKQKLVYVLNRDSTARLTISSPLEAHKSHTIVYSIAGVDCGFDNPIFASIELDYLEADQDSTGQSANEAQKHLTFYELDLGLNHVSRKWSEPIDNGANMLVTVPGGGDGPSGILVCAENFVIYKNQGHPDVRAVIPRRADLPAERGVLIVSAATHRHRATFFFLLQTEYGDVFKCTLEHDNDRVTELKIKYFDTIPVTISMCVLKTGFLFAASEFGNHGLYQFRAIGEEADVESSSSTLMETEEGFQPVFFQPRGLKNLIRIDQVDSLMPIMDMKVANLFEEETPQIFTLCGRGPRSSLRILRPGLAVSEMAVSQLPGIPIAVWTVKKNINDEFDAYIVVSFASATLVLSIGETVEEVSDSGFLDTTPSLAVSLLGDDSLMQVHPKGIRHIREDGRIIQWETPGKRTIVKVATNRVQVVIALSGGELVYFEMDITGKLMEVEKHEMSGDVACLDIAPVPEGRQRSRFLAVGSYDNTIRILSLDPDDCMQVLSLQSVSSPPESLLLLEVQASVGGEDGADHPASVFLNAGLQNGVLFRTVVDMVTGQLSDTRSRFLGLRAPKLFSAVVRGRRAMLCLSSRPWLGYIHQGHFLLTPLSYETLEYAASFSSDQCAEGVVAVAGDALRVFTIERLGETFNETVIPLRYTPRKFVLHPKRKLLIVIESDQGAFTAEEREAARKECLEAAGMEENGNGNIDEMENGAENEENDPLSDEQYGYPKAEAEKWVSCIRVFEPRTTTTTCLLELQDNEAAFSVCTVNFSDKEYGTLLAVGTAKSLKFWPKRSFAAGFIHIYRFIEDGKGLQLLHKTQVEGIPLALCQFQGKLLAGIGSVLRLYDLGKRKLLRKCENKLFPNTIISLHTYRDRIYVGDIQESFHYCKYRRDENQLYIFADDSVPKWLTASYHIDFDTMAGADKFGNVYFMRLPQDLSDEIEEDPTGGKIKWEQGKLNGAPNKVEEIVQFHVGDVVTCLQKTSLIPGGGECLIYGTVMGCLGALLAFTSREDVDFFSHLEMHMRQEHPPLCGRDHIAYRSAYFPVKDVIDGDLCEQFPTLPADLQKKIADELDRTPGEIMKKLEDVRNRII

SEQ ID NO: 17055 - protein, 1211 aa, Petroselinum crispum
MYLYNLTLQQATGIVCAINGSFTGGKSQEIVVARGKVLDLLRPDDNGKIQTILSVEVFGVIRSLAHFRLTGAHKDYIVVGSDSGRIVILEYNKEKNVFDKIHQETFGKSGCRRIVPGQYLGIDPKGRAVMVGACEKQKLVYVLNRDTSARLTISSPLEAHKSHTIVYSIVGVDCGFDNPIFAAIELDYSEADQDSTGQAASEAQKHLTFYELDLGLNHVSRKWSEQVDNGANMLVTVPGGGDGPSGVLVCAENFVIYKNQGHPDVRAVIPRRADLPAERGVLIVSAAMHKQKSMFFFLLQTEYGDIFKVTLDHDNERVSELKIKYFDTIPVTSSLCVMKLGFLFAASEFGNHGLYQFQAIGDDPDVESSSATLMETEEGFQPVFFQPRGLKNLVRIDQVESLMPIMDMKVTNIFEEETPQIFSLCGRGPRSSLRILRPGLAITEMAVSQLPGVPSAVWTVKKNVNDEFDAYIVVSFTNATLVLSIGETVEEVSDSGFLDTTPSLEVSLIGDDSLMQVHPTGIRHIREDGRINEWRTPGKRTIVKVGSNRLQVVVALSGGELIYFEVDMTGQLMEVEKHDMSGDVACLDIAPVPEGRQRSRFLAVGSYDNTIRILSLDPDDCMQILSLQSVSSPPDSLLFLEVQASIGGEDGADHPANLFLNAGLQSGVLFRTVVDMVTGQLSDARSRFLGLRAPKLFSVAVRGRRAMLCLSSRPWLGYIHQGHFLLTPLSYETLEYAASFSSDQCAEGVVAVAGDALRVFTIDRLGETFNESTIPLRYTPRKFVIQSKRKLLVIIESDQGAFAAEDREAARKECFEAAGMGANGKIEAENGGDDEDKDDPLSDEQYGYPKAESDKWVSCIRVLDPKTTETTCLLELQDNEAAFSICTVNFHDKEHGTLLAVGTAKGLQFWPEKSFSAGYIHIYRFLKDGKSLELLHKTQVDGVPLALSQFQGRLLAGIGPVLRLYDLGKRRLLRKCENKLFPNTINSIHTYRDRIYVGDLQESFHYCKYRRDENQLYIFADDSVPRWLTASYHIDFDTMAGGDKFGNIYFVRLPQDVSDEIEEDPTGGKIKWEQGKLNGAPNKVEEIVQFHVGDVVTCLQKASLIPGGQESLIYGTVMGSLGALLAFSSRDDVDFFNHLEMHMRQEHPPLCGRDHMAYRSAYFPVKDVVDGDLCEQFPTLPMDLQRKIADELDRTPGEILKKLEEIRNKIV

SEQ ID NO: 17056 - protein, 1214 aa, Eutrema parvulum
MYLYSLTLQQATGIICAINGNFSGGKTQEIAVARGKILDLLRPDENGKIQTIHSVEVFGAIRSLAQFRLTGAQKDYIVVGSDSGRIVILEYNKEKNVFDKVHQETFGKSGCRRIVPGQYLAVDPKGRAVMIGACEKQKLVYVLNRDTAARLTISSPLEAHKSHTICYSICGVDCGFDNPIFAAIELDYSEADQDPTGQAASEAQKHLTFYELDLGLNHVSRKWSEPVDNGANMLVTVPGGADGPSGVLVCAENFVIYKNQGHPDVRAVIPRRADLPAERGVLVVSAAMHKQKTMFFFLLQTEYGDVFKVTLDHDGDHVSELKIKYFDTIPVAASICVLKLGFLFSASEFGNHGLYQFQAIGEEPDVESSSSNLMETEEGFQPVFFQPRRLKNLVRIDQVESLMPLMDMKILNLFEEETPQIFSLCGRGPRSSLRILRPGLAISEMAVSQLPGQPSAVWTVKKNVSDEFDAYIVVSFTNATLVLSIGETVEEVNDSGFLDTTPSLAVSLIGDDSLMQVHPNGIRHIREDGRINEWRTPGKRSIVKVGYNRLQVVIALSGGELIYFEADMTGQLMEVEKHEMSGDVACLDIAPVPEGRQRSRFLAVGSYDNTVRILSLDPDDCLQILSVQSVSSAPESLLFLEVQASVGGDDGADHPASLFLNSGLQNGVLFRTVVDMVTGQLSDSRSRFLGLKPPKLFSIAVRGRSAMLCLSSRPWLGYIHRGHFHLTPLSYETLEFAAPFSSDQCAEGVVSVAGDALRIFMFDRLGETFNETVVPLRYTPRKFVVQPKRKLLVIIESDQGAFTAEEREAARKECFEAGGAGENGNGGADQMENGADDEDKEDPLSDEQYGYPKAESEKWVSCIRVVDPKTAATTCLLELQDNEAAYSVCTVNFHDKEYGTLLAVGTVKGMQFWPKKNLVAGFIHIYRFVEEGRSLELLHKTQVEGVPLALCQFQGRLLAGIGPVLRLYDLGKKRLLRKCENKLFPNTIISIQTYRDRIYVGDIQESFHYCKYRRDENQLYIFADDCVPRWLTASHHVDFDTMAGADKFGNIYFVRLPQDVSEEIEEDPTGGKIKWEQGKLNGAPNKVDEIVQFHVGDVVTCLQKASMIPGGSESIMYGTVMGSIGALHAFTSRDDVDFFSHLEMHMRQEYPPLCGRDHMAYRSAYFPVKDVIDGDLCEQFPTLPIDLQRKIADELDRTPAEILKKLEDARNKIV

SEQ ID NO: 17057 - protein, 325 aa, Saccharum officinarum
MEETLAVESAAGETASAQAPERKEETLEEVLSRHRKEKSKLQDKETSLKKAAAKGSKAEQKAKKKQVEEEITRLSRELEANHAAELASFGYKPSGSSEKGNLDNLVKAIAGVSVSSNSDSTKPSKGARRREKKAKEEAAREQRIQEEQSNLVSDRVLENEKLERKLEPLGLTIQEIKPDGHCLYRAVENQLLLHSNGAARYSYQDLRQMAAKYMREHAADFLPFYLAEGKADIGPDPMESFEKYCKEMESTAAWGGQLELGALTHCLKKHIVVYSGSFPDVEMGKEYKSGSGGSGAGDASIRLSFHRHAYGPGEHYNSVIPAESS

SEQ ID NO: 17058 - protein, 325 aa, Zea mays
MEETLAVESAAGETAAAQAPELNEETLEEVLSRHRKEKSKLQDKETSLKKAAAKGSKAEQKAKKKQVEEEITRLSSELEANHAAELASFGYKPSGSSEKGNLDNLVKAIAGVSVSSNSDSAKLSKGARRREKKAKEEAAREQRIQEEQSNLVSDRMLENEKLERKLEPLGLTVQEIKPDGHCLYRAVENQLSLHSNGAARYSYQDLRQMTAKYMREHAANFLPFYLAEGKADVGPDPMASFERYCEEMESTAAWGGQLELGALTHCLKKHIVVYSGSFPDVEMGKEYKSGPGGSGAGGASIRLSFHRHAYGLGEHYNSVVPAGSS

SEQ ID NO: 17059 - protein, 327 aa, Echinochloa colona
MEETLAAESTAGEAPAAVAPERKEETLEEVLSRHRKEKSKLQDKETSLKKAAAKGSKAEQKAKKKQVEEEITRLSAELEAKHAAELASFGYKPSGSSSEKGNLDNLVKAIAGVSMSSNSESAKPSKGARRREKKAKEEAAREQRIQEEQSNLVSDRMVENEKLERKLEPLGLTIQEIKPDGHCLYRAVENQLLLHSNGGARYSYQDLRQMTAKYMREHAADFLPFFLAEGKVEIGPDPSESFERYCQEIESTAAWGGQLELGALTHCLKKHIVVYSGSFPDVEMGKEYKSGSVGGSSSGDASIRLSFHRHAYGLGEHYNSVIPVESS

SEQ ID NO: 17060 - protein, 325 aa, Panicum virgatum
MEETLAVESAAGEAPAAVASERKEETLEEVLSRHRKEKSKLQDKETSLKKAAAKGSKAEQKAKKKQVEEEITRLSAELEAKHAAELASFGYKPSGSSEKGNLDNLVKAIAGVSMSSNLDSAKPSKGARRREKKAKEEAAREQRIQEEQSNLVSDRMLEKEKLESKLEPLGLTIQEIKPDGHCLYRAVENQLLLHSKGTARYSYQDLRQMTAKYMREHADDFLPFFLAEGKAETGSDPSESFEKYCQEIESTAAWGGQLELGALTHCLKKHIVVYSGSFPDVEMGQEYKSGSGGSSVGDASIRLSFHRHAYGLGEHYNSVIPTESS

SEQ ID NO: 17061 - protein, 323 aa, Setaria italica
MEETLAAESAAGETHAAVETERKEETLEEVLARHRKEKSKLQDKETSLKKAAAKGSKAEQKARKKQVEEEITRLSAELEAKHAAELASFGYKPSGSSEKGNLDNLVKAIAGVTMSSNSESAKPSKGAKRRQKKAKEEAAREQRIQEEQSNLVSDRMLENDKLESKLEPLGLTVQEIKPDGHCLYRAVENQLSLHSNGTARYSYQDLRQMTAKYMREHAADFLPFFLAEGKAETGSDPSESFEKYCQEIESTAAWGGHLELGALTHCLKKHIVVYSGSFPDVEMGQEYKSGGSSAGDASIRLSFHRHAYGLGEHYNSVIPTESS

SEQ ID NO: 17062 - protein, 323 aa, Oryza sativa
MDETLADESAAGGGEAAAAEPAQESQQETLEEVLSRHRKEKSKLQDKETSLKKAAAKGSKAEQKAKKKQVEEEISRLSAELEAKHAAELATFGYKSSGSSEKGNMDTLVKAIAGVSVTSNADSAKPSKGARRREKKAKEEAAREQRIQEEQNNLVSDRMIENEKLEKKLEPMGLTIQEIKPDGHCLYRAVENQLSLYSRETTQYNYQELRQMTANYMKEHAADFLPFFLSEGKVESGPDPLESFKRYCEEVESTAAWGGQLELGALTHCLKKHIVVYSGSFPDVEMGKEYKLDSGGKDGPSIRLSYHRHAYGLGEHYNSVVPA

SEQ ID NO: 17063 - protein, 323 aa, Triticum aestivum
MDETLAAEAGAAAATEEKAVPEREPETLEEVISRHRKEKSKLQDKETSLKKAAAKGSKAEQKAKKKQVEEEISRLSAALEAKHAAELASFGYKPAESSEKGNLDTLVKAIAGVSVSSNADSAKPGKAAKRREKKAKEEAAREQRIQEEQTNLVSDRMLEDEKLGRRLEPLGLTIHEIKPDGHCLYRAIENQLSLHSKGTTQYNHQELRQMTAKYMREHAADFLPFFLSEGKAESGPDPSESFEKYCEEMESTAAWGGQLELGALTHCLKKHIVVYSGSFPDVEMGKEYNKSGPGGDPSIRLSYHRHAYGLGEHYNSVIPTELS

SEQ ID NO: 17064 - protein, 323 aa, Oryza sativa
MDETLADESAAGGGEAAAAEPAQESQQETLEEVLSRHRKEKSKLQDKETSLKKAAAKGSKAEQKAKKKQVEEEISRLSAELEAKHAAELATFGYKSSGSSEKGNMDTLVKAIAGVSVTSNADSAKPSKGARRREKKAKEEAAREQRIQEEQNNLVSDRMIENEKLEKKLEPMGLTIQEIKPDGHCLYRAVENQLSLYSRETTQYNYQELRQMTANYMKEHAADFLPFFLSEGKVESGPDPLESFKRYCEEVESTAAWGGQLELGALTHCLKKRIVVYSGSFPDVEMGKEYKLDSGGKDGPSIRLSYHRHAYGLGEHYNSVVPA

SEQ ID NO: 17065 - protein, 323 aa, Secale cereale
MDETLAAEAGAAAATEEKAVPEREPETLEEVISRHRKEKSKLQDKETSLKKAAAKGSKAEQKAKKKQVEEEILRLSAALEAKHAAELASFGYKPAESSEKGNLDTLVKAIAGVSVSSNADSAKPGKAAKRREKKAKEEAAREQRIQEEQTNLVSDRMLEDEKLGRRLEPLGLTIHEIKPDGHCLYRAIENQLSLHSKGTTQYNHQELRQMTAKYMREHAADFLPFFLSEGKAESGPDPSESFEKYCEEMESTAAWGGQLELGALTHCLKKHIVVYSGSFPDVEMGKEYNKSGPGGDPSIKLSYHRHAYGLGEHYNSVIPTELS

SEQ ID NO: 17066 - protein, 329 aa, Leymus cinereus x Leymus triticoides
MDETLAAEAGAAVAAAAAATEEKAVPERELETLEEVISRHRKEKSKLQDKETSLKKAAAKGSKAEQKAKKKQVEEEISRLSAELEAKHAAELASFGYKPAGSSEKGNLDTLVKAIAGVSVSSNADSAKPGKAAKRREKKAKEEAAREQRIQEEQTNLVSDRMLEDEKLGRKLQPLGLTIHEIKPDGHCLYRAVENQLSLHSNGTTQYNHQELRQMTPKYMREHAADFLPFFLSEGKAEAGPDPSESFERYCEEIESTAAWGGQLELGALTHCLKKHIVVYSGSFPDVEMGKEYTKKSEPGGDPSIRLSYHRHAYGLGEHYNSVIPTELS

SEQ ID NO: 17067 - protein, 324 aa, Brachypodium distachyon
MEETLAVEAPATAVGQEEAAPEREPETLEEVISRHRKEKSKLQDKETSLKKAAAKGSKAEQKAKKKQVEEEISRLSAELEAKHAAELASFGYKPTGTSEKGNLDTLVKAIAGVSVSSNAESMKPGKAARRREKKAKEEAARDQRIEEEQANLVTDRMLEDEKLEKKLKPLGLTIREIKPDGHCLYRAIENQLSLHSKGTTQYNHQELRQMAAKYMRDHAADFLPFFLSEGKAESGPDPSESFEKYCEEMESTAAWGGQLELGALTHCLKKHIMVYSGSFPDVEMGKEYSKKSESGSDPSIRLSYHRHAYGLGEHYNSVIPTELS

SEQ ID NO: 17068 - protein, 326 aa, Hordeum vulgare
MDETLAAEAGAAAAGATEEKAVPERQPETLEEVISRHRKEKSKLQDKETSLKKAAAKGSKAEQKAKKKQVEEEISRLSAALEAKHAAELASFGYKPAESSEKGNLDTLVKAIAGVSVSSNADSAKPGKAAKRREKKAKEEAAREQRIQEEQTNLVSDRMLEDEKLGRRLEPLGLTIHEIKPDGHCLYRAIENQLSLHSKGTTQYNHQELRQMTAKYMREHAADFLPFFLSEGKAESGPDLSESFEKYCEEMESTAAWGGQLELGALTHCLKKHIVVYSGSFPDVEMGKEYNKKSEPGGDPSIRLSYHRHAYGLGEHYNSVIPTELS

SEQ ID NO: 17069 - protein, 323 aa, Lolium multiflorum
MDETLAAAAAPLPEQAAPEREKETLEEVMSRHRKEKSKLQDKETNLKKAAAKGSKAEQKAKKKQVEEEISRLSAELEAKHAAELASFGYKAEGSSEKGNLDTLVKAIAGVSVSSNADSAKQPGKAAKRREKKAKEEAAREQRIQEEQTNLVSDRMVEDEKLEKRLEPLGLTIHEIKPDGHCLYRAIENQLSLHSKGTTQYSHQELRQMTAKYMREHAADFLPFFLSEGKAEAGPDPSKSFESYCAEIESTAAWGGQLELGALTHCLKKHIVVYSGSFPDVEMGKEYNKKLEAGGDPSIRLSYHRHAYGLGEHYNSVIPAELET

SEQ ID NO: 17070 - protein, 286 aa, Panicum virgatum
KLQDKETSLKKAAAKGSKAEQKAKKKQVEEEIARLSAELEAKHATELASFGYKPSGSSEKGNLDNLVKAIAGVSMSSNLDSAKPSKGARRREKKAKDEAAREQRIQEEQSNLVSDRMLENEKLENKLEPLGLTIQEIKPDGHCLYRAVENQLLLHSKGTAQYSYQDLRQMTAKYMREHADDFLPFFLAEGKAETGSDPSESFEKYCQEIESTAAWGGQLELGALTHCLKKHIVVYSGSFPDVEMGLEYKSGSGGNSAGDASIRLSFHRHAYGLGEHYNSVIPTESS

SEQ ID NO: 17071 - protein, 501 aa, Saccharum officinarum
MWKQFLSKLPRKSSASGDSGQCSNGTGIQRTSSCGSIPPGRPASAIRRMSSAVFPSTVVAGIEPLVSFKDVPNSEKQNLFVSKLSLCCVVFDFSDPNKSSVEKDIKRQALLDLIEFVESTNARFSEAAIAACSRMCAINLFRAFPPNCRSGSSGGGEGDEDEPMFDPAWCHLQLVYELLLKFIGSSSLDAKIGKKHFDHSFIVKLLNLLDSEDPRERDCLKTILHRVYGKFMVHRPFIRKAVSNIFYQFVFETDRHNGIAELLEVFGSVISGFALPLKEEHKIFLWRVLVPLHKPKSVGVYLQQLTYCVTQFIEKDPKLASSVIIGLLRYWPITNCQKEVMFLSEIEEILESTSQAEFQKCMVPLFRRIAHCITSSHFQVAERALFVWNNDHIISLIAQNRQVIMPLVVPALEHNIQNHWNQAVLNLTVNVKKMFSEMDDDLSSSCLAKYKEEEEKRVSIEAKRKLTWEKLEAAAAFQPVTGHTAVLVGHQPSANMIATLI

SEQ ID NO: 17072 - protein, 501 aa, Zea mays
MWKQLLSKLPRKSPACGDSGQCSNGTGIQRTSSCGSIPPGRPASAIRRMSSAVFPSSVVAGIEPLVSFKDVPNSEKQNLFVSKLSLCCVVFDFSDPNKSSVEKDIKRQALLDLIEFVESTNARFSEAAIAACSRMCAINLFRAFPPSCRSGSSGGGEGDEEEPMFDPAWCHLQLVYELLLKFIGSSSLDAKVGKKHFDHSFIVKLLNLLDSEDPRERDCLKTILHRVYGKFMVHRPFIRKAVSNIFYQFVFETDRHNGIAELLEVFGSVISGFALPLKEEHKIFLWRVLIPLHKPKSVGVYLQQLTYCVTQFLEKDPKLASSVIIGLLRYWPITNCQKEVMFLSEIEEILESTSQAEFQKCMVPLFRRIAHCITSSHFQVAERALFVWNNDHIISLIAQNRQVIMPLVIPALEQNIQNHWNQAVLNLTVNVKKMLSEMDDDLFSSCLAKYKDEEEKRVSLEAKRRLTWEKLESAAAFQPVTGHTAVLVGHRPSANLIATMI

SEQ ID NO: 17073 - protein, 501 aa, Panicum virgatum
MWKQFLSKLPRKSPASGDSGQCSNGTGIQRTTSCGSIPPGRPASAIRRMSSAVFPSSVVAGIEPLVSFKDVPNSEKQNLFVSKLSLCCVVFDFSDPNKSSVEKDIKRQALLDLIEFVESSSARFSEAAIAACARMCAINLFRAFPPNYRSGSSGGGEGDEDEPMFDPAWCHLQLVYELLLKFIGSSSLDAKVGKKHFDHSFIVKLLNLLDSEDPRERDCLKTILHRVYGKFMVHRPFIRKAVSNIFYQFVFETDRHNGIAELLEVFGSVISGFALPLKEEHKIFLWRVLIPLHKPKSVGLYLQQLTYCVTQFLEKDPKLASSVIIGLLRYWPITNCQKEVMFLSEIEEILESTSQAEFQKCMVPLFRRIAHCITSSHFQVAERALFVWNNDHIISLIAQNRQVIMPLVVPALEQNIQNHWNQAVLNLTMNVKKMFSEMDEDLFSSCLDKYKEDEEKRASLEVKRKLTWEKLESAAAFQPVTGHTAVLVGHQLSAKMIATLI

SEQ ID NO: 17074 - protein, 500 aa, Setaria italica
MWKQFLSKLPRKSSASGDSGQCSNGTGIQRTSSLGSIPPSRPASAIRRMSSAVFPSSVVAGIEPLVSFKDVPNSEKQNLFVSKLSLCCVVFDFSDPNKSSVEKDIKRQALLDLIEFVESSNARFSEASIAACARMCAINLFRAFPPNYRSGSCGGEGDEDEPMFDPAWCHLQLVYELLLKFIGSSSLDAKVGKKHFDHSFIVKLLNLLDSEDPRERDCLKTILHRIYGKFMVHRPFIRKAVSNIFYQFVFETDRHNGIAELLEVFGSVISGFALPLKEEHKIFLWRVLIPLHKPKSVGLYLQQLTYCVTQFLEKDPKLASSVIIGLLRYWPITNCQKEVMFLSEIEEILESTSQAEFQKCMVPLFRRIAHCITSSHFQVAERALFVWNNDHIISLIAQNRQVIMPLVVPALEQNIQNHWNQAVLNLTLNVKKMFSEMDEDLFSSCLAKYKEDEEKRVSFEVKRKLTWEKLESAAAFQPVTGHTAVLVGHQPSANMTATLI

SEQ ID NO: 17075 - protein, 500 aa, Pennisetum glaucum
MWKQFLSKLPRKSSASGDSGQCSNGTGIQRTSSLGSIPPSRPASAIRRMSSAVFPSSVVAGIEPLVSFKDVPNSEKQNLFVSKLSLCCVIFDFSDPNKSSVEKDIKRQALLDLIEFVESSNGRFSEASIAACARMCAINLFRAFPPNYRSGSSGGEGDEDEPMFDPAWCHLQLVYELLLKFIGSSSLDSKVGKKHFDHSFIVKLLNLLDSEDPRERDCLKTILHRVYGKFMVHRPFIRKAVSNIFYQFVFETDRHNGIAELLEVFGSVISGFALPLKEEHKIFLWRVLIPLHKPKSVGLYLQQLTYCVTQFLEKDPKLASSVILGLLRYWPITNCQKEVMFLSEIEEILESTSQAEFQKCMVPLFRRIAHCITSSHFQVAERALFVWNNDHIISLIAQNRQVIMPLVVPALEQNIQNHWNQAVLNLTLNVKKMFSEMDEDLFSSCLAKYKEDEEKQVSLEVKRKLTWEKLESAAAFQPVTGHTAVLVGHQPSANMIATLI

SEQ ID NO: 17076 - protein, 501 aa, Panicum virgatum
MWKQFLSKLPRKSSASADSGQCSNGTGIQRTTSCGSIPPGRPASAIRRMSSAVFPSSVVAGIEPLVSFKDVPNSEKQNLFVSKLSLCCVVFDFSDPNKSSVEKDIKRQALLDLIEFVESSSARFSEAAIAACARMCAINLFRAFPPNYRSGSSGGGEGDEDEPMFDPAWCHLQLVYELLMKFIGSSSLDAKVGKKHFDHSFIVKLLNLLDSEDPRERDCLKTILHRVYGKFMVHRPFIRKAVSNIFYQFVFETDRHNGIAELLEVFGSVISGFALPLKEEHKIFLWRVLIPLHKPKSVGLYLQQLTYCVTQFLEKDPKLASSVIIGLLRYWPITNCQKEVMFLSEIEEILESTSQAEFQKCMVPLFRRIAHCITSSHFQVAERALFVWNNDHIISLIAQNRQVILPLVVPALEQNIQNHWNQAVLNLTMNVKKMFSEMDEDLFSSCLDKYKEDEEKRASLELKRKLTWEKLESAAALQPVTGHAAVLVGHQLSANMIATLI

SEQ ID NO: 17077 - protein, 504 aa, Zea mays
MWKQFLSKLPRRSSASGDSGHCSSGAGIQRTSSCGSIPPGRPPASAIRRMSSAVFPSSVVAGIEPLVSFKDVPSSEKQSLFVSKLSLCCVVFDFSDPDRSSVEKDIKRQALLDLIEFVESTNARFSEAAVVACSRMCAVNLFRAFPASCRSGGSSGVGECDEDEPMFDTGWCHLHLVYELLLKFIGSSSLDAKIGKKHFDHSFIVKLLDLLHSEDPRERDCVKNILHRVYGKFMVHRPFIRRAASNVFYQFVFETDRHNGIAELLEVFGSVISGFALPLKEEHKTFLWRVLVPLHKPKSLGAYLQQLTYCVTQFIEKDPELASPVIIGLLRYWPITNCQKEVMFLSEIEEILEATSQAEFQKCMAPLFRRIAHCITSAHFQVAERALFMWNNDHIVSLIAQNRQVIMSLVVPALEQNIQNHWNQAVLNLAVNVKKMFSEMDGDHFSSCLARYKEEEERLVSLEAKRKLTWEKLESAAAFQPVTGQTAVLVGHQPSANMIANLIF

SEQ ID NO: 17078 - protein, 510 aa, Oryza sativa
MWKGFLSKLPRKTSASGRGADLDSGQCSNGAGNGNPIQRTSSCGSIPSGRSTSTIKRMSSAIFPSSVVAGIEPLVSFKDVPNSEKQNLFVSKLNLCCAVFDFSDPNKSSAEKDIKRQTLLDLIDYVDSSSSRFSEAVIAASSRMFAVNLFRVFPPNYRSGSSGGGEGEEEEPMFEPAWCHLQLVYELLLKFIGSSSLDAKVGKKYFDHSFIVKLLNLLDSEDPRERDCLKTILHRIYGKFMVHRPFIRKAVSNIFYHFVFETDRHNGIAELLEVFGSVISGFALPLKEEHKIFLWRVLVPLHKPKSVGVYLQQLTYCVTQFIEKDPKLASSVIIGLLRYWPITNSQKEVMFLSEIEEILETISTAEFQKCMVPLFRRIAQCIKSSHFQVAERALFIWNNDNVISLIAQNRQMIMPIIVPALEHNSQNHWNQAVLNLTDNVKKMFSEMDDVLFSACLVKYKEDEETQASLESKRRLTWEKLESAASFQPVTGHTAVLVGRQPSANLIATLI

SEQ ID NO: 17079 - protein, 510 aa, Oryza sativa
MWKGFLSKLPRKTSASGRGADLDSGQCSNGAGNGNPIQRTSSCGSIPSGRSTSTIKRMSSAIFPSSVVAGIEPLVSFKDVPNSEKQNLFVSKLNLCCAVFDFSDPNKSSAEKDIKRQTLLDLIDYVDSSSSRFSEAVIAASSRMFAVNLFRVFPPNYRSSSSGGGEGEEEEPMFEPAWCHLQLVYELLLKFIGSSSLDAKVGKKYFDHSFIVKLLNLLDSEDPRERDCLKTILHRIYGKFMVHRPFIRKAVSNIFYHFVFETDRHNGIAELLEVFGSVISGFALPLKEEHKIFLWRVLVPLHKPKSVGVYLQQLTYCVTQFIEKDPKLASSVIIGLLRYWPITNSQKEVMFLSEIEEILETISTAEFQKCMVPLFRRIAQCIKSSHFQVAERALFIWNNDNVISLIAQNRQMIMPIIVPALEHNSQNHWNQAVLNLTDNVKKMFSEMDDVLFSACLVKYKEDEERQASLESKRRLTWEKLESAASFQPVTGHTAVLVGRQPSANLIATLI

SEQ ID NO: 17080 - protein, 506 aa, Brachypodium distachyon
MWKQFLSKLPRKSSGSGRDDFDSGQCSNGNGSSIQRTSSCGSIPAGRSTSTIKRMSSAVFPSSVVAGIEPLVSFKDVPNSEKQNLFVSKLNLCCAVFDFSDPSKSSAEKDIKRQTLLDLVDFVDSSSSRFSEAVIAACSRMFAVNLFRVFPPNYRSGSGGGEGDEDEPMFDPAWCHLQLVYELLLKFIGSNSLDAKIGKKYFDHSFIVRLLNLLDSEDPRERDCLKTILHRIYGKFMVHRPFIRKAVSNIFYHFVFETQRHNGIAELLEVFGSVISGFALPLKEEHKIFLWRVLIPLHKPKSVGVYLQQLTYCVTQFLEKDPKLAGSIIIGLLRYWPITNSQKEVMFLSEIEEILEATSMVEFQKCMVPLFRRIAHCVNSSHFQVAERALFMWNNDHIISLVAQNRLVIMPIIVPALEQNSQNHWNQAVLNLTANVMKMFSEMDEELFSACLTKCKEEDDNQASLEEKRRLTWEKLESAAALQPVTGHTAVLVGRQPSANLIATLI

SEQ ID NO: 17081 - protein, 500 aa, Hordeum vulgare
MWKQFLSKLPRTKSSGGGGGGDSGQCSGGNGNPIQRTSSVPAGGGGRSASTIKRMSSAVFPSSVVAGIEPLVSFKDVPSSERHNLFVSKLGLCCAVFDFSDPAKSSAEKDIKRQTLLDLIDFVDSSSGRYPEAVIAACSRMLAVNLFRVFPPSYRSGGGSSGGGGGGEGDEDEPMFDPAWCHLQLVYELLLKFIGSSSLDAKIGKKYFDHSFIVRLLNLLDSEDPRERDSLKTILHRIYGKFMVHRPFIRKAVSNIFYHFVFETQRHNGIAELLEVFGSVISGFALPLKEEHKIFLWRVLIPLHKPKSVGVYLQQLTYCVTQFLEKDPKLAGSIIIGLLRYWPVTNSQKEVMFLSEIEEILEATSMVEFQKCMVPLFRRIAHCINSSHFQVAERALFMWNNDHIISLVAQNRQVIMPIIVPALEQNGQNHWNHAVLNLTANVMKMFSEMDEELFSVCLTKCKEDEENQVSMEEKRRLKWAKLESAAALQPVTGHTAVLVG

SEQ ID NO: 17082 - protein, 500 aa, Hordeum vulgare
MWKQFLSKLPRTKSSGGGGGGDSGQCSGGNGNPIQRTSSVPAGGGGRSASTIKRMSSAVFPSSVVAGIEPLVSFKDVPSSERHNLFVSKLGLCCAVFDFSDPAKSSAEKDIKRQTLLDLIDFVDSSSGRYPEAVIAACSRMLAVNLFRVFPPSYRSGGGSSGGGGGGEGDEDEPMFDPAWCHLQLVYELLLKFIGSNSLDAKIGKKYFDHSFIVRLLNLLDSEDPRERDSLKTILHRIYGKFMVHRPFIRKAVSNIFYHFVFETQRHNGIAELLEVFGSVISGFALPLKEEHKIFLWRVLIPLHKPKSVGVYLQQLTYCVTQFLEKDPKLAGSIIIGLLRYWPVTNSQKEVMFLSEIEEILEATSMVEFQKCMVPLFRRIAHCINSSHFQVAERALFMWNNDHIISLVAQNRQVIMPIIVPALEQNGQNHWNHAVLNLTANVMKMFSEMDEELFSVCLTKCKEDEENQVSMEEKRRLKWAKLESAAALQPVTGHTAVLVG

SEQ ID NO: 17083 - protein, 514 aa, Avena sativa
MWKQFLGKLPRTKSSGAGRDGFDAGQCSSNSTNWEYSAPPRLPSGGGSAGGRSASAIKRMSSAVFPSSVVAGIEPLVAFKDVPGSERHNLFVSKLGLCCAVFDFSDPAKSAAEKDIKRQALLDLVDFVDTNTSRFSEPVIAACSRMFAVNLFRVFPPNYRSGSSSSGSGEGDEDEPMFDPAWYHLQLVYELLLKFIGSTSLDAKVGKKYFDHSFIVRLLNLLDSEDPRERDSLKTILHRIYGKFMVHRPFIRKAVSNIFYHFVFETQRHNGIAELLEVFGSVISGFALPLKEEHKIFLWRVLIPLHKPKSVGVYLQQLTYCVTQFLDKDPKLAGSIIIGLLRYWPITNSQKEVMFLSEIEEILEATSAVEFQKCMVPLFRRIAHCINSSHFQVAERALFMWNNDHIISLIAQNRQVIMPIIVPALEQNSQTHWNQAVLNLTANVMKMFSEVDEELFSACLTKCKEDEENQASLEEKRRLTWARLESAAALQPVTGHTAVLVGRQPSANLIATLI

SEQ ID NO: 17084 - protein, 289 aa, Zea mays
MGDAAETNKTLHNWMGEPRPRSSDQRDEEETLQLSLGLPGGGASAGGGVAPAAWRMLPARDEEMRSAAAVVDTSLLSLGYSAPAFSPRSPGKAKGSPAAATENALASTNNASQRRSPNTPVIGWPPVRAFRRNLATSSRASLEHQNGKKAAKPEQTTKRAPFVKINMDGIPIGRKIDLSALGSYDELSLSVDKLFRGLLAAQQDPLAAGAKECSQEEVAISGLLDGTGEYTLVYEDYEGDRVLVGDVPWGMFVSSVKRLRVLKTSDLSSSLTAPPGQKRTVTECPVFTS

SEQ ID NO: 17085 - protein, 607 aa, Triticum aestivum
VEGRFVVEKNSLRVTSPAALRGVYECAIGNFGMPQYGGTMHGVVVYPKANTKACKPFADFGLSFNPKAGGLPVFLLVDRGDCYFTTKGWNAQTAGAAAVLVADDRAEPLITMDTPESSGKEHLENITVPSALVSKRFGDDLKTALENGDMVNVLLDWRESLPHPDERVEYEFWTNSNDECGAKCDMQMSFVRDFRGVAQVLEQRGYTQFAPHYITWYCPEAFVLSAQCRSQCINHGRYCAPDPEQDFTTGYDGKDVVVQNLIQICLFKVANESRKPWLWWDYVHDFAIRCPMKEKKYTTDCAHGVIKSLGMDIDKITQCVGDPDADEDNPVLKAEQDAQIGHGARGDVTILPTFVVNNRQYRGKLDKRAVLRAICSGFEETTEPDICLTQDIQTNQCLENNGGCWLDKNTNFTACKDTFRGRVCECPVVNGVKFVGDGYTHCEASGVGRCQINNGGCWKETRNGKSVSACSNEQAKGCKCPQGFKGDGIHGCEDVDECKERLFCQCKDCSCENTWGSYECGCGGSNMLYMREHDTCISKVATSSVGWGFMWVIFFGLGFAGVGAYAVYKYRLRSYMDSEIRAIMAQYMPLENQETSSHQRHVDHADI

SEQ ID NO: 17086 - protein, 646 aa, Brachypodium distachyon
MGGGRRFSPPPPAVGWRQRNRAPAVVLIVALVMMAEPAAARFVVEKNSLRVTSPAALRGVYECAIGNFGMPQYGGTMHGVVVYPKANAKACADFRDSAGLNFSPKPGGLPVFLLVDRGECYFTTKGWNAQTAGAAAVLVADDRVEPLITMDTPESSGKEHLENISVPSALVSKRLGDDLKNALQNGDMVNVLLDWRESLPHPDERVEYEFWTNSNDECGAKCDMQMNFVRSFRGIAQVLEQRGYTQFAPHYITWYCPEAFILSKQCRSQCINHGRYCAPDPEQDFSIGYDGRDVVVQNLIQICLFKVANETRKPWLWWDYVHDFAIRCPMKDKKYTRDCANGVIKSLGLDIDKINKCVGDPEADEENPVLKAEQDAQIGHGSRGDVTILPTFVVNNRQYRGKLDKRAVLRAICSGFEETTEPDICLAQDIQTNQCLEHNGGCWLDSSNNFTACKDTFRGRVCECPVVNGVKFVGDGYTHCEASGVGRCQINNGGCWKETRNGKSVSACSNEETKGCKCPPGFKGDGIHSCEDVDECKEKLFCQCKGCNCENTWGSYECGCGGNNMLYMREHDTCISKVASSSVGQGFLWVIFFGLAFAGVGAYAVYKYRLRSYMDSEIRAIMAQYMPLENHEMSSIPQRPVEHADI

SEQ ID NO: 17087 - protein, 672 aa, Secale cereale
EIIDPPAHRSSSARGSCSIVVVRHLGQGRDRVTERGDRDGREIVAVGGVAAAAASTSSRVGGGDGGGGEVRGGEEQPAGDVAGGAAGRVRVRHRQLRDAAYGAPLHGVVVYPKANAKACNPFADFGLSFNPKAGGLPVFLLVDRGDCYFTTKGWNAQTAGAAAVLVADDRAEPLITMDTPESSGKEHLENITVPSALVSKRFGDDLKAALENGDMVNVLLDWRESLPHPDERVEYEFWTNSNDECGAKCDMQMDFVRDFRGVAQVLEQRGYTQFAPHYITWYCPEAFVLSAQCRSQCINHGRYCAPDPEQDFTTGYDGKDVVVQNLIQICLFKVANESRKPWLWWDYVHDFAIRCPMKEKKYTTDCAHGVIKSLGMDIDKITKCVGDPDADEDNPVLKAEQDAQIGHGARGDVTILPTFVVNNRQYRGKLDKREVLRAICSGFEETTEPDICLTQDIQTNQCLENNGGCWLDKNTNFTACKDTFRGRVCECPVVNGVKFVGDGYTHCEASGVGRCQINNGGCWKETRNGKSVSACSNEQAKGCKCPQGFKGDGIHGCEDVDECKERLFCQCKDCSCENTWGSYECGCGGSNMLYMREHDTCISKVATSSVGWGFMWVIFFGLGFAGVGAYAVYKYRLRSYMDSEIRAIMAQYMPLENQETSSHQRHVEHADI

SEQ ID NO: 17088 - protein, 636 aa, Setaria italica
MGTRLRPPAWWCRALLALAIAAGLMAVDPAAARFVVEKNSLRVTSPAALRGVYECAIGNFGMPQYGGTMHGVVVYPKANGKACKPFADFGLSFKPKPGGLPVFLLVDRGDCYFTTKGWNAQNSGAAAVLVADDKVEPLITMDSPESSGTEHMENITIPSALVTKRFGDDLRKALQNGDMVNVLLDWRESLPHPDERVEYELWTNSNDECGAKCDMQMNFVRSFRGIAQALEKRGYTQFTPHYITWYCPEAFVLSKQCKSQCINHGRYCAPDPEQDFSIGYDGKDVVLQNLIQICVFKVANESRKPWMWWDYVHDFAVRCPMKEKKYTRECANGVIKSLGLEIEKINKCIGDPEADKENSVLKAEQDAQIGHGSRGDVTILPTLVVNSRQYRGKLEKSSVLKAVCSGFEETTEPDICLREDIETNECLEHNGGCWLDKATNVSACKDTFRGRVCECPSVNGVKFVGDGYTHCEASGLGRCQINNGGCWKETRNGKTVSACSNEEAKGCKCPTGFKGDGVNSCEDVDECKENLYCKCKNCACENIWGSYECSCGGSNMLYIREHDTCISKHSTSTIGWGFLWVIFFGLALAGAGAYAVYKYRLRSYMDSEIRAIMAQYMPLESHEMPSQQRPVEHADI

SEQ ID NO: 17089 - protein, 631 aa, Panicum virgatum
MGTWLRPPAWCCALLALALLLGDPAAARFVVEKNSLRVTSPAALRGVYECAIGNFGMPQYGGTMHGVVVYPKANAKACKPFADFDLSFNPKSGGLPVFLLVDRGDCYFTTKGWNAQNAGAATVLVADDKVEPLITMDSPESSGTEHMENITIPSALVTKRFGDDLRKALQNGDMVNVLLDWRESLPHPDERVEYELWTNSNDECGAKCDMQMNFVRSFRGIAQALEKRGYTQFTPHYITWYCPEAFVLSKQCKSQCINHGRYCAPDPEQDFSIGYDGKDVVLQNLIQICVFKVANESRKPWMWWDYVHDFAVRCPMKDKKYTRECANDVIKSLGLEFEKINKCIGDPEADKENPVLKAEQDAQIGHGSRGDVTILPTLVVNNRQYRGKLEKSSVLKAVCSGFEETTEPDICLREDIETNECLEHNGGCWLDKATNVSACKDTFRGRVCECPVVNGVKFVGDGYTHCEASGLGRCQINNGGCWKETRNGKTVSACSNEEAKGCKCPTGFKGDGVNSCEDVDECKENLFCKCKNCACENTWGSYECSCGGSNMLYIREHDTCISKHSTSSIGWGFLWVIFFGLALAGAGAYAVYKYRLRSYMDSEIRAIMAQYMPLESQEMPNQHRPVEHADI

SEQ ID NO: 17090 - protein, 636 aa, Sorghum bicolor
METTTAARRRRRLLLLLVLLALAAHRAAARFVVEKNSLRVTSPAALRGVYECAIGNFGMPQYGGTMHGVVVYPKVDAKACRPFDASGLSFKPKSGGLPVFLLVDRGDCYFTTKGWNAQNAGAAAVLVADDKVEPLITMDSPESSGTEHIENITIPSALVTKRFGDDLRKALQNGEMVNVLLDWRESLPHPDERVEYEFWTNSNDECGAKCDMQMNFVRSFRGIAQALEKRGYTQFTPHYITWYCPEAFILSKQCKSQCINHGRYCAPDPEQDFSIGYDGKDVVVQNLIQICVFRVANETRRPWMWWDYVHDFAVRCPMKEKKYTRECAHGVINSLGLDIEKINKCVGDPDADKENPVLKAEQDAQIGHGSRGDVTILPTLVVNNRQYRGKLEKRSVLKAVCSGFEETTEPDVCLREDIETNECLENNGGCWLDKATNVSACKDTFRGRVCECPTVNGVKFIGDGYSHCEASGLGRCQINNGGCWNETRNGKTVSACSNQEAKGCKCPSGFRGDGMNSCEDVDECKEKLFCQCKDCACENTWGSYECSCGGSNSLYIREHDTCISKQSSSSLGWGFLWVIFIGLALAGAGAYAVYKYRLRSYMDSEIRAIMAQYMPLESQEMPNQHRSVVPVDHADI

SEQ ID NO: 17091 - protein, 378 aa, Secale cereale
MKPSAAILLAAVVALLLVAAVRGDDDCGSPESAAQDRARANPLKIAAFFSILVCGALGCSLPVLGRRVPALRPEGDVFFLVKAFAAGVILATGFIHILPDAFENLTSDCLPSDGPWKDFPFAGLGAMVGAIGTLVVDTVATGYFTRAHLNKDGGHGAISSSAAVVDEEKQAAAAASEEARRRDGGEQDVHVHTHATHGHAHGSAALVAAVGGAEDEKDTIRHRVISQVLELGIVVHSVIIGISLGASQDPDTIKPLVVALSFHQMFEGMGLGGCIVQAKFKARSIVTMILFFCLTTPVGIAIGYGISRVYNENSPTALVVEGSLNSVAAGILIYMALVDLLAEDFMNPKVQSRGKLQLGINVSMLVGAGLMSMLAKWA

SEQ ID NO: 17092 - protein, 377 aa, Secale cereale
MKPSAAVLLAAIVALLLVSAVRGGDDHCGSPESAAQDRARANPLKITAFFSILVCGALGCSLPVLGRRVPALRPEGDVFFLVKAFAAGVILATGFIHILPDAFENLKSPCLKPSDGPWQDFPFAGLGAMVGAIGTLVVDTVATGYFTRAHLNKDEANGAISSNSAVVDEEKRAAAEEARHHDGEELEVHVHTHATHGHAHGSAALVAAVGGAEDEKDTIRHRVISQVLELGIVVHSVIIGISLGASQNPEAIKPLVVALSFHQMFEGMGLGGCIVQAKFKARSIVIMILFFCLTTPVGILIGFGISRVYNENSPTALVVEGSLNSVAAGILIYMALVDLLAEDFMNPKVQSRGKLQLGINISMLVGAGLMSMLAKWA

SEQ ID NO: 17093 - protein, 377 aa, Avena sativa
MKPSADVLLAVLVALLLVSAVRGGDDDDHCGSPESAAHDRARARPLKIAAFFSILLCGALGCSLPVLGRRVPVLRPDGDIFFLVKAFAAGVILATGFIHILPDAFDNLTSPCLPADGPWQDFPFAGLGAMVGAIGTLVVDTIATGYFTRAHLKKDAATGSSSAAVVDEEKQAAAAAAAATEEGGEHLHVVHTHATHGHAHGSAALVAAVGGAEDEKDTVRHRVISQVLELGIVVHSVIIGISLGASHDPDTIKPLVVALSFHQMFEGMGLGGCIVQAKFNARSIVTMILFFCLTTPVGILVGMGISHVYNENSPTALVVEGSLNSVAAGILVYMALVDLLAEDFMNPKVQSRGKLQLGINFSMLLGAGLMSMLAKWA

SEQ ID NO: 17094 - protein, 375 aa, Avena sativa
MKPSAAVLLAVLVALLLVSAVSGHDDCGSPESAAHDRARARPLKIAAFFSILLCGALGCSLPVLGRRVPVLRPDGDIFFLVKAFAAGVILATGFIHILPDAFDNLTSPRLPADGPWKDFPFAGLGAMVGAIGTLVVDTLATGYFTRAHLKKDDAATGSGTAAVVDEEKQAAAAAAAATEEGGEHLHVVHTHATHGHAHGSAALVAAVGGGEDEKDTVRHRVISQVLELGIVVHSVIIGISLGASQDPDMIKPLVVALSFHQMFEGMGLGGCIVQAKFNARSIVTMILFFCLTTPVGILVGMGISHVYNENSPTALVVEGSLNSVAAGILVYMALVDLLAEDFMNPKVQSRGKLQLGINFSMLLGAGLMSMLAKWA

SEQ ID NO: 17095 - protein, 321 aa, Triticum aestivum
MAARAIVALSLILALVAIASGGASAQLSSGFYSRSCPGMLKAVRSALHPAIARERRVGASIVRLFFHDCFVQGCDASLLLDDAPGLRGEKNATPNKNSARGFEVIDAVKAAVEECCPGVVSCADILAIAAEESVVFLGGPSWEVKMGRRDSTTASFNGAENNIPPPTSGLANLTSLFAAQGLSQKDMVALSGAHTIGLARCTNFRDHIYNDTNIDAGFARSRQSGCPRATGSGDNNLAPLDLQTPAVFENDYYKNLVQKRGLLHSDQELFNGGAADALVREYVGSQSAFFKDFVEGMIKMGDITPLMGSNGQIRMNCRRIN

SEQ ID NO: 17096 - protein, 321 aa, Triticum aestivum
MAARAIVVLWLILALVAIASGGASAQLSSGFYSRSCPGMLKAVRSALHPAIARERRVGASIVRLFFHDCFVQGCDASLLLDDAPGLRGEKNATPNKNSARGFEVIDAVKAAVEGCCPGVVSCADILAIAAEESVVFLGGPSWEVKMGRRDSTTASFNGAENNIPPPTSGLANLTSLFAAQGLSQKDMVALSGAHTIGLARCTNFRDHIYNDTNIDAGFARSRQSGCPRATGSGDNNLAPLDLETPTVFENDYYKNLVQKRGLLHSDQELFNGGAADALVREYVGSQSAFFKDFVEGMIKMGDITPLTGSNGQIRMNCRRIN

SEQ ID NO: 17097 - protein, 321 aa, Triticum aestivum
MAARAIAVLSLILALVAIASGGASAQLSSGFYSRSCPGMLKAVRSALHPAIARERRVGASIVRLFFHDCFVQGCDASLLLDDAPGLRGEKNATPNKNSARGFEVIDAVKAAVEGCCPGVVSCADILAIAAEESVVFLGGPSWEVKMGRRDSTTASFNGAENNIPPPTSGLANLTSLFAAQGLSQKDMVALSGAHTIGLARCTNFRDHIYNDTNIDAGFARSRQSGCPRATGSGDNNLAPLDLQTPTVFENEYYKNLVQKRGLLHSDQELFNGGAADTLVREYVGSQSAFFKDFVEGMIKMGDITPLTGSNGQIRMNCRRVN

SEQ ID NO: 17098 - protein, 321 aa, Secale cereale
MAARAIVSLSLILALVAITSGGASAQLSSGFYSSSCPGMLKAVRSALHPAIARERRVGASIVRLFFHDCFVQGCDASLLLDDAPGLRGEKNATPNKNSARGFEVIDAVKAAVEECCPGVVSCADILAVAAEESVVFLGGPSWEVKLGRRDSTTASFNGAENNIPPPTSGLANLTSLFAAQGLSQKDMVALSGAHTIGLARCTNFRDHIYNDTDIDTGFARSRQSGCPRATGSGDNNLAPLDLQTPTVFENAYYKNLVQKRGLLHSDQELFNGGAADALVREYVGSQSAFFNDFVEGMIKMGDITPLTGSNGQIRMNCRRVN

SEQ ID NO: 17099 - protein, 321 aa, Secale cereale
MAARAIVALSLILALVAIASGGASAQLSSGFYSSSCPGMLKAVRSALHPAIARERRVGASIVRLFFHDCFVQGCDASLLLDDAPGLRGEKNATPNKNSARGFEVIDAVKAAVEECCPGVVSCADILAIAAKESVVFLGGPSWEVKMGRRDSTTASFNGAENNIPPPTSGLANLTSLFAAQGLSQKDMVALSGAHTIGLARCTNFRDHIYNDTNIDAGFAKSRQSGCPRPTGSGDNNLAPLDLQTPTVFENDYYKNLVQKRGLLHSDQELFNGGAADALVQEYVGSQSAFFKDFVEGMIKMGDITPLMGSNGQIRMNCGRIN

SEQ ID NO: 17100 - protein, 319 aa, Leymus cinereus x Leymus triticoides
MAARAIVVLLSLILALVAGGASAQLSSGFYSRSCPGMLKAVRSALHPAIARERRLGASIVRLFFHDCFVQGCDASLLLDDAPGLRGEKNAPPNKNSARGFEVLDAVKAAVEERCPGVVSCADILAIAAQESVVFLGGPSWEVKMGRRDSTTASFTGAENNIPPPTSGLANLTSLFAAQGLSQKDMVALSGAHTIGLARCTNFRDHVYNDTNIDAGFARSRQSGCPRATGSGDNNLAPLDLQTPTVFENNYYKNLVQKRGLLHSEQELFNGGAADALVREYVGSQSAFFKDFVEGMIKMGDITPLTGSNGQIRMNCRRIN

SEQ ID NO: 17101 - protein, 321 aa, Pseudoroegneria spicata
MAARTIVVLSLIVALVAIASGGASAQLSSGFYSRSCPGMLKAVRSALHPAIARERRVGASIVRLFFHDCFVQGCDASLLLDDAPGLSGEKNATPNKNSARGFEVIDAVKAAVEECCPGVVSCADILAIAAEESVVFLGGPTWEVKMGRRDSTTASFNGAENNIPPPTSGLANLTSLFAAQGLSQKDMVALSGAHTIGLARCTNFRDHIYNDTNIDAGFARSRESGCPRTSGSGDNNLAPLDLQTPTVFENDYYKNLVQKRGLLHSDQELFNGGAADALVREYVGSQSAFFKDFVEGMIKMGDITPLTGSNGQLRMNCRRIN

SEQ ID NO: 17102 - protein, 319 aa, Hordeum vulgare
MAARAIVVLVSLVLAVVAGGASAQLSSGFYSRSCPGMLKAVRSALHPAITRERRVGASIVRLFFHDCFVQGCDASLLLDDAPGLRGEKNAAPNKNSVRGFEVIDAIKAAVEKECPGVVSCADVLAVAAEESVVFLGGPSWEVKMGRRDSTTASFTGAENNIPPPTSGLANLTSLFAAQGLCQKDMVALSGAHTIGLARCTNFRDHIYNDTNIDDGFARSRQSGCPRTAGFGDNNLAPLDLQTPTVFENNYYKNLVQKRALLHSDQELLNGGAADALVRQYVGSQSSFFKDFVVGMVKMGDIGPLTGSSGQIRKNCRRIN

SEQ ID NO: 17103 - protein, 319 aa, Hordeum vulgare
MAARAIVVLVSLVLAVVAGGASAQLSSGFYSRSCPGMLKAVRSALHPAITRERRVGASIVRLFFHDCFVQGCDASLLLDDAPGLRGEKNAAPNKNSVRGFEVIDAIKAAVEKECPGVVSCADVLAVAAEESVVFLGGPSWEVKMGRRDSTTASFTGAENNIPPPTSGLANLTSLFAAQGLCQKDMVALSGAHTIGLARCTNFREHIYNDTNIDDGFARSRQSGCPRTAGFGDNNLAPLDLQTPTVFENNYYKNLVQKRALLHSDQELLNGGAADALVRQYVGSQSSFFKDFVVGMVKMGDIGPLTGSSGQIRKNCRRIN

SEQ ID NO: 17104 - protein, 319 aa, Secale cereale
MAARAIVVLVSLILAVVAGGASAQLSSGFYSRSCPGMIKAVRSALRPAIARERRVGASIVRLFFHDCFVQGCDASLLLDDAPGLRGEKNAMPNKNSVRGFEVIDAIKAAVEKECPGVVSCADILAIAAEESIAILGGPSWEVKMGRRDSTTASFNGAENNIPPPTSGLTNLTSLFAAQGLSQKDMVALSGAHTIGLARCTFFRDHVYNDTNIDSGFARSRQSGCPRTAGSGDNNLAPLDLQTPTVFENDYYKNLVQKRGLLHSDQELFNGGGADALVRQYIGSQSAFFKDFVVGMIKMGDITPLTGSSGQVRKNCRRIN

SEQ ID NO: 17105 - protein, 319 aa, Triticum aestivum
MAARAIVVLVSLILAVVAGGASAQLSSGFYSRSCPGMLKAVRSALRPAIVRERRVGASIVRLFFHDCFVQGCDASLLLDDASGLRGEKNAKPNKNSVRGFEVIDAIKAAVEKECPGVVSCADILAIAAEESVVLLGGPSWEVKMGRRDSTTASFSGAENNIPPPTSGLANLTSLFAAQGLSQKDMVALSGAHTVGQARCTFFRDHIYNDTNIDSGFARSRQSGCPRTAGSGDNNLAPLDLQTPSTFENDYYKNLVQKRGILHSDQELFNGGAADALVQQYIGSQSTFFKDFVVGMIKMGDITPLTGSSGQIRKNCRRIN

SEQ ID NO: 17106 - protein, 526 aa, Lolium multiflorum
MAIGAFVDGPAGGAGYNGRVTSFVVLSCIVAGSGGILFGYDLGISGGVTSMESFLKKFFPDVYHQMKGDSHVSNYCRFDSELLTVFTSSLYIAGLVATLFASSVTTKYGRRASILIGGSVFIAGSVFGGAAVNVYMLLINRILLGIGLGFTNQSIPLYLSEMAPPQYRGAINNGFELCISIGILIANLINYGVAKIEGGWGWRISLSMAAVPAAFLTIGAIFLPETPSFLIQRDGNVDQAKMMLQRLRGTTGVQKELDDLVTASNISRTIKNPYRNILKKKYRPQLVIALLIPFFNQVTGINVINFYAPVMFRTIGLKESASLMSAVVTRLCATAANIVAMIVVDRFGRRKLLLVGGVQMILSQFTVGAVLAVKFKDHGVMEKEYAYLVLVIMCVFVAGFAWSWGPLTYLVPTEICPLEIRSAGQSVVIAVIFLVTFLIGQTFLAMLCHLKFGTFFLFGGWVCVMTMFVFFFLPETKQLPMEQMEQVWRRHWFWKRIVGEEEEEQEAGQTQTAPGTIALSTTPHNN

SEQ ID NO: 17107 - protein, 524 aa, Avena sativa
MAIGAFVEGPSGGAGYNGRVTSFVVLSCIVAGSGGILFGYDLGISGGVTSMESFLKRFFPDVYRQMKGDDSHVSNYCRFDSELLTVFTSSLYVAGLVSTLFASSVTTKYGRRTSILIGGSVFIAGSVFGGAAVNVYMLLINRVLLGIGLGFTNQSIPLYLSEMAPPQYRGAINNGFELCISIGILIANLINYGVAKIEGGWGWRISLSMAAVPAAFLTIGAIFLPETPSFLIQRDGNIDQAKMMLQRLRGTTGVQKELDDLVTASNISRTIKNPYRNILKKKYRPQLVIALLIPFFNQVTGINVINFYAPVMFRTIGLKESASLMSAVVTRVCALFANVVAMVVVDKFGRRKLLLAGGVQMILSQFTVGAILAVKFKDHGAMEKEYAYLVLIIMCVFVAGFAWSWGPLTYLVPTEICPLEIRSAGQSVVIAVIFLVTFVIGQTFLAMLCHLKFGTFFLFGGWVCVMTLFVFFFLPETKQLPMEQMEQVWRRHWFWKRIVGEEEEEEEMQTAAGAVALSTTAHNN

SEQ ID NO: 17108 - protein, 525 aa, Hordeum vulgare
MAIGAFVEGPAGGGGYNGRVTSFVVLSCIVAGSGGILFGYDLGISGGVTSMESFLKKFFPDVYHQMNGDKAAVSNYCRFDSELLTVFTSSLYVAGLVATLFASTVTTRYGRRASILIGGSVFIAGSAFGGAAVNVYMLLVNRILLGIGLGFTNQSIPLYLSEMAPPQYRGAINNGFELCISIGILIANLINYGVQKIEGGWGWRISLSMAAVPAAFLTIGAIFLPETPSFLIQRDGNVDEAKIMLQKLRGTTGVQKELDDLVTASNISRAIKNPYRNILKKKYRPQLVIALLIPFFNQVTGINVINFYAPVMFRTIGLGESAALMSAVVTRLCATVANIVAMIVVDKFGRRKLLLVGGVQMILSQFTVGAILAVKFKDQGVMGKEYGYLVLIIMCVFVAGFAWSWGPLTYLVPTEICPLEIRSAGQSVVIAVIFLMTFVIGQTFLNMLCHLKFGTFFLFGGWVCVMTLFVFFFLPETKQLPMEQMEQVWRRHWFWKRIVGEEEEEVDQAQTGAGTISMSTTSHSS

SEQ ID NO: 17109 - protein, 450 aa, Panicum virgatum
MKGDKNVSNYCRFDSELLTVFTSSLYVAGLVATLFASSVTRRFGRRASILIGGTVFIVGSVFGGAAVNVYMLLLNRILLGIGLGFTNQSIPLYLSEMAPPQYRGAINNGFELCISIGILIANLINVGVEKIADGWGWRISLSLAAVPAAFLTMGAIFLPETPSFIIQRDGNIDEAKILLQRLRGTTRIQKELDDLVSASNVSRTIQHPLRKIFKRKYRPQLVIALSVPFFNQVTGINVINFYAPVMFRTIGLKESASLMSAVVTRICATVANIVAMVVVDRFGRRKLFLVGGIQMILSQIMVGAVLAAKFKDHGGMEKEYAYLVLIIMCVFVAGFAWSWGPLTYLVPTEICPLEIRSAGQSIVIAVIFLVTFVIGQTFLAMLCHLKFGTFFLFGGWVCVMTLFVYFFLPETKQLPMEQMEQVWRRHWFWKRIVGEEEEEREARSIALSNT

SEQ ID NO: 17110 - protein, 506 aa, Triticum aestivum
TSFVVLSCIVAGSGGILFGYDLGISGGVTSMESFLKKFFPDVYHQMNGDKAAAVSNYCRFDSELLTVFTSSLYVAGLVATLFASSVTTRYGRRASILIGGSVFIAGSAFGGAAVNVYMLLVNRILLGIGLGFTNQSIPLYLSEMAPPQYRGAINNGFELCISIGILIANVINYGVQKIEGGWGWRISLSMAAVPAAFLTIGAIFLPETPSFLIQRDGNVDEAKMMLQRLRGTTGVQKELDDLVTASNISRAIKNPYRNILKKKYRPQLVIALLIPFFNQVTGINVINFYAPVMFRTIGLGESAALMSAVVTRLCATVANIVAMIVVDKFGRRKLLLVGGVQMILSQFTVGAILAVKFKDHGVMDKEYGYLVLVIMCVFVAGFAWSWGPLTYLVPTEICPLEIRSAGQSVVIAVIFLMTFVIGQTFLNMLCHLKFGTFFLFGGWVCVMTLFVFFFLPETKQLPMEQMEQVWRKHWFWKRIVGEGEEEVDQAHTGAGAIAMSTAPHSS

SEQ ID NO: 17111 - protein, 534 aa, Brachypodium distachyon
MAIGAFVEGPTGGAAAAAGYNGRVTSFVVLSCIVAGSGGILFGYDLGISGGVTSMESFLKKFFPEVYRQMKGDKVDVSNYCRFDSELLTVFTSSLYVAGLVATLFASSVTTRYGRRASILIGGSVFIAGSVFGGAAVNVYMLLLNRILLGIGLGFTNQSIPLYLSEMAPPQYRGAINNGFELCISIGILIANLINYGVAKIEGGWGWRISLSMAAVPAAFLTVGAIFLPETPSFLIQRGGGNTDAAKAMLQRLRGTAGVQKELDDLVAAAGAGQQGRPLRTLLGKKKYRPQLAMAILIPFFNQVTGINVINFYAPVMFRTIGLKESASLMSAVVTRLCATAANVVAMVVVDRSGRRKLLLAGGVQMILSQFAVGAILAAKFKDHGAMDKEYAYLVLVIMCVFVAGFAWSWGPLTYLVPTEICPLEIRSAGQSVVIAVIFLVTFVIGQTFLAMLCHLRSGTFFLFGGWVCLMTLFVFFFLPETKQLPMEQMEQVWRRHWFWRRVVGTEEEEDDVMSAETAAAGSAIALSSSRGRN

SEQ ID NO: 17112 - protein, 519 aa, Oryza sativa
MAIGAFVEGGGSGYSGRVTPFVVLSCIVAGSGGILFGYDLGISGGVTSMEPFLKKFFPDVYHQMKGDKKKVSNYCRFDSELLTVFTSSLYIAGLVATLVASSVTRRFGRRASILIGGSVFVAGSVFGGAAVNIYMLILNRVLLGIGLGFTNQSIPLYLSEMAPPQHRGAINNGFELCISIGILIANLINYGVDKIEGGWGWRISLSMAAVPAAFLTVGALFLPETPSFVIQRSGDVDSARALLQRLRGTAAVHKELEDLVMASEVSKTIRHPLRNMLRRRYRPQLVIAVLVPLFNQVTGINVINFYAPVMFRTIGLRESASLMSAVVTRVCATAANVVAMAVVDRLGRRRLLLVGGVQMLVSQVMVGAILAGKFREHGEEMEKEYAYLVLSVMCVFVAGFAWSWGPLTYLVPAEICPLEVRSAGQSIVIAVIFLLTFLIGQTFLAMLCHLKFATFFLFAACLCVMTLFVFFFLPETKQLPMEQMDQLWRTHWFWKRIVGDSPQQQVVELHHHHQRSSSE

SEQ ID NO: 17113 - protein, 518 aa, Oryza sativa
MAIGAFVESGGGGGGGGGGGYGGRVTAYVVLTCVVAGSGGILFGYDLGISGGVTSMDSFLKRFFPDVYQKKQDTRVSHYCAFDSELLTVFTSSLYIAGLVATLFASSVTRRYGRRTSMLIGGTVFIAGSVFGGAAVNVFMLLINRILLGIGLGFTNQSIPLYLSEMAPPRYRGAINNGFELCISLGILFANVLNYCVVKITAGWGWRISLSMAAVPAAFLTIGAVFLPETPSFIIERDGDTDKARILLQRLRGTTSVQKELDDLVAASNLSRTVQYPFRNIFKRKYRPQLVIALLVPFFNQLTGINVMNFYAPVMFRTIGLKESASLLSSVVNRLCATFANIMAMIVVDRFGRRKLFLVGGIQMILSQLAVGAILAAEFKDYGSMDREYAYLVLITMCVFVAGFAWSWGPLTFLVPTEICPLEIRSAGQSIVVAVVFLMTFVIGQTFLAVLCRIKSGTFFFFAGWICLMTVFVYFFLPETKKLPMEQMEQVWRKHWFWKKIVGEEEEKQAEKTALPSM

SEQ ID NO: 17114 - protein, 298 aa, Panicum virgatum
MAGLSLQHPLAFAFGLLGNVISFMTYLAPLPTFYRIYKNKSTESFQSVPYVVALFSAMLWIYYALLKSDECLLITINSAGCVIETLYIALYLTYAPKKAKLFTAKLLLLLNVGVFGLILLLTLLLSAGQNRVVILGWVCVGFSVSVFVAPLSIIHQVVRTRSVEFMPFSLSLSLTVSAVVWFLYGLLIKDKYVALPNVLGFTFGVIQMGLYAIYRNATPRVPAKEVADDKEDIVVVEVPEHVVTIAKLGAPAVELKTHEVRPAMATPTEEAWPENDKAVAKQENGTVAGKGDNDGDQV

SEQ ID NO: 17115 - protein, 298 aa, Panicum virgatum
MAGLSLQHPLAFSFGILGNIISFMTYLAPLPTFYRIYKSKSTEGFQSVPYVVSLFSAMLWIYYALLKSDECLLITINSAGCVIETLYIVIYLAYAPKKAKLFTAKILLLLNVGVFGLILLLTLLLSAGQHRVVILGWVCVGFSVSVFVAPLSIIRQVVRTRSVEFMPFSLSLSLTVSAVVWFLYGLLIKDKYVALPNVLGFIFGVIQMGLYAIYRNATPRVPAKEVADDDKEDMVVKVPEHVVTIAKLGEPAVELKTHEVRPAMATPTADAGPENDKAVANKQENGTVPGKGSNTDQV

SEQ ID NO: 17116 - protein, 299 aa, Setaria italica
MAGLSLDHPLAFTFGLLGNIISFMTYLAPLPTFYRIYKTKSTEGFQSVPYVVALFSAMLWIYYALLKSDEFLLITVNAAGCVIETLYITMYLAYAPKKAKLFTAMILLLLNVGVFGLILLLTMLLAAGEKRVVLLGWVCVGFAVSVFVAPLSIIRQVVRTRSVEFMPFFLSLSLTVSAVVWFLYGLLIKDKYVALPNVIGFTFGVIQMGLYALYRNATPRVPAKEVADVKATVVDDTFKVPEHVVTIAKLGAPAVEILTSEVHPVESPPTEEAKKEDDEPLEEELGDASKKGSNTTEQV

SEQ ID NO: 17117 - protein, 289 aa, Sorghum bicolor
MAGLSLQHPMAFAFGLLGNIISFMTYLAPLPTFYRIYKSKSTQGFQSVPYVVALFSAMLWIYYALLKSNEFLLITINSAGCVIETLYIVMYLLYAPKKAKLFTAKILLLLNVGVFGLILLLTLLLSAGQHRVVVLGWVCVAFSVSVFVAPLSIIRQVVRTRSVEFMPFSLSLSLTVSAVVWFLYGLLIKDKYVALPNVLGFSFGVVQMGLYALYRNATPRVPPAKEVTDDDAAADGTFKLPGEHVVTIAKLTAVPAVSPQLQEEAKPADNGTTPAPAPANDVQLNAEQV

SEQ ID NO: 17118 - protein, 273 aa, Saccharum officinarum
MRGSSRRPVAVVMAWVRRQPPKVKAFLAVVAGMAALVFIRFIVHDHDNLFVAAEAAHALGIAVLIYKLTKEKTCAGLSLKSQDLTALFLAVRLYCSFVMEYDIHTILDTATLAATLFVIYMIRFKLRSTYMLDKDNFALYYVVLPCAVLALLVHPSTSHNIVNRICWAFCVYLEAVSVLPQLRLMQNTKIVEPFTAHYVFALGVARFLSCAHWVLQVLDTHGRLLTALGYGLWPSMVLLSEIVQTFILADFCYYYVKSVFGGQLVLRLPSGVV

SEQ ID NO: 17119 - protein, 273 aa, Sorghum bicolor
MRGSSRRPVAVVMAWMRRQPPKVKAFLAVVAGMAALVFIRFIVHDHDNLFVAAEAAHALGIAVLIYKLTKEKTCAGLSLKSQDLTALFLAVRLYCSFVMEYDIHTILDTATLAATLFVIYMIRFKLRSTYMLDKDNFALYYVVLPCAVLALLIHPSTSHNIVNRICWAFCVYLEAVSVLPQLRLMQNTKIVEPFTAHYVFALGVARFLSCAHWVLQVLDTRGRLLTALGYGLWPSMVLLSEIVQTFILADFCYYYVKSVFGGQLVLRLPSGVV

SEQ ID NO: 17120 - protein, 273 aa, Zea mays
MRGSSRRPVAVVMAWVRRQPPKVKAFLAVVAGMAALVFIRFIVHDHDNLFVAAEAAHALGIAVLIYKLTKEKTCAGLSLKSQDLTALFLAVRLYCSFVMEYDIHTILDTAALAATLFVIYMIRFKLRSTYMLDKDNFALYYVILPCALLALLVHPSTSHNIVNRICWAFCVYLEAVSVLPQLRLMQNTKIVEPFTAHYVFALGVARFLSCAHWVLQVLDTRGRLLTALGYGLWPSMVLLSEIVQTFILADFCYYYVKSVFGGQLVLRLPSGVV

SEQ ID NO: 17121 - protein, 272 aa, Oryza sativa
MRGSRRPVAVVLSWVRRQPPKVKAFLAVVAGMAALVFIRFIVHDHDNLFVAAEAAHALGLGVLIYKLTKEKTCAGLSLKSQDLTALFLAVRLYCSFVMEYDIHTILDTATLAATLFVIYMIRFKLRSTYMLDKDNFALYYVVLPCAGLALLVHPSTSHNIINRISWAFCVYLEAVSVLPQLRLMQNTKIVEPFTAHYVFALGVARFLSCAHWVLQVLDTRGRLLTALGYGLWPSMVLLSEIVQTFILADFCYYYVKSVFGGQLVLRLPSGVV

SEQ ID NO: 17122 - protein, 273 aa, Panicum virgatum
MRGSSRRPLAAVMAWVRRQPPKVKAFLAVVAGMAALVFIRFIVHDHDNLFVAAEAAHALGIAVLIYKLTKEKTCAGLSLKSQDLTALFLAVRLYCSFVMEYDIHTILDTATLAATLFVIYMIRFKLRSTYMLDKDNFKLYYVVVPCAVLTFIAHPTTSHNIVNRLCWAFCVYLEAVSVLPQLRLMQNTKIVEPFTAHYVFALGVARFLSCAHWVLQVLDTRGRLLTALGYGLWPSMVLLSEIVQTFILADFCYYYVKSVFGGQLVLRLPSGVV

SEQ ID NO: 17123 - protein, 273 aa, Panicum virgatum
MRGSSRRPLAAVMAWVRRQPPKVKAFLAVVAGMAALVFIRFIVHDHDNLFVAAEAAHALGIAVLIYKLTKEKTCAGLSLKSQDLTALFLAVRLYCSFVMEYDIHTILDTATLAATLFVIYMIRFKLRSTYMLDKDNFKLYYVVVPCAVLTFVAHPTTSHNIVNRLCWAFCVYLEAVSVLPQLRLMQNTKIVEPFTAHYVFALGVARFLSCAHWVLQVLDTRGRLLTALGYGLWPSMVLLSEIVQTFILADFCYYYVKSVFGGQLVLRLPSGVV

SEQ ID NO: 17124 - protein, 273 aa, Echinochloa colona
MRGSSRRPVAAVMAWVRRQPPKVKAFLAVVAGMAALVFIRFIVHDHDNLFVAAEAAHALGIGVLIYKLTKERTCAGLSLKSQDLTALFLAVRLYCSFVMEYDIHTILDTATLVATLFVIYMIRFKLRSTYMVDKDNFALYYVAVPCAVLALLIHPSTSHNIVNRISWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17125 - protein, 273 aa, Setaria italica
MRGSSRRPLAAVMAWVRRQPPKVKAFLAVVAGMAALVFIRFIVHDHDNLFVASEAAHAIGIGVLIYKLTKEKTCAGLSLKSQDLTALFLAVRLYCSFVMEYDIHTILDTATLAATLFVIYMIRFRLRSTYMLDKDNFKLYYVVVPCAVLTTFAHPTTSHNIVNRLCWAFCVYLEAVSVLPQLRLMQNTKIVEPFTAHYVFALGVARFLSCAHWVLQVLDTRGRLLTALGYGLWPSMVLLSEIVQTFILADFCYYYVKSVFGGQLVLRLPSGVV

SEQ ID NO: 17126 - protein, 272 aa, Echinochloa colona
MRGTKRPLGAVTSWVRRQPPKVKAFLAVVTGMAALVFIRFIVHDHDNLFVAAEAAHALGIGVLIYKLTKERTCAGLSLKSQDLTALFLAVRLYCSFVMEYDIHTILDTATLVATLFVIYMIRFKLRSTYMVDKDNFALYYVAVPCAVLALLIHPSTSHNIVNRICWAFCVYLEAVSVLPQLRLMQNTKIVEPFTAHYVFALGVARFLSCAHWVLQVLDTRGRLLTALGYGLWPSMVLLSEIVQTFILADFCYYYVKSVFGGQLVLRLPSGVV

SEQ ID NO: 17127 - protein, 272 aa, Pennisetum glaucum
MRGTRRPLGAVTSWVRRQPPKVKAFLAVVAGMATLVFIRFIVHDHDNLFVAAEAAHALGIGVLIYKLTKERTCAGLSLKSQDLTALFLAVRLYCSFVMEYDIHTILDTATLVATLFVIYMIRFKLRSTYMVDKDNFALYYVVLPCAVLALLVHPSTSHNIVNRISWAFCVYLEAVSVLPQLRLMQNTKIVEPFTAHYVFALGVARFLSCAHWVLQVLDTRGRLLTALGYGFWPSMVLLSEIVQTFILADFCYYYVKSLVGGQLVLRLPSGVV

SEQ ID NO: 17128 - protein, 272 aa, Sorghum bicolor
MRGAKRPLGVVTSWVRRQPPKVKAFLAVVTGMAALVFIRFIVHDHDNLFVAAEAAHALGIGVLIYKLTKEKTCAGLSLKSQDLTALFLAVRLYCSFVMEYDIHTILDTATLVATLFVIYMIRFKLRSTYMVDKDNFALYYVVLPCAGLALLIHPSTSHNIVNRISWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17129 - protein, 272 aa, Brachypodium distachyon
MRASRRPMGVVLGWVRRQPPKVKAFLAVVAGMAALVFIRFIVHDHDNLFVAAEAAHAIGIALLVYKLTKEKTCAGLSLKSQDLTALFLAVRLYCSFVMEYDIHTILDSATLVATLFVIYMIRFKLRSTYMLDKDNFALYYVVVPCAVLAVLVHPSTSHIMINRICWAFCVYLEAVSVLPQLRLMQNTKIVEPFTAHYVFALGVARFLSCAHWVLQVLDTRGRLLTALGYGLWPSMVLLSEIVQTFILADFCYYYVKSVVGGQLVLRLPSGVV

SEQ ID NO: 17130 - protein, 272 aa, Avena sativa
MRGTKRPLGVVTAWVRRQPPKVKAFLAVVTGMAALVFIRFIVHDHDNLFVAAEAAHALGIAVLIYKLTKEKTCAGLSLKSQDLTALFLAVRLYCSFVMEYDIHTVLDTATLVATLFVIYMIRFKLRSTYMVDKDNFALYYVVVPCAALALLVHPSTSHNILNRFSWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17131 - protein, 272 aa, Secale cereale
MRASKRPLGVVMAWVRRQPPKVKAFLAVVTGMAALVFIRFIVHDHDNLFVAAEAVHALGIAVLIYKLTKERTCAGLSLKTQDLTALFLAVRLYCSFVMEYDIHTVLDTATLVATLFVIYMIRFKLRSTYMVDKDNFALYYVVIPCAVLALLVHPSTSHNIVNRFGWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17132 - protein, 272 aa, Setaria italica
MRGTKRPLGAVTSWVRRQPPKVKAFLAVVAGMAALVFIRFIVHDHDNLFVAAEAAHALGIGVLIYKLTKERTCAGLSLKSQDLTALFLAVRLYCSFVMEYDIHTVLDTATLVATLFVIYMIRFKLRSTYMVDKDNFALYYVVLPCAGLALLIHPSTSHNIVNRISWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17133 - protein, 272 aa, Zea mays
MRGAKRPLSVVTSWVRRQPPKVKAFLAVVTGMAALVVIRFIVHDHDNLFVAAEAAHALGIGVLIYKLTKEKTCAGLSLKSQDLTALFLAVRLYCSFVMEYDIHTILDSATLVATLFVIYMIRFKLRSTYMVDKDNFALYYVVLPCAGLALLVHPSTSHNIVNRISWAFCVYLEAVSVLPQLRLMQNTKIVEPFTAHYVFALGVARFLSCAHWVLQVLDTRGRLLTALGYGLWPSMVLFSEIVQTFILADFCYYYVKSLVGGQLVLRLPSGVV

SEQ ID NO: 17134 - protein, 272 aa, Zea mays
MRGTKRPLGVVTSWVRRQPPKVKAFLAVVTGMAALVFIRFIVHDHDNLFVAAEAAHALGIGVLIYKLTKEKTCAGLSLKSQDLTALFLAVRLYCSFVMEYDIHTILDTATLVATLFVIYMIRFKLRSTYMVDKDNFALYYVVLPCAGLALLIHPSTSHNIVNRISWGFCVYLEAVSVLPQLHLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17135 - protein, 272 aa, Avena sativa
MRGTKRPLGVVTAWVRRQPPKVKAFLAVVTGMAALVFIRFIVHDHDNLFVAAEAAHALGIGVLIYKLTKEKTCAGLSLKSQDLTALFLAVRLYCSFVMEYDIHTVLDTATLVATLFVIYMIRFKLRSTYMVDKDNFALYYVVVPCAALALLVHPSTSHNILNRFSWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17136 - protein, 272 aa, Triticum aestivum
MRASKRPLGVVMAWVRRQPPKVKAFLAVVTGMAALVFIRFIVHDHDNLFVAAEAVHALGIAVLIYKLTKERTCAGLSLKTQDLTALFLAVRLYCSFVMEYDIHTVLDTATLVATLFVIYMIRFKLRSTYMLDKDNFALYYVVIPCAVLALLVHPSTSHNIANRFSWAFCVYLEAVSVLPQLRLMQNTKIVEPFTSHYVFALGVARFLSCAHWVLQVLDTRGRLLTALGYGLWPSMVLLSEIVQTFILADFCYYYVKSLVGGQLVLRLPSGVV

SEQ ID NO: 17137 - protein, 272 aa, Brachypodium distachyon
MRGTKRPLGVVTSWVRRQPPKVKAFLAVVTGMAALVFIRFIVHDHDNLFVAAEAAHALGIAVLIYKLTKEKTCAGLSLKSQDLTALFLAVRLYCSFVMEYDIHTVLDTATLVATLFVIYMIRFKLRSTYMVDKDNFALYYVVVPCAALALLIHPSTSHNIANRFSWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17138 - protein, 272 aa, Panicum virgatum
MRGTKRPLGAVTSWVRRQPPKVKAFLAVVTGMAALVFIRFIVHDHDNLFVAAEAAHALGIGVLIYKLTKEKTCAGLSLKSQDLTALFLAVRLYCSFVMEYDIHTILDTATLVATLFVIYMIRFKLRSTYMVDKDNFALYYVVVPCAALALLIHPSTSHNIVNRVSWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17139 - protein, 272 aa, Triticum aestivum
MRASKRPLGVVMAWVRRQPPKVKAFLAVVTGMAALVFIRFIVHDHDNLFVAAEAVHALGIAVLIYKLTKERTCAGLSLKTQDLTALFLAVRLYCSFVMEYDIHTVLDTATLVATLFVIYMIRFKLRSTYMVDKDNFALYYVVIPCAVLALVVHPSTSHNIANRFSWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17140 - protein, 272 aa, Secale cereale
  Sequence also found in Organisms: Triticum aestivum
MRAPRRPMAVVLSWVRRQPPKVKAFLAVVAGMTALVFIRFIVHDHDNLFVAAEAAHALGIAVLIYKLTKEKTCAGLSLKSQDLTALFLAVRLYCSFVMEYDIHTILDSATLVATLFVIYMIRFRLRSTYMLDKDNFALYYVVVPCCVLAFIAHPSTSHIMINRICWAFCVYLEAVSVLPQLRLMQNTKIVEPFTAHYVFALGVARFLSCAHWVLQVLDTRGRLLTALGYGFWPSMVLLSEIVQTFILADFCYYYVKSLAGGQLVLRLPSGVV

SEQ ID NO: 17141 - protein, 272 aa, Hordeum vulgare
MRASRKPMAVVLSWVRRQPPKVKAFLAVVAGMTALVFIRFIVHDHDNLFVAAEAAHALGIAVLIYKLTKEKTCAGLSLKSQDLTALFLAVRLYCSFVMEYDIHTILDSATLVATLFVIYMIRFRLRSTYMLDKDNFSLLYVVIPCCVLAFLAHPSTSHIMINRICWAFCVYLEAVSVLPQLRLMQNTKIVEPFTAHYVFALGVARFLSCAHWVLQVLDTRGRLLTALGYGFWPSMVLLSEIVQTFILADFCYYYVKSLAGGQLVLRLPSGVV

SEQ ID NO: 17142 - protein, 272 aa, Avena sativa
MRPPRRPLGVVVAWVRRQPPKVKAFLAVVAGMAALVFIRFIVHDHDNLFVAAEAAHALGLAVLIYKLTKEKTCAGLSLKSQDLTALFLSVRLYCSFVMEYDIHTILDSATLVATLFVIYMIRFRLRATYMVEKDNFALYYVVVPCFVLAFFSHPSTSHFAVNRICWAFCVYLEAVSVLPQLRLMQNTKIVEPFTAHYVFALGVARFLSCAHWVLQVLDTRGRLLTALGYGLWPSMVLLSEIVQTFILADFCYYYVKSVVGGQLVLRLPSGVV

SEQ ID NO: 17143 - protein, 272 aa, Lolium multiflorum
MRGTKRPLGVVTAWVRRQPPKVKAFLAVVTGMAALVFIRFIVHDHDNLFVAAEAAHALGIAVLIYKLTKERTCAGLSLKSQELTALFLAVRLYCSFVMEYDIHTILDSATLVATLFVIYMIRFRLRATYMLEKDNFPLYYVVVPCFVLAFFSHPSTSHFMVNRICWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17144 - protein, 272 aa, Ananas comosus
MRGPRRPLSVVAGWVRRQPPKVKAFLAVVAGMAALVLIRAVVRDHDNLFVAAEAVHALGISVLIYKLTKEKTCAGLSLKSQDLTALFLAVRLYCSFVMEYDIHTLLDTATLVTTLWVIYMIRFKLKSSYMEDKDNFAIHYVVLPCALLAVLIHPSTSHNIVNRICWAFCVYLEAVSVLPQLRLMQNTKIVEPFTAHYVFALGVARFLSCAHWVLQVLDTRGRLLTALGYGWWPSMVLLSEIVQTFILADFCYYYVKSLVGGQLVLRLPSGVV

SEQ ID NO: 17145 - protein, 272 aa, Musa acuminata
MRGGRRPIYAVAAWVRRQPSKVKAFLGVVAGMAALVFLRFIVHDHDNLFVAAEAVHAIGISVLIYKLTKERTCAGLSLKSQDLTALFLAVRMYCSFVMEYDIHTVLDTATLATTLWVIYMIRFKLKSSYMEDKDNFAIYYVVVPCALLALAVHPSTSHNIFNRICWAFCVYLEAVSVLPQLRLMQNTKIVEPFTAHYVFALGVARFLSCAHWVLQVLDTQGRLLTALGYGLWPSMVLLAEIVQTFILADFCYYYVKSLVGGQLVLRLPSGVV

SEQ ID NO: 17146 - protein, 272 aa, Musa acuminata
MRGAKRPIHALAAWVRRQPPKVKAFLGVVAGMAALVFLRFIVHDHDNLFVAAEAVHAIGISVLIYKLSKERTCAGLSLKSQDLTALFLAVRLYCSFVMEYDMHTVLDTATLATTLWVIYMIRFKLKSSYMEDKDNFAIYYVVVPCALLALAVHPSTSHNIFNRICWAFCVYLEAVSVLPQLRLMQNTKIVEPFTAHYVFALGVARFLSCAHWVLQVLDTRGRLLTALGYGLWPSMVLLAEVVQTFILADFCYYYVKSVFGGQLVLRLPSGVV

SEQ ID NO: 17147 - protein, 272 aa, Musa acuminata
MRGAKQPIYAGTAWVRRQPPKVKAFLCVVTGMAALVFLRFIVHDHDNLFVAAEAVHALGISVLIYKLTKERTCAGLSLKSQDLTALFLAVRLYCSFVMEYDIHTLLDSATLATTLWVIYMIRFKLKSSYMEDKDNFAIYYVVVPCALLAFAVHPSTSHNIFNRICWAFCVYLEAVSVLPQLRLMQNTKIVEPFTAHYVFALGVARFLSCAHWVLQVLDTRGRLLTALGYGLWPSMVLLAEIVQTFILADFCYYYVKSLVGGQLVLRLPSGVV

SEQ ID NO: 17148 - protein, 283 aa, Festuca arundinacea
RRRDRGSATTTIRGTKRPLGVVTAWGRRQPPKVKAFLAVVTGMAALVFIRFIVHDHDNLFGAAEAAHALGIAVLIYKLTKEKTCAGLSLKSQDLTALFLAVRLYCSFVMEYDIHTVLDSATLVATLFVIYMIRFKLRSTYMVDKDNFALYYVVVPCAALALLIHPSTSHNIANRFSWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17149 - protein, 272 aa, Elaeis guineensis
MRGSRRTMNVVVGWVKRQPPKVKAFLSVVAGMVALVFLRFVVHDHDNLFVAAEAVHALGISVLIYKLTKERTCAGLSLKSQDLTALFLAVRLYCSVVMEYDIHTLLDSATLLTTLWVIYMIRFKLKSSYMEDKDNFAIYYVVVPCAVLALLIHPSTAHNIVNRIFWAFCVYLEAVSVLPQLRLMQNTKIVEPFTAHYVFALGVARFLSCAHWVLQVLDTGGRLLTALGYGLWPSMVLLSEIVQTFILADFCYYYIKSLVGGQLVLRLPSGVV

SEQ ID NO: 17150 - protein, 272 aa, Musa acuminata
MRGARRPIYAVATWVKRQPPKVKAFLCVVAGIAALVFLRFIVHDHDNLFIAAEAVHALGISVLIYKLTKERTCAGLSLKSQDLTALFLAARLYCSFVMEYDIHTVLDTATLATTLWVIYMIRFKLRPSYMEDKDNFAIYFVVVPCVLLALAVHPSTSHNIFNRICWAFCVYLEAVSVLPQLRLMQNTKIVEPFTAHYVFALGIARFLSCAHWVLQVLDTRGRLLTALGYGLWPPMVLLAEIVQTFILADFCYYYVKSVVGGQLVLRLPSGVV

SEQ ID NO: 17151 - protein, 272 aa, Cocos nucifera
MRAPRGRINAVAGWVKRQPPKVKAFLSVVAGMAALVFLRFVVHDHDNLFVAAEAVHALGISVLIYKLTKERTCAGLSLKSQDLTALFLAVRLYCSFVMEYDIHTLLDSATLLTTLWVIYMIRFKLKSSYMEDKDNFAIYYVVVPCAVLALLIHPSTAHNIVNRIFWAFCVYLEAVSVLPQLRLMQNTKIVEPFTAHYVFALGVARFLSCAHWVLQVLDTGGRLLTALGYGLWPSMVLLSEIVQTFILADFCYYYIKSVVGGQLVLRLPSGVV

SEQ ID NO: 17152 - protein, 272 aa, Ricinus communis
MRAPKRPIHAVSTWVRRQPPKVKAFLAVVAGMAALVFLRFIVHDHDNLFVAAEAVHSIGIIVLIYKLMKEKTCAGLSLKSQELTAMFLAVRLYCSFVMEYDIHTLLDLATLGTTLWVIYMIRFNLKSSYMEDKDNFAIYYVVVPCAILALLIHPSTSHNIVNRIFWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17153 - protein, 273 aa, Allium cepa
MRGSSKRQINMVISWVKRQPPKVKAFLSVVSAMAALVFLRFIVHDHDNLFVAAEAAHAIGISVLVYKLTKEKTCAGLSLKSQELTALFLAVRLYCSFVMEYDIHTVLDSATLASTLWVIYMMRFKLKSSYMEDKDNFAMYYVVVPCAALAFLIHPSTSHNILNRICWAFCVYLEAVSVLPQLRLMQNTKIVEPFTSHYVFALGVARFLSCAHWVLQVLDTRGRLLTALGYGLWPSMVLLSEIVQTFILADFCYYYVKSTLGGQLVMRLPSGVV

SEQ ID NO: 17154 - protein, 272 aa, Phalaenopsis aphrodite
MRVSKRSIGVVWAWVRQQPPKIKAFLSVVTGMAALAFLRFVVHDHDNLFVASEAVHAVGISVLIYKLTKEKTCAGLSLKSQELTALFLSVRLYCSFVMEYDIHTLLDSATLVTTLWVIYMIRFKLKSSYMEDKDNFAIYYVVVPCAVLALLVHPTTSHNLVNRIFWAFCVYLEAVSVLPQLRLMQNTKIVEPFTAHYVFALGIARFLSCAHWVLQVLDTRGRLLTALGYGLWPSMVLLSEIVQTFILADFCYYYVKSVFGGQLVLRLPSGVV

SEQ ID NO: 17155 - protein, 272 aa, Amaranthus tuberculatus
MRPQRRPIQAVMAWLRRQPPKVKAFLAVVAGMAALVLLRAVVHDHDNLFVASEAVHVIGIAVLIYKLTKEKTCAGLSLKSQELTAIFLAVRLYCSFVMEYDIHTLLDSATLVFTIWVIYMIRFKLRSTYMEDKDNFALYYVLLPCAVLAFLVHPSTSHNFFNRILWAFCVYLEAVSVLPQLRVMQNTKIVEPFTAHYVFALGVARFLSCAHWVLQVLDSRGHLLTALGYGLWPSFVLISEIVQTFILADFCYYYVKSIFGGQLVLRLPTGVV

SEQ ID NO: 17156 - protein, 273 aa, Amaranthus tuberculatus
MKGGKRTPVQAVTLWVRRQPPKVKAFLAVIAGMAALVFLRMVVHDHDNLFVAAEAVHAIGIAVLIYKLTKEKTCAGLSLKTQELTAIFLAVRLYCSFVMEYDIHTLLDTATLATTLWVIYMIRFKLKSTYMEEKDNFAIYYVVGPCALLSLLVHPSTVHNIVNRISWAFCVYLEAVSVLPQLRVMQNTKIVEPFTAHYVFALGVARFLSCAHWVLQVLDTHGRLLTALGYGLWPSMVLLSEVVQTFILADFCYYYVKSLVGGQLVVRLPSGVV

SEQ ID NO: 17157 - protein, 272 aa, Theobroma cacao
MRAQRRPIHAVSMWVRRQPPKVKAFLAVVSGMAALVLLRFIVHDHDNLFVAAEAVHSIGISVLIYKLTKEKTCAGLSLKSQELTAIFLAVRLYCSFVMEYDIHTLLDLATLATTLWVIYMIRFKLKSSYMEDKDNFAIYYVVAPCAVLALLIHPSTSHNLLNRIFWAFCVYLEAVSVLPQLRVMQNTKIVEPFTAHYVFALGVARFLSCAHWVLQVLDSRGHLLVALGYGLWPSMVLISEIVQTFILADFCYYYIKSVFGGQLVLRLPSGVV

SEQ ID NO: 17158 - protein, 272 aa, Citrus clementina
  Sequence also found in Organisms: Citrus sinensis
MRAPKRPIHAVSTWVRRQPPKVKAFLAVVSGMAALVLLRFIVHDHDNLFVAAEAVHSIGISVLIYKLMKEKTCAGLSLKSQELTAIFLAVRLYCSFVMEYDIHTLLDLATLATTLWVIYMIRFNLRSSYMEDKDNFAIYYVVVPCAVLALLIHPSTSHNILNRIFWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17159 - protein, 272 aa, Elaeis guineensis
MKASRGRINAVVGWVKRQPPKVKAFLSVVAGMAALVFLRFVVHDHDNLFVAAEAVHAIGISVLIYKLTKEKTCAGLSLKSQDLTALFLAVRLYCSFVMEYDIHTLLDSATLVTTLWVIYMIRFKLKSSYMEDKDNFAIYYVVVPCAALALLIHPSTSHNIVNRFFWAFCVYLEAVSVLPQLRLMQNTKIVEPFTAHYVFALGVARFLSCAHWVLQVLDTRGALLTALGYGMWPSMVLFSEIVQTFILADFCYYYVKSLVGGQLVLRLPSGVV

SEQ ID NO: 17160 - protein, 273 aa, Allium cepa
MRGTSKRQINMVISWVKRQPPKVKAFLSVVSAMAALVFLRFIVHDHDNLFVAAEAAHAIGISVLVYKLTKEKTCAGLSLKSQELTALFLAVRLYCSFVMEYDIHTVLDSATLASTLWVIYMMRFKLKSSYMEDKDNFAMYYVVVPCAALAFLIHPSTSHNILNRICWAFCVYLEAVSVLPQLRLMQNTKIVEPFTSHYVFALGVARFLSCAHWVLQVLDTRGRLLTALGYGLWPSMVLLSEIVQTFILADFCYYYVKSTLGGQLVMRLPSGVV

SEQ ID NO: 17161 - protein, 272 aa, Populus trichocarpa
MRPPRRPIHVVTTWVRRQPPKVKAFLAVVAGMSALVLLRFIVHDHDNLFVAAEAVHSIGISVLIYKLMKEKTCAGLSLKTQELTAMFLAVRLYCSFVMEYDIHTILDLATLATTLWVIYMIRFNLKSSYMEDKDNFALYYVAAPCAVLALLIHPSTAHNLLNRILWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17162 - protein, 272 aa, Papaver somniferum
MRGSKTPIHAVATWVRRQPPKVKAFLAVISGMAALVFLRFIVHDHDNLFVAAEAVHSLGICVLIYKLMKEKTCAGLSLKSQELTAMFLAVRLYCSFVMEYDIHTLLDSATLVATLWVIYMIRFKLRSSYMEDKDNFPIYYVAAPCAVFAVFVHPSTSHHMVNRICWAFCVYLEAVSVLPQLRVMQNTKIVEPFTAHYVFALGVARFLSCAHWVLQVLDTHGRLLTALGYGLWPSMVLLSEIVQTFILADFCYYYVKSVVGGQLVLRLPSGVV

SEQ ID NO: 17163 - protein, 272 aa, Euonymus alatus
MRAPRRPIHAVSTWVRRQPPKVKAFLAVVSGMAALVLLRFIVHDHDNLFVAAEAVHSIGISVLIYKLMKEKTCAGLSLKTQELTAMFLAVRLYCSFVMEYDIHTLLDLATLATTIWVIYMIRFKLRSSYMEDKDNFAIYYVVVPCAVLALLIHPTTSHNILNRIFWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17164 - protein, 272 aa, Platanus occidentalis
MRGQRRPVHAVATWVKRQPPKVKAFLAVVSGMAALVLLRFIVHDHDNLFVAAEAVHALGISVLIYKLMKEKTCAGLSLKSQELTAIFLAVRLYCSFVMEYDIHTLLDSATLGTTLWVIYMIRFRLKSSYMEDKDNFAIYYVVVPCVLLALAIHPSTSHNILNRICWAFCVYLEAVSVLPQLRVMQNTKIVEPFTAHYVFALGVARFLSCAHWVLQVLDTRGRLLTALGYGLWPSAVLLSEVVQTFILADFCYYYVKSLVGGQLVLRLPSGVV

SEQ ID NO: 17165 - protein, 272 aa, Populus trichocarpa
MRPPKRPIQVVTTWVRRQPPKVKAFLAVVAGMTALVLLRFIVHDHDNLFVAAEAVHSIGISVLIYKLMKEKTCAGLSLKTQELTAMFLAVRLYCSFVMEYDIHTVLDLATLATTLWVIYTIRFKLKSSYMEDKDNFALYYVAAPCAVLALLIHPSTSHNLLNRILWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17166 - protein, 272 aa, Papaver somniferum
MRGSKTPIHAVATWVRRQPPKVKAFLAVISGMAALVFLRFIVHDHDNLFVAAEAVHSLGICVLIYKLMKEKTCAGLSLKSQELTAMFLAVRLYCSFVMEYDIHTLLDSATLVATLWVIYMIRFKLRPSYMEDKDNFPIYYVAAPCAVFAVFVHPSTSHHMVNRICWAFCVYLEAVSVLPQLRVMQNTKIVEPFTAHYVFALGVARFLSCAHWVLQVLDTHGRLLTALGYGLWPSMVLLSEIVQTFILADFCYYYVKSVVGGQLVLRLPSGVV

SEQ ID NO: 17167 - protein, 272 aa, Gossypium hirsutum
MRAEKRLIHAATMWVRRQPPKVKAFLAVVSGMAALVLLRFIVHDHDNLFVAAESVHSLGISVLIYKLTKEKTCAGLSLKSQELTAIFLAVRLYCSFVMEYDIHTILDLATLATTLWVIYMIRFKLKSSYMEDKDNFAIYYVVIPCAVLALFIHPSTSHNLMNRIFWAFCVYLEAVSVLPQLQVMQNTKIVEPFTAHYVFALGVARFLSCAHWVLQVLDSRGHLLVALGYGLWPSMVLISEIVQTFILADFCYYYIKSVFGGQLVLRLPSGVV

SEQ ID NO: 17168 - protein, 272 aa, Gossypium hirsutum
MRAEKRLIHAATMWVRRQPPKVKAFLAVVSGMAALVLLRFIVHDHDNLFVAAESVHSLGISVLIYKLTKEKTCAGLSLKSQELTAIFLAVRLYCSFVMEYDIHTILDLATLATTLWVIYMIRFKLKSSYMEDKDNFAIYYVVIPCAVLALCIHPSTSHNLMNRIFWAFCVYLEAVSVLPQLQVMQNTKIVEPFTAHYVFALGVARFLSCAHWVLQVLDSRGHLLVALGYGLWPSMVLISEIVQTFILADFCYYYIKSVFGGQLVLRLPSGVV

SEQ ID NO: 17169 - protein, 272 aa, Eucalyptus grandis
MKASKRPIQAVASWLRRQPPKVKAFLAVVSGMVALVFLRMVVHDHDNLFVAAEAVHAVGIAVLIYKLSKEKTCAGLSLKSQELTAVFLAVRLYCSVVMEYDIHTLLDSATLATTLWVIYMIRFKLRSSYMEEKDNFAIYYVVIPCAVLSLVIHPSTHHHIINRICWAFCVYLEAVSVLPQLRVMQNTKIVEPFTAHYVFALGVARFLSCAHWVLQVLDTRGGLLTALGYGMWPSMVLLSEIVQTFILADFCYYYVKSVFGGQLVLRLPSGVV

SEQ ID NO: 17170 - protein, 272 aa, Mimulus guttatus
MRAPKRPIQAVSTWVRRQPPKVKAFLAVISGMAALVLLRAIVHDHDNLFVAAEAVHSIGIAVLIYKLMKEKTCAGLSLKSQELTAIFLAVRLYCSFVMEYDIHTLLDMATLATTLWVIYMIRIKLQSSYMEDKDNIALYYVVGPCAVLALLIHPSTSHHIINRIAWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17171 - protein, 272 aa, Carica papaya
MRPQKRSIHAVSTWVRKQPPKVKAFLAVVAGMAALVLLRFIVHDHDNLFVAAEAVHSIGISVLIYKLMKEKTCAGLSLKSQELTAMFLAVRLYCSFVMEYDIHTVLDLATLATTLWVIYMIRFKLRSSYMEDKDNFAIYYVVIPCAVLALFIHPSTSHHLLNRIFWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17172 - protein, 272 aa, Papaver somniferum
MRAQKKPIQAVATWVRRQPPKVKAFLAVVSGMTALVFLRFIVNDHDNLFVAAEAVHAIGVSVLIYKLMKEKTCAGLSLKSQELTAIFLAVRLYCSFVMEYDIHTLLDTATLGTTLWVIYMIRFKLRSSYMEDKDNFAIYYVLVPCAVLALAIHPSTSHNILNRIFWALCVYLEAVSVLPQLRVMQNTKIVEPFTAHYVFALGVARFLSCAHWVLQVLDTRGRLLTALGYGLWPSMVLLSEIVQTFILADFCYYYVKSIFGGQLVLRLPSGVV

SEQ ID NO: 17173 - protein, 272 aa, Tripterygium wilfordii
MRAPRRPIHAVSTWVRRQPPKVKAFLAVVSGMAALVLLRFIVHDHDNLFVAAEAVHSIGISVLIYKLMKEKTCAGLSLKTQELTAMFLAVRLYCSFVMEYDIHTLLDLATLATTIWVIYMIRFKLRSSYMEDKDNFAIYYVVVPCAVLALLIHPTTSHNILNRIFWAFCVYLEAVSVLPQLRVMQNTKIVEPFTAHYVFALGVARFLSCAHWVLQVLDSRGHLLVALGYGLWPSMVLISEVVQTFILADFCYYYVKSVFGGQLVLRLPSGVV

SEQ ID NO: 17174 - protein, 273 aa, Beta vulgaris
MKGGKRSPVQAVNLWVRRQPPKMKAFLAVVAAMAALVFLRMVVHDHDNLFVAAEAVHAIGIAVLIFKLTKEKTCAGLSLKSQELTAIFLAVRLYCSFVMEYDIHTLLDTATLATTLWVIYMIRFRLKSTYMEEKDNFAIYFVVVPCAVLSLLIHPSTVHNIVNRISWAFCVYLEAVSVLPQLRVMQNTKIVEPFTAHYVFALGVARFFSCAHWVLQVLDTHGRLLTALGYGLWPSMVLLSEVVQTFILADFCYYYVKSLVGGQLVLRLPSGVV

SEQ ID NO: 17175 - protein, 272 aa, Manihot esculenta
MRPHKRPIHAVTTWVRRQPPKVKAFLAVVSGMAALVLLRFIVHDHDNLFVAAEAVHSLGISVLIYKLMKEKTCAGLSLKSQELTAMFLAVRLYCSFVMEYDIHTLLDLATLATTLWVIYMIRFKLRASYMEDKDNFAIYYVALPCAILALFIHPSTSHNLLNRILWAFCVYLEAVSVLPQLRVMQNTKIVEPFTAHYVFALGVARFLSCAHWVLQVLDSRGHLLVALGYGLWPSMVLISEIVQTFILADFCYYYIKSVFGGQLVLRLPSGVV

SEQ ID NO: 17176 - protein, 272 aa, Manihot esculenta
MRPQQRPIHAVTSWVRRQPSKVKAFLGVVLGMAALVFLRFIVHDHDSLFIAAEAVHSIGIIVLIYKLTKERTCAGLSLKSQELTAMFLAVRLYCSFVMEYDIHTLLDLATLATTLWVIYMIRFKLKSSYMEDKDNFAIYYVVLPCAILALLIHPSTSHNLLNRISWAFCVYLEAVSVLPQLRVMQNTKIVEPFTAHYVFALGVARFLSCAHWVLQVLDTRGRLLVALGYGLWPSMVLISEIVQTFILADFCYYYVKSVFGGQLVLRLPSGVV

SEQ ID NO: 17177 - protein, 272 aa, Gossypium raimondii
MRAEKRLIHAATMWVRRQPPKVKAFLAVVSGMATLVLLRFIVHDHDNLFVAAESVHSLGISVLIYKLTKEKTCAGLSLKSQELTAIFLAVRLYCSFVMEYDIHTILDLATLATTLWVIYMIRFKLKSSYMEDKDNFAIYYVVIPCAVLALFIHPSTSHNLMNRIFWAFCVYLEAVSVLPQLQVMQNTKIVEPFTAHYVFALGVARFLSCAHWVLQVLDSRGHLLVALGYGLWPSMVLISEIVQTFILADFCYYYIKSVFGGQLVLRLPSGVV

SEQ ID NO: 17178 - protein, 272 aa, Actinidia deliciosa
MRAPKRPIHAVSMWVRRQPPKVKAFLAVVAGMAALVLLRVIVHDHDNLFVAAEAVHSIGICVLIYKLTKEKTCAGLSLKTQELTALFLAVRLYCSFVMEYDIHTLLDFSTLATTLWVIYMIRFSLKSSYMEDKDNLAMYYVVVPCAVLALLIHPSTSHNIVNRIFWAFCVYLEAVSVLPQLRVMQNTKIVEPFTAHYVFALGIARFLSCAHWVLQVLDSRGHLLVALGFGLWPSMVLISEIVQTFILADFCYYYVKSVFGGQLVLRLPSGVV

SEQ ID NO: 17179 - protein, 272 aa, Mimulus guttatus
MRSPRRPIQAVSTWVRRQPPKVKAFLAVISGMAALVILRAIVHDHDNLFVAAEAVHSIGICVLIYKLMKEKTCAGISLKSQDLTAIFLAVRLYCSFVMEYDIHTVLDMATLATTLWVIYMIRLKLKSSYMADKDNFALYYVLAPCAILALLIHPSTSHHIINRIAWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17180 - protein, 269 aa, Allium cepa
SKRQINMVISWVKRQPPKVKAFLSVVSAMAALVFLRFIVHDHDNLFVAAEAAHAIGISVLVYKLTKEKTCAGLSLKSQELTALFLAVRLYCSFVMEYDIHTVLDSATLASTLWVIYMMRFKLKSSYMEDKDNFAMYYVVVPCAALAFLIHPSTSHNILNRICWAFCVYLEAVSVLPQLRLMQNTKIVEPFTSHYVFALGVARFLSCAHWVLQVLDTRGRLLTALGYGLWPSMVLLSEIVQTFILADFCYYYVKSTLGGQLVMRLPSGVV

SEQ ID NO: 17181 - protein, 272 aa, Cajanus cajan
MRGGRKSIHAITTWVRRQPPKVKAFLAVVSGMAALVFLRFIVHDHDNLFVAAEAVHSLGISVLIYKLIKEKTCAGLSLKSQELTAIFLAVRLYCSFVMEYDIHTLLDLATLATTLWVIYMIRFKLKSSYMEEKDNFAIYYVVIPCAVLALFIHPSTSHHLLNRIFWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17182 - protein, 272 aa, Tripterygium wilfordii
MRASKRPIHAVSTWVRRQPPKVKAFLAVVSGMATLVLLRFIVHDHDNLFVAAEAVHSIGISVLIYKLMKEKTCAGLSLKTQELTAIFLAVRLYCSFVMEYDIHTLLDLATLATTIWVIYMIRFKLRSSYMEDKDNFAIYYVVVPCAVLALLIHPTTSHNLLNRIFWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17183 - protein, 272 aa, Antirrhinum majus
MRPAKRPIQAVSSWVRRQPPKVKAFLAVISGMAALVLLRAIVHDHDNLFVAAEAVHSIGISVLIYKLMKEKTCAGLSLKSQELTAIFLAVRLYCSFVMEFDIHTLLDMATLATTLWVVFMIRFKLRSSYMEDKDNFALYYVLAPCAVLALLIHPSTSHNIVNRIAWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGELVMRLPSGVV

SEQ ID NO: 17184 - protein, 272 aa, Phaseolus vulgaris
MRPQRTSIHAVTSWVRRQPPKVKAFLAVVSGMAALVLLRFIVHDHDNLFVAAEAVHSLGISVLIYKLTKEKTCAGLSLKSQELTAIFLAVRLYCSFVMEYDIHTILDFATFITTLWVIYMIRFKLKASYMEEKDNFAIYYVVVPCAVLALLIHPSTSHHLLNRISWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17185 - protein, 272 aa, Fagus grandifolia
MRTQRRPIHAVSTWVRRQPPKVKAFLAVVSGMAALVLLRFIVHDHDNLFVAAEAVHSIGISVLIYKLMKEKTCAGLSLKSQELTAMFLAVRLYCSFVMEYDIHTLLDLATFATTLWVIYMIRFNLKASYMDDKDNFAIYYVVVPCAVLALFIHPSTSHHLLNRIFWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17186 - protein, 273 aa, Daucus carota
MRGAPKRPIQMITSWLRRQPPKVKAFLGVVAGMAALVLLRAIVHDHDTLFVAAEAVHSLGISVLIYKLMKEKTCAGLSLKSQELTALFLAVRLYCSFVMEYDIHTLLDLATLGTTLWVIYMIRFKLRSSYMEDKDNFAIYYVVIPCAVLAMLVHPSTSHNFINRFFWGFCVYLESVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17187 - protein, 272 aa, Trifolium pratense
MRPQRTSIHAISTWVRRQPPKVKAFLAVVSGMAALVLLRFIVHDHDNLFVAAEAVHSLGITVLIYKLMKEKTCAGLSLKSQELTAIFLAVRLYCSFVMEYDIHTILDLATFVTTLWVIYMIRFKLKASYMEEKDNFAIYYVVIPCAVLALLIHPSTSHHILNRIFWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17188 - protein, 272 aa, Lotus japonicus
MRPQRMSIHTVATWVRRQPPKVKAFLAVVSGMAALVLLRFIVHDHDNLFVAAEAVHSLGISVLIYKLMKEKTCAGLSLKSQELTAMFLAVRLYCSFVMEYDIHTLLDFATFATTVWVIYMIRFKLKASYMEEKDNFAIYYVVIPCAVLALLIHPSTSHHILNRIFWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17189 - protein, 272 aa, Orobanche aegyptiaca
MKVPRRPIQAVATWVRRQPPKVKAFLAVVSGMAALVLLRAIVHDHDNLFVASEAVHSIGIGVLIYKLMKERTCAGLSLKSQELTAIFLAVRLYCSFVMEYDIHTILDMATLATTLWVIYMIRFKLKSSYMEDKDNIALYYVVVPCAIVALLIHPSTSHHIINRIAWAFCVYLEAVSVLPQLRVMQNTKIVEPFTAHYVFALGVARFLSCAHWVLQVLDSRGHLLVALGYGLWPSMVLLSEIVQTFILADFCYYYVKSVFGGQLVLRLPSGVV

SEQ ID NO: 17190 - protein, 272 aa, Petroselinum crispum
MRAPKRPIQMVTSWVRRQPPKVKAFLGVVAGMAALVLLRAIVHDHDTLFVAAEAVHSLGISVLIYKLMKEKTCAGLSLKSQELTALFLAVRLYCSFVMEYDIHTLLDLATLGTTLWVIYMIRFKLRSSYMEDKDNFAIYYVVIPCAVLAAVVHPSTSHNFINRFFWGFCVYLESVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17191 - protein, 272 aa, Arachis hypogaea
MRPPKKSIHAVTTWVRRQPPKVKAFLAVVSGMAALVFLRFIVHDHDNLFVAAEAVHSLGISVLIYKLMKEKTCAGLSLKSQELTAMFLAVRLYCSFVMEYDIHTILDLATLGTTLWVIYMIRFNLRSSYMEEKDNFAIYYVVIPCAVLALFIHPSTSHHLLNRIFWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17192 - protein, 272 aa, Papaver somniferum
MRAQKKTIQAVATWVRRQPPKVKAFLAVVSGMTALVFLRFIVNDHDNLFVAAEAVHAIGVSVLIYKLMKEKTCAGLSLKSQELTAIFLAVRLYCSFVMEYDIHTLLDTTTLGTTLWVIYMIRFKLRSSYMEDKDNFAIYYVLVPCAVLALAIHPSTSHNILNRIFWALCVYLEAVSVLPQLRVMQNTKIVEPFTAHYVFALGVARFLSCAHWVLQVLDTRGRLLTALGYGLWPSMVLLSEIVQTFILADFCYYYVKSIFGGQLVLRLPSGVV

SEQ ID NO: 17193 - protein, 272 aa, Prunus persica
MRAPKRPIHTVSTWVRRQPPKVKAFLAVVTGMAALVVLRFIVHDHDNLFVAAEAVHSIGIMVLIYKLTKEKTCAGLSLKSQELTAMFLAVRLYCSFVMEYDIHTLLDLATLVTTLWVIYMIRFNLKSSYMEDKDNFAIYYVVVPCALLALFIHPSTSHHLLNRISWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17194 - protein, 272 aa, Chenopodium quinoa
MRPQRKTIHTIMAWLRRQPPKVKAFLAVVAGMAALVLLRAVVRDHDNLFVAAEAVHVIGIAVLIYKLTKEKTCAGLSLKSQELTAIFLAVRLYCSFVMEYDIHTLLDSATLVFTLWVIYMIRFNLRSTYMEDKDNFALYYVLVPCAVLAVLVHPSTSHNILNRISWAFCVYLEASSVLPQLRVMQNTKIVEPFTAHYVFALGVARFLSCAHWVLQVLDSRGHLLTALGYGLWPSFVLISEIVQTFILADFCYYYVQSIFGGQLVLRLPSGVV

SEQ ID NO: 17195 - protein, 272 aa, Valeriana officinalis
MRAPRRPIHIVSTWVRRQPPKVKAFLAVVAGMAALVLLRFIVHDHDNLFVAAEAVHSIGISVLIYKLMKERTCAGLSLKSQELTAMFLAVRLYCSFVMEYDIHTLLDLATLGTTLWVIYMIRFNLKSSYMEDKDNFAIYYVVVPCAVLALAVHPTTSHHLLNRIFWAFCVYLEAVSVLPQLRVMQNTKIVEPFTAHYVFALGVARFLSCAHWVLQVLDSRGQLLTALGYGLWPSMVLISEIVQTFILADFCYYYIKSVFGGQLVLRLPSGVV

SEQ ID NO: 17196 - protein, 272 aa, Vaccinium corymbosum
MRPGKRPIQAVSVWVRRQPPKVKAFLAVVTGMAALVLLRVIVHDHDNLFVAAEAVHSIGISVLIYKLMKEKTCAGLSLKSQELTALFLAVRLYCSFVMEYDIHTLLDMCTLATTLWVIYMIRFNLKSSYMEDKDNFPIYYVAAPCAALALLIHPSTSHHIINRIFWAFCVYLEAVSVLPQLRVMQNTKIVEPFTAHYVFALGVARFLSCAHWVLQVLDSRGHLLTALGYGLWPSMVLISEIVQTFILADFCYYYVKSVFGGQLVLRLPSGVV

SEQ ID NO: 17197 - protein, 272 aa, Trifolium pratense
  Sequence also found in Organisms: Medicago truncatula
MRPQRTSIHAISTWVRRQPPKVKAFLAVVSGMAALVLLRFIVHDHDNLFVAAEAVHSLGISVLIYKLMKEKTCAGLSLKSQELTAIFLAVRLYCSFVMEYDIHTILDLATFVTTVWVIYMIRFKLKASYMEEKDNFAIYYVVIPCAVLALLIHPSTSHHILNRIFWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17198 - protein, 272 aa, Gossypium hirsutum
MRTQKRPMHAVSMWVRRQPPKVKAFLAVVSGMAALVLLRVIVHDHDNLFVAAEAVHSIGISVLIYKLTKEKTCAGLSLKSQELTAIFLAVRLYCSFVMEYDIHTLLDLATLATTLWVIYMIRFKLKSSYMEDKDNFVIYYVVVPCAVLALCIHPTTSHNLLNRISWAFCVYLEAVSVLPQLRVMQNTKIVEPFTAHYVFALGVARFLSCAHWVLQVLDSRGRLLVALGYGLWPSMVLISEIVQTFILADFCYYYIKSVFGGQLVLRLPSGVV

SEQ ID NO: 17199 - protein, 272 aa, Gossypium hirsutum
MRVQQRPIRALSMWVRRQPPKVKAFLGVVSGMAALVLLRFIVHDHDNLFVAAEAVHSIGISVLIYKLIKEKTCAGLSLKSQELTAIFLAVRLYCSFVMEYDIHTLLDLATLATTLWVIYMIRFKLKSSYMEDKDNFALYYVLVPCAALALFIHPSTSHNLVNRIFWAFCVYLEAVSVLPQLRVMQNTKIVEPFTAHYVFALGVARFLSCAHWVLQVLDSRGHLLVALGYGLWPSMVLISEIVQTFILADFCYYYIKSVFGGQLVLRLPSGVV

SEQ ID NO: 17200 - protein, 272 aa, Gossypium hirsutum
MRVQQRPIRAMSMWVRRQPPKVKAFLAVVSGMAALVLLRFIVNDHDNLFVAAEAVHSIGISVLIYKLIKEKTCAGLSLKSQELTAIFLAVRLYCSFVMEYDIHTLLDLATLATTLWVIYMIRFKLKSSYMEDKDNFALYYVLVPCAALALFIHPSTSHNLVNRIFWAFCVYLEAVSVLPQLRVMQNTKIVEPFTAHYVFALGVARFLSCAHWVLQVLDSRGHLLVALGYGLWPSMVLISEIVQTFILADFCYYYIKSVFGGQLVLRLPSGVV

SEQ ID NO: 17201 - protein, 272 aa, Vigna unguiculata
MRPQRTSIYAVTSWVRRQPPKVKAFLAVVSGMAALVLLRFIVHDHDNLFVAAEAVHSLGISVLIYKLMKEKTCAGLSLKSQELTAIFLAVRLYCSFVMEYDIHTILDFATFITTLWVIYMIRFKLKASYMEEKDNFAIYYVVVPCAVLALLIHPSTSHHLLNRISWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17202 - protein, 271 aa, Eschscholzia californica
GGPKKPIHVVATWVRRQPPKVKAFLAVISGMAALVFLRFIVNDHDNLFVAAEAVHSIGICVLIYKLMKEKTCAGLSLKSQELTAMFLAVRLYCSFVMEYDIHTLLDSATLGTTLWVIYMIRFKLRSSYMEDKDNFPIYYVAVPCALLALFVHPSTSHHMINRVCWAFCVYLEAVSVLPQLRVMQNTKIVEPFTAHYVFALGVARFLSCAHWVLQVLDTRGRLLTALGYGLWPSMVLLSEIVQTFILADFCYYYVKSVVGGQLVLRLPSGVV

SEQ ID NO: 17203 - protein, 273 aa, Fagopyrum esculentum
MKGGQKRPIQAFSSWVRRQPPKVKAFMAVISGIIALVFLRMIVHDHDKLFVAAEAVHAIGICVLIYKLTKEKTCAGLSLKSQELTAMFLAVRLYCSFVMEYDIHTLLDTATLATTLWVIYMMRFKVRSTYMEDKDNFAIYYVAIPCAVLSVIVHPSTTHNILNRIAWAFCVYLEAVSVLPQLRVMQNTKIVEPFTAHYVFALGVARFLSCAHWVLQVLDTRGRLLTALGYGLWPSMVLLSEIVQTFILADFCYYYVKSIFGGQLVLRLPSGVV

SEQ ID NO: 17204 - protein, 273 aa, Fagopyrum esculentum
MKGGQKRPIQAFSSWVRRQPPKVKAFMAVISGIMALVFLRMIVHDHDKLFVAAEAVHAIGICVLIYKLTKEKTCAGLSLKSQELTAMFLAVRLYCSFVMEYDIHTLLDTATLATTLWVIYMMRFKVRTTYMEDKDNFAIYYVAIPCAVLSVLVHPSTTHNILNRIAWAFCVYLEAVSVLPQLRVMQNTKIVEPFTAHYVFALGVARFLSCAHWVLQVLDTRGRLLTALGYGLWPSMVLLSEIVQTFILADFCYYYVKSIFGGQLVLRLPSGVV

SEQ ID NO: 17205 - protein, 272 aa, Gossypium raimondii
MRVQQRPIRALSMWVRRQPPKVKAFLGVVSGMAALVLLRFIVHDHDNLFVAAEAVHSIGISVLIYKLIKEKTCAGLSLKSQELTAIFLAVRLYCSFVMEYDIHTLLDLATLATTLWVIYMIRFKLKSSYMEDKDNFALYYVLAPCAALALFIHPSTSHNLVNRIFWAFCVYLEAVSVLPQLRVMQNTKIVEPFTAHYVFALGVARFLSCAHWVLQVLDSRGHLLVALGYGLWPSMVLISEIVQTFILADFCYYYIKSVFGGQLVLRLPSGVV

SEQ ID NO: 17206 - protein, 272 aa, Tropaeolum majus
MRAPKRPIQTVLSWVKKQPPKVKAFLAVVAGMSALVLLRFIVHDHDNLFVAAEAVHSIGISVLIYKLMKEKTCAGLSLKSQELTALFLAVRLYCSFVMEYDIHTLLDLSTFATTVWVIYMIRFNLRSSYMEDKDNFAIYYVVLPCALLALFIHPSTSHHILNRIFWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17207 - protein, 272 aa, Lippia dulcis
MRPPRRPIQAVTTWVRRQPPKVKGFLAVISGMVALVILRAIVHDHDNLFVAAEAVHSIGICVLIYKLMKEKTCAGLSLKSQELTAIFLAVRLYCSFVMEYDIHTLLDMATLATTLWVIYMIRFNLRSSYMEDKDNFALYYVVGPCAIVALLIHPSTSHHIINRIAWAFCVYLEAVSVLPQLRVMQNTKIVEPFTAHYVFALGVARFLSCAHWVLQVLDTRGHLLVALGYGLWPSMVLISEVVQTFILADFCYYYVKSVFGGQLVLRLPSGVV

SEQ ID NO: 17208 - protein, 272 aa, Prunus mume
MRAPKRPIHTLSTWVRRQPPKVKAFLAVVTGMAALVVLRFIVHDHDNLFVAAEAVHSIGIMVLIYKLTKEKTCAGLSLKSQELTAMFLAVRLYCSFVMEYDIHTLLDLATLVTTLWVIYMIRFNLKSSYMEDKDNFAIYYVVVPCALLALFIHPSTSHHLLNRISWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17209 - protein, 271 aa, Chenopodium quinoa
GGKRSPVQAVNIWVRRQPPKMKAFLAVVVGIAALVFLRMVVQDHDNLFVAAEAVHAVGIAVLIYKLTKEKTCAGLSLKSQELTAIFLAVRLYCSFVMEYDIHTLLDTATLATTLWVIYMIRFRLKSTYMEEKDNFAIYYVVVPCAVLSLLIHPTTVHNIVNRVSWAFCVYLEAVSVLPQLRVMQNTKIVEPFTAHYVFALGVARFLSCAHWVLQVLDTHGRLLTALGYGLWPSMVLLSEVVQTFILADFCYYYVKSLVGGQLVLRLPSGVV

SEQ ID NO: 17210 - protein, 273 aa, Raphanus sativus
MKGGTKSPIQAVWSWVRRQPPKVKAFLAVVSGMAALVLLRFIVHDHDNLFVAAEAVHSIGICVLIYKLMKEKTCAGLSLKSQELTAIFLAVRLYCSFVMEYDIHTILDLATLGTTLWVIFMIRFKLRPSYMQDKDNFALYYVLVPCVVLAVLIHPSTSHNILNRISWALCVYLEAVSVLPQLRVMQNTKIVEPFTAHYVFALGVARFLSCAHWVLQVVDTRGRLLVALGYGLWPSMVLISEIVQTFILADFCYYYVKSVFGGQLVLRLPSGVV

SEQ ID NO: 17211 - protein, 272 aa, Triphysaria pusilla
MRPPKRPIQAVLTWVRRQPPKVKAFLAVISGMAALVILRAIVHDHDNLFVAAEAVHSIGIMVLIYKLMKERTCAGLSLKSQELTAIFLAVRLYCSFVMEYDIHTLLDMATLATTLWVIYTIRFKLNSSYMADKDNFALYYVAAPCAVLALLIHPSTSHHIVNRIAWAFCVYLEAVSVLPQLRVMQNTKIVEPFTAHYVFALGVARFLSCAHWVLQVLDSRGHLLVALGYGLWPTMVLISEIVQTFILADFCYYYVKSVFGGQLVLRLPSGVV

SEQ ID NO: 17212 - protein, 272 aa, Triphysaria pusilla
MKAPRRPIQAVTSWVRRQPPKVKAFLAVVSGMAALVLLRAVVHDHDNLFVAAEAVHSIGIGVLIYKLIKERTCAGLSLKSQELTAIFLAVRLYCSFVMEYDIHTLLDMATLATTLWVIYMIRFKLKSSYMEDKDNIPLYYVVIPCAVVALLIHPSTSHHIINRIAWAFCVYLEAVSVLPQLRVMQNTKIVEPFTAHYVFALGVARFFSCAHWVLQVLDTRGHLLVALGYGLWPSMVLLSEIVQTFILADFCYYYVKSVFGGQLVLRLPSGVV

SEQ ID NO: 17213 - protein, 273 aa, Thalictrum flavum
RGSSAKRPIYAVAAWVKRQPPKVKAFLAVVSGMAALVFLKLIVNDHDNLFVAAEAVHAIGICVLIYKLMKEKTCAGLSLKSQEITALFLAIRLYCSFVMEYDIHTLLDTATLGTTLWVIYMIRFKLRSSYMEDKDNFPIYYVVVPCAVFALIIHPSTSHHILNRIFWALCVYLEAVSVLPQLRVMQNTKIVEPFTAHYVFALGVARFLSCAHWVLQVLDTRGRLLTALGYGLWPSMVLISEIVQTFILADFCYYYMKSLVGGQLVLRLPSGVV

SEQ ID NO: 17214 - protein, 272 aa, Amorphophallus konjac
MKGSKRSLNAALGWLRRQPPKVKAFLAVVAGMAALVFLRFVVHDHDNLFVAAEVCHAAGIIVLIYKLTKERTCAGLSLKSQELTALFLAVRLYCSFVMEYDIHTLLDTATLVTTLWVIYMFRFKLRSSYMEDQDNFAIYYVVIPCVILALLIHPTTTHNFINRIFWAFCVYLEAVSVLPQLRLMQNTKIVEPFTAHYVFALGVARFLSCAHWVLQVLDTQGRLLTALGYGLWPPMVLLSEIVQTFILADFCYYYVKSLVGGQLVLRLPSGVV

SEQ ID NO: 17215 - protein, 272 aa, Aristolochia fimbriata
MRAPRRSMNAFVGWVRRQPPKVKSFLAVVTGMVALVLLRLVVRDHDNLFVAAEALHALGISVLIYKLTKEKTCAGLSLKTQELTAIFLAVRLYCSFVMEYDIHTLLDSATLITTLWVIYMIRFKLKFSYMEDKDNFAIYYVVGPCAVLALLIHPSTSHHIFNRICWAFCVYLEAVSVLPQLRVMQNTKIVEPFTAHYVFALGVARFLSCAHWVLQVLDTRGRLLTALGYGLWPPMVLLSEIVQTFILADFCYYYVKSVVGGQLVLRIPSGVV

SEQ ID NO: 17216 - protein, 273 aa, Brassica napus
  Sequence also found in Organisms: Brassica oleracea
MKGGTKSPIQAVWSWVRRQPPKVKAFLAVVSGMAALVLLRFIVHDHDNLFVAAEAVHSIGICVLIYKLMKEKTCAGLSLKSQELTAIFLAVRLYCSFVMEYDIHTILDLATLGTTLWVIFMIRFKLRASFMEDKDNFALYYVLVPCVVLAVLIHPSTSHNILNRISWALCVYLEAVSVLPQLRVMQNTKIVEPFTAHYVFALGVARFLSCAHWVLQVVDTRGRLLVALGYGLWPSMVLISEIVQTFILADFCYYYVKSVFGGQLVLRLPSGVV

SEQ ID NO: 17217 - protein, 272 aa, Cannabis sativa
MRAPKRPIHAVSTWVRRQPPKVKAFLAVISGMTALVLLRFIVHDHDNLFVAAEAVHSIGISVLIYKLMKEKTCAGLSLKSQELTAIFLAVRLYCSFVMEYDIHTLLDLATLGTTLWVIFMIRFKLKSSYMEDKDNFAIYYVVVPCAVLALLIHPSTSHHLLNRIFWAFCVYLEAVSVLPQLRVMQNTKIVEPFTAHYVFALGIARFLSCAHWVLQVLDTRGQLLVALGYGLWPSMVLISEIVQTFILADFCYYYVKSVFGGQLVLRLPSGVV

SEQ ID NO: 17218 - protein, 272 aa, Cicer arietinum
MRPQKTSIHAISTWVRRQPPKVKAFLAVVSGMAALVLLRFIVHDHDNLFVAAEAVHSLGISVLIYKLMKEKTCAGLSLKSQELTAMFLAVRLYCSFVMEYDIHTILDLATFVTTVWVIYMIRFKLKASYMEEKDNFAIYYVVIPCAVLALLIHPSTSHHILNRIFWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17219 - protein, 272 aa, Cleome gynandra
MKATKNPIHAVWTWVRRQPPKVKAFLAVVTGMAALVLLRFIVHDHDNLFVAAEAVHSIGIAVLIYKLTKEKTCAGLSLKSQELTAIFLGVRLYCSFVMEYDIHTLLDLATLGTTLWVIFMIRFKLRSSYMEDKDNFALYYLLVPCAVLAVLIHPSTSHNILNRISWAFCVYLEAISVLPQLRVMQNTKIVEPFTAHYVFALGVARFLSCAHWVLQVLDTRGRLLVALGYGLWPSMVLISEIVQTFILADFCYYYVRSVLGGQLVLRLPSGVV

SEQ ID NO: 17220 - protein, 272 aa, Euphorbia peplus
MRAHKRPIYAVTTWLRRQPSKVKAFLAVVAGMSALVLLRFIVHDHDNLFVAAEAVHSIGIVVLIYKLMKEKTCAGLSLKSQELTAMFLAVRLYCSFVMEYDIHTILDLATLGTTLWVIYMIRFKLKSSYMVDKDNFAIYYVVVPCAALAFLIHPSTSHNFINRIFWAFCVYLEAVSVLPQLRVMQNTKIVEPFTAHYVFALGVARFLSCAHWVLQVLDSRGHLLVALGYGLWPSMVLISEIVQTFILADFCYYYIKSVFGGQLVLRLPSGVV

SEQ ID NO: 17221 - protein, 272 aa, Gossypium raimondii
MRTQKRPIHAVSMWVRRQPPKVKAFLAVVSGMAALVLLRVIVNDHDNLFVAAEAVHSIGISVLIYKLTKEKTCAGLSLKSQELTAIFLAVRLYCSFVMEYDIHTLLDLATLATTLWVIYMIRFKLKSSYMEDKDNFVIYYVVVPCAVLALCIHPTTSHNLLNRISWAFCVYLEAVSVLPQLRVMQNTKIVEPFTAHYVFALGVARFLSCAHWVLQVLDSRGRLLVALGYGLWPSMVLISEIVQTFILADFCYYYIKSVFGGQLVLRLPSGVV

SEQ ID NO: 17222 - protein, 272 aa, Lupinus angustifolius
MRPQRTPIHTITTWVRKQPPKVKAFLAVVSGMAALVLLRFIVHDHDNLFVAAEAVHSIGISVLIYKLMKEKTCAGLSLKSQELTAIFLAVRLYCSFVMEYDIHTLLDFATFATTLWVIYMIRFKLKASYMEEKDNFAIYYVVIPCAVLALLIHPSTSHHLLNRISWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17223 - protein, 272 aa, Quercus alba
MRAQKTPIHAVSTWVRRQPPKVKAFLAVVSGMAALVLLRFIVHDHDNLFVAAEAVHSIGISVLIYKLMKEKTCAGLSLKSQELTAIFLAVRLYCSFVMEYDIHTLLDLATFLTTLWVIYMIRFNLKSSYMEDKDNFAIYYVVIPCAVLALFIHPSTSHHFLNRIFWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17224 - protein, 272 aa, Phalaenopsis aphrodite
MRGSGRPISVVTRWVRRQPPRMKAFLSVVAGMVALVLLRFVVQDHDSLFVAAEAVHAIGISVLIYKLAKEKTCAGLSLKSQELTALFLAVRLYCSFVMEYDIHTLLDSATLVTTLWVIYMIRFKLKSSYMEDKDNFVIYYVVVPCLVLAFAVHPTTSHNIVNKISWAFCVYLEATSVLPQLRLMQNTKIVEPFTAHYVFALGIARFLSCAHWILQVLDTRGRLLTALGYGLWPSMVLLSEIVQTFILADFCYYYVKSVFGGQLVLRLPAGVV

SEQ ID NO: 17225 - protein, 272 aa, Solanum lycopersicum
  Sequence also found in Organisms: Solanum tuberosum, Solanum phureja
MRTTRRPIQVVSTWVRRQPPKVKAFLAVITGMAALVLLRAIVHDHDNLFVAAEAVHSIGISVLIYKLMKEKTCAGLSLKSQELTAMFLAVRLYCSFVMEYDIHTLLDLATLATTLWVIYMIRFNLRSSYMEDKDNFLIYYVVIPCAALALLIHPSTSHLFVNRVFWAFCVYLEAVSVLPQLRVMQNTKIVEPFTAHYVFALGVARFLSCAHWVLQVLDSRGHLLVALGHGLWPSMVLISEIVQTFILADFCYYYVKSVFGGQLVMRLPSGVV

SEQ ID NO: 17226 - protein, 272 aa, Salvia sclarea
MKAPRRPIQAAATWLRRQPPKVKAFLAVISGMAALVLLRAIVHDHDNLFVAAEAVHSIGIAVLIYKLMKERTCAGLSLKSQELTAIFLAVRLYCSFVMEYDIHTVLDLATLATTLWVVYMIRFKLRSSYMEDKDNIAIYYVVVPCAVIALIVHPSTSHHVVNRIAWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17227 - protein, 272 aa, Silene vulgaris
MRPQRRPIHTITLWLKRQPPKVKAFLAVVAGMAALVLLRAVVHDHDNLFVAAEAVHAIGIAVLIYKLAKEKTCAGLSLKSQELTAIFLAIRLYCSFVMEYDIHTLLDSATLAFTLWVIYMIRFSLRSTYMEDKDNFPIYYVLAPCAVLAFLVHPSTSHNIINRILWAMCVYLEAVSVLPQLRVMQNTKIVEPFTAHYVFALGVARFLSCAHWVLQVLDSRGHLLTALGYGLWPSFVLISEIVQTFILADFCYYYVKSIFGGQLVMRLPSGVV

SEQ ID NO: 17228 - protein, 272 aa, Eutrema halophilum
MKATKNPIHAVWSWVRRQPPKVKAFLAVVTGMAALVLLRFIVHDHDNLFVAAEAVHSIGICVLIYKLMKEKTCAGLSLKSQELTAIFLAVRLYCSFVMEYDIHTILDLATLGTTLWVIFMIRFKLRASYMEDKDNFALYFVLVPCAVLAVLIHPSTSHNILNRISWALCVYLEAVSVLPQLRVMQNTKIVEPFTAHYVFALGVARFLSCAHWVLQVVDTRGRLLVALGYGLWPSMVLISEIVQTFILADFCYYYVKSVFGGQLVLRLPSGVV

SEQ ID NO: 17229 - protein, 273 aa, Eutrema parvulum
MKAPTKSPIHAVWSWVRRQPPKVKAFLAVVTGMAALVLLRFIVHDHDNLFVAAEAVHSIGICVLIYKLMKEKTCAGLSLKSQELTAIFLAVRLYCSFVMEYDIHTILDLATLGTTLWVIFMIRFKLRASYMEDKDNFALYFVLVPCAVLAVLIHPSTSHNILNRISWALCVYLEAVSVLPQLRVMQNTKIVEPFTAHYVFALGVARFLSCAHWVLQVVDTRGRLLVALGYGLWPSMVLISEIVQTFILADFCYYYVKSVFGGQLVLRLPSGVV

SEQ ID NO: 17230 - protein, 272 aa, Eutrema parvulum
MKATKSPIHAVSSWVRRQPPKVKAFLAVVSGMAALVLLRFIVHDHDNLFVAAEAVHSIGISVLIYKLMKEKTCAGLSLKSQELTAIFLAVRLYCSLVMEYDIHTILDLATLATTLWVIFMIRFKLRASYMEDKDNFALYYVLLPCAVLAVLIHPSTSHIILNRIFWAFCVYLEAVSVLPQLRAMQNTKIVEPFTAHYVFALGVARFLSCAHWVLQVVDSRGHLLVALGYGLWPSMVLISEVVQTFILADFCYYYVKSVFGGQLVLRLPSGVV

SEQ ID NO: 17231 - protein, 272 aa, Tragopogon dubius
MRPPKKTIHVISSWVRRQPPKVKAFLAVVTGMLALVLLRVIVHDHDNLFVAAEAVHSIGISVLIYKLMKEKTCAGLSLKTQDLTALFLAVRLYCSFVMEYDIHTLLDLATLATTLWVIFMIRFKLKSSYMEDKDNFAMYYVAVPCAILALLIHPSTSHHIVNRIFWAFCVYLEAVSVLPQLRVMQNTKIVEPFTAHYVFALGVARFLSCAHWVLQVLDSRGHLLTALGYGLWPSMVLISEIVQTFILADFCYYYIKSVFGGQLVLRLPSGVV

SEQ ID NO: 17232 - protein, 272 aa, Trigonella foenum-graecum
MRPQRTSIHAISTWVRRQPPKVKAFLAVVSGMAALVLLRFIVHDHDNLFVAAEAVHSLGISVLIYKLMKEKTCAGLSLKSQELTAIFLAVRLYCSFVMEYDIHTILDLATFVTTVWVIYMIRFKLKASYMEEKDNFAIYYVLIPCAVLALLIHPSTSHHILNRIFWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17233 - protein, 272 aa, Vicia sativa
MRPQKTSIHAISTWVRRQPPKVKAFLAVVSGMAALVLLRFIVHDHDNLFVAAEAVHSLGISVLIYKLMKEKTCAGLSLKSQELTAMFLAVRLYCSFVMEYDIHTILDLATFVTTVWVIYMIRFKLKASYMEEKDNFAIYYVVLPCAVLALVIHPSTSHHIFNRIFWAFCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17234 - protein, 272 aa, Rosmarinus officinalis
MKAPRRPIQAAATWLRRQPPKVKAFLAVISGMAALVLLRAIVHDHDNLFVAAEAVHSMGIAVLIYKLMKEKTCAGLSLKSQELTAIFLAVRLYCSFVMEYDIHTLLDLATLATTLWVVYMIRFKLRSSYMEDKDNIPIYYVVVPCAVIALIVHPSTSHHVVNRIAWALCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17235 - protein, 272 aa, Glycine max
MRSGKKSIHAITTWVRRQPPKVKAFLAVVSGMAALVLLRFIVHDHDNLFVAAEAVHSLGISVLIYKLIKEKTCAGLSLKSQELTAIFLAVRLYCSFVMEYDIHTLLDLATFATTLWVIYMIRFKLKSSYMEEKDNFAIYYVVIPCAVLALFIHPSTSHHLLNRISWAFCVYLEAVSVLPQLRVMQNTQIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17236 - protein, 272 aa, Glycine max
MRPQRTSIHAVTTWVRRQPPKVKAFLAVVSGMAALVLLRFIVHDHDNLFVAAEAVHSLGISVLIYKLMKERTCAGLSLKSQELTAIFLAVRLYCSFVMEYDIHTLLDFATFVTTLWVIYMIRFKLKASYMEEKDNFAIYYVVVPCAVLALLIHPSTSHHLLNRISWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17237 - protein, 272 aa, Spinacia oleracea
MRPQRRTIHTIMAWLRRQPPKVKAFLAVVTGMAALVLLRAVVRDHDNLFVAAEAVHVIGIAVLIYKLTKEKTCAGLSLKSQELTAIFLAVRLYCSFVMEYDIHTLLDSATLVFTLWVIYMIRFNLRSTYMEEKDNFALYYVLLPCAILACAVHPSTSHNILNRTLWAFCVYLEAASVLPQLRVMQNTKIVEPFTAHYVFALGVARFLSCAHWVLQVLDSRGHLLTALGYGLWPSFVLISEIVQTFILADFCYYYVQSIFGGQLVLRLPSGVV

SEQ ID NO: 17238 - protein, 273 aa, Arabidopsis lyrata
MKATAKTPIHVVWSWVRRQPPKVKAFLAVVTGMAALVLLRFIVHDHDNLFVAAEAVHSIGICVLIYKLMKEKTCAGLSLKSQELTAIFLAVRLYCSFVMEYDIHTILDLATLGTTLWVIFMIRFKLRASYMEDKDNFPLYYVLLPCVVLAVFIHPSTSHHILNRISWALCVYLEAVSVLPQLRVMQNTKIVEPFTAHYVFALGVARFLSCAHWVLQVVDTRGRLLVALGYGLWPSMVLISEIVQTFILADFCYYYVKSVFGGQLVLRLPSGVV

SEQ ID NO: 17239 - protein, 272 aa, Cichorium intybus
MRPPKRTIHVISSWVRRQPPKVKAFLAVVTGMLALVLLRVIVHDHDNLFVAAEAVHSIGISVLIYKLMKEKTCAGLSLKTQELTALFLAVRLYCSFVMEYDIHTLLDLATLATTLWVIFMIRFKLKSSYMEDKDNFAMYYVAVPCVILALLIHPSTSHHIVNRIFWAFCVYLEAVSVLPQLRVMQNTKIVEPFTAHYVFALGVARFLSCAHWVLQVLDSRGHLLTALGYGLWPSMVLISEIVQTFILADFCYYYMKSVFGGQLVLRLPSGVV

SEQ ID NO: 17240 - protein, 272 aa, Cirsium arvense
MRPPRKTIHVISSWIRRQPPKVKAFLAVVTGMVALVLLRAIVHDHDNLFIAAEAVHSIGIAVLIYKLSKEKTCAGISLKSQELTAMFLAVRLYCSVVMEYDIHTLLDLSTLAATLWVIFMIRFRLKSSYMEDKDNFAMYYVVVPCAVLALLVHPSTSHHIMNRIFWAFCVYLEAVSVLPQLRVMQNTKIVEPFTAHYVFALGVARFLSCAHWVLQVLDSRGHLLTALGYGLWPSMVLISEIVQTFILADFCYYYVKSVFGGQLVLRLPSGVV

SEQ ID NO: 17241 - protein, 273 aa, Fagopyrum esculentum
MKGGKKRPLQAVAMWVRRQPPKVKAFLSVVAGMAALVFIRMIVHDHDNLFVAAEAVHSVGVCVLIYKLSKEKTCAGLSLKTQELTALFLTVRLYCSVVMEYDIHTILDTATLVTTLWVIFMIRFKLRSTYMEDKDNFAMYFMVIPCVALSLLIHPTTTHILVNRILWAFCVYLEAISVLPQLRVMQNTKIVEPFTAHYVFALGVARFLSCAHWVLQVLDTRGSLLTALGYGLWPSMVLLSEIVQTFILADFCYYYVKSIFGGQLVLRLPSGVV

SEQ ID NO: 17242 - protein, 272 aa, Vitis vinifera
MRPPRRPIHTVSAWVRRQPPKVKAFLAVVSGMAALALLRIVVHDHDNLFVAAEAVHSIGICVLIYKLMKEKTCAGLSLKSQELTAIFLAVRLYCSFVMEYDIHTLLDSATLGTTLWVIYMIRFRLKSSYMEDKDNFAIYYVVGPCALLALVIHPSTSHHFVNRIFWAFCVYLEAVSVLPQLRVMQNTKIVEPFTAHYVFALGVARFLSCAHWVLQVLDTRGHLLVALGYGLWPSMVLISEIVQTFILADFCYYYIKSVVGGQLVLRLPSGVV

SEQ ID NO: 17243 - protein, 272 aa, Humulus lupulus
MKAPKRPIHAVSTWVRRQPPKVKAFLAVISGMTALVLLRFIVHDHDNLFVAAEAVHSIGISVLIYKLMKEKTCAGLSLKSQELTAIFLAVRLYCSFVMEYDIHTLLDLATLGTTLWVIFMIRFKLKSSYMEDKDNFAIYYVVVPCAVLALLIHPSTSHHLLNRIFWAFCVYLEAVSVLPQLRVMQNTKIVEPFTAHYVFALGIARFLSCAHWVLQVLDTRGQLLVALGYGLWPSMVLISEIVQTFILADFCYYYVKSVFGGQLVLRLPSGVV

SEQ ID NO: 17244 - protein, 272 aa, Ipomoea nil
MKMPRRPIQAVTTWVKRQPPKVKAFLAVITGMAALVMLRAIVHDHDNLFVAAEAVHSIGICVLIYKLMKEKTCAGLSLKSQELTAMFLAVRLYCSFVMEYDIHTLLDMATLATTLWVIYMIRFNLKSSYMEDKDNFAMYYVVVPCAVLAFLIHPTTSHHIVNRIFWAFCVYLEAVSVLPQLRVMQNTKIVEPFTAHYVFALGVARFLSCAHWVLQVLDSRGHLLVALGHGLWPSMVLISEIVQTFILADFCYYYVKSVFGGQLVLRLPSGVV

SEQ ID NO: 17245 - protein, 272 aa, Cucumis melo
MKATKRPIQAVATWVRRQPPKIKAFLAVVSGMAALVFLRFVVHDHDNLFVAAEAVHAIGISVLIYKLMKERTCAGLSLKSQELTALFLAVRLYCSFVMEYDIHTLLDTATLVTTLWVIYMIRFKLRSSYMEDKDNFPIYYVAVPCALLSFVIHPTTVHNIINRIAWAFCVYLEAVSVLPQLRVMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17246 - protein, 272 aa, Momordica charantia
MKATKRPIQAVATWVRRQPPKIKAFLAVVSGMAALVFLRFVVHDHDNLFVAAEAVHAIGISVLIYKLMKERTCAGLSLKSQELTAIFLAVRLYCSFVMEYDIHTLLDSATLVTTLWVIYMIRFKLRSSYMDDKDNFPIYYVVIPCAILSLVIHPTTVHNIINRIAWAFCVYLEAVSVLPQLRVMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17247 - protein, 272 aa, Nicotiana benthamiana
MRTTRRPIHAVSTWVRRQPPKVKAFLAVITGMAALVLLRAIVHDHDNLFVAAEAVHSIGISVLIYKLMKEKTCAGLSLKSQELTAMFLAVRLYCSFVMEYDIHTLLDLATLATTLWVIYMIRFKLKSSYMEDKDNFLIYYVVIPCAALALLIHPSTSHLFVNRVFWAFCVYLEAVSVLPQLRVMQNTKIVEPFTAHYVFALGVARFLSCAHWVLQVLDSRGHLLVALGHGLWPSMVLISEIVQTFILADFCYYYVKSVFGGQLVMRLPSGVV

SEQ ID NO: 17248 - protein, 272 aa, Nicotiana benthamiana
MKAPRRPIHAMSTWVRRQPPKVKAFLAVVAGMAALVLLRAIVHDHDNLFVAAEAVHAIGISVLIYKLMKEKTCAGLSLKSQELTAMFLAVRLYCSFVMEYDIHTLLDLATLATTLWVIYMIRFKLKSSYMEDKDNCAIYYVAIPCAALALLIHPSTSHHFINRIFWAFCVYLEAVSVLPQLRVMQNIKIVEPFTAHYVFALGIARFLSCAHWVLQVLDSRGHLLVALGHGLWPSMVLLSEIVQTFILADFCYYYVKSVFGGQLVLRLPSGVV

SEQ ID NO: 17249 - protein, 272 aa, Cajanus cajan
MRPQRASIHHLTTWVRRQPPKVKAFLAVVSGMAALVLLRFIVHDHDNLFVAAEAVHSLGISVLIYKLMKEKTCAGLSLKSQELTAIFLAVRLYCSFVMEYDIHTVLDLSTFITTLWVIYMIRFKLKASYMEEKDNFAIYYVVVPCAVLALLIHPSTSHHIINRIFWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17250 - protein, 273 aa, Primula obconica
MRPGRKNPIHSVSMWVRRQPPKVKAFLAVVAGMAALVLLRVIVHDHDNLFVAAEAVHSIGICVLIYKLMKEKTCAGLSLKTQELTAIFLAVRLYCSYVMEYDIHTLLDLSTLAATLWVIYMIRFKLKSSYMEDKDNLPIYYVLAPCAVLAFLIHPSTSHHFINRIFWSFCVYLEAVSVLPQLRVMQNTKIVEPFTAHYVFALGVARFLSCAHWVLQVLDTRGRLLTALGYGLWPSMVLLSEIVQTFILADFCYYYVKSVFGGQLVLRLPSGVV

SEQ ID NO: 17251 - protein, 272 aa, Carthamus tinctorius
MRPPKKTIHVISSWIRRQPPKVKAFLAVVAGMLALVLLRAIVHDHDNLFIAAEAVHSIGIAVLIYKLSKEKTCAGISLKSQELTAMFLAVRLYCSVVMEYDIHTLLDLSTLAATLWVIYMIRFRLKSSYMEDKDNFAMYYVAVPCAVLALLVHPSTSHHIMNRIFWAFCVYLEAVSVLPQLRVMQNTKIVEPFTAHYVFALGVARFLSCAHWVLQVLDSRGHLLTALGYGLWPSMVLISEIVQTFILADFCYYYVKSVFGGQLVLRLPSGVV

SEQ ID NO: 17252 - protein, 272 aa, Triphysaria pusilla
MKAPRRPIQAVTSWVRRQPPKVKAFLAVVSGMAALVLLRAVVHDHDNLFVAAEAVHSIGIGVLIYKLIKERTCAGLSLKSQELTAIFLAVRLYCSFVMEYDIHTLLDMTTLATTLWVIYMIRFKLKSSYMEDKDNIPLYYVVIPCAVIALLIHPSTSHHIINRIAWAFCVYLEAVSVLPQLRVMQNTKIVEPFTAHYVFALGVARFFSCAHWILQVLDTRGHLLVALGYGLWPSMVLLSEIVQTFILADFCYYYVKSVFGGQLVLRLPSGVV

SEQ ID NO: 17253 - protein, 272 aa, Rosmarinus officinalis
MKAPRRPIQAAATWLRRQPPKVKAFLAVISGMAALVLLRAIVHDHDNLFVAAEAVHSMGIAVLIYKLMKEKTCAGLSLKSQELTAIFLAVRLYCSFIMEYDIHTLLDLATLATTLWVVYMIRFKLRSSYMEDKDNIPIYYVVVPCAVIALIVHPSTSHHVVNRIAWALCVYLEAVSVLPQLRVMQNTKIVEPFTAHYVFALGVARFLSCAHWVLQVLDTRGHLLVALGYGLWPSMVLISEIVQTFILADFCYYYVKSVFGGQLVLRLPSGVV

SEQ ID NO: 17254 - protein, 272 aa, Glycine max
MRSGRKSIHAITTWVRRQPPKVKAFLAVVSGMAALVLLRFIVHDHDNLFVTAEAVHSLGISVLIYKLIKEKTCAGLSLKSQELTAIFLSVRLYCSFVMEYDIHTLLDLATLVTTLWVIYMIRFKLKSSYMEDKDNFAIYYVMIPCAVLALFIHPSTSHHLLNRIAWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQFVLRLPSGVV

SEQ ID NO: 17255 - protein, 272 aa, Glycine max
MRPQRTSIHAVTTWVRRQPPKVKAFLAVVSGMAALVLLRFIVHDHDNLFVAAEAVHSLGISVLIYKLMKEKTCAGLSLKSQELTAIFLAVRLYCSFVMEYDIHTLLDFATFVTTVWVIYMIRFKLKASYMEEKDNFAIYYVVAPCAMLALLIHPSTSHHLLNRISWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17256 - protein, 272 aa, Acacia harpophylla
MRPQKNPIHTISTWVRRQPPKVKAFLAVVTGMAALVLLRVIVHDHDNLFVAAEAVHSLGISVLIYKLMKEKTCAGLSLKSQELTAIFLAVRLYCSFVMEFDIHTLLDLATLATTLWVIFMIRFKLKSSYMEEKDNFAIYYVVIPCAVIALLIHPSTSHHILNRIFWAFCVYLEAVSVLPQLRVMQNTKIVEPFTAHYVFALGVARFLSCAHWVLQVLDSRGHLLVALGYGLWPSMVLISEIVQTFILADFCYYYVKSVLGGQLVLRLPSGVV

SEQ ID NO: 17257 - protein, 269 aa, Brassica napus
  Sequence also found in Organisms: Brassica oleracea
MKSPIHTVWSWVRRQPPKVKAFLAVVTGMAALVLLRFIVHDHDNLFVAAEAVHSIGICVLIYKLMKEKTCAGLSLKSQELTAIFLAVRLYCSFVMEYDIHTVLDLATLGTTLWVIFMIRFKLRASYMEDKDNFALYYVLVPCVVLAVLIHPSTSHNILNRISWALCVYLEAVSVLPQLRVMQNTKIVEPFTAHYVFALGVARFLSCAHWVLQVVDTRGRLLVALGYGLWPSMVLISEIVQTFILADFCYYYVKSVFGGQLVLRLPSGVV

SEQ ID NO: 17258 - protein, 272 aa, Centaurea maculosa
MRPPRKTIHVISSWIRRQPPKVKAFLAVVAGMLALVLLRTIVHDHDNLFIAAEAVHSIGIAVLIYKLSKEKTCAGISLKSQELTAMFLAVRLYCSVVMEYDIHTLLDLSTLAATSWVIYMILFRLKSSYMEDKDNFAMSYVVVPCAVLALLVHPSTSHHIVNRIFWAYCVYLEAVSVLPQLRVMQNTKIVEPFTAHYVFALGVARFLSCAHWVLQVLDSRGHLLTALGYGLWPSMVLISEIVQTFILADFCYYYVKSVFGGQLVLRLPSGVV

SEQ ID NO: 17259 - protein, 272 aa, Cucumis sativus
MKATKRPIQAVATWVRRQPPKIKAFLAVVSGMAALVFLRFVVHDHDNLFVAAEAVHAIGISVLIYKLMKERTCAGLSLKSQELTAIFLAVRLYCSFVMEYDIHTLLDTATLVTTLWVIYMIRFKLRSSYMEDKDNFPIYYVAVPCALLSFVIHPTTVHNIINRIAWAFCVYLEAVSVLPQLRVMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17260 - protein, 272 aa, Lupinus angustifolius
MRGERNTIHVISSWVRRQPPKVKAFLAVVSGMAALVLLRFIVHDHDNLFVAAEAVHSIGISLLIYKLMKEKTCAGLSLKSQELTAMFLAVRLYCSFVMEYDIHTLLDLATLATTLWVIYMISFNLKSSYMEEKDNFAIYYVVIPCAVLALFIHPSTSHHLLNRIFWAFCVYLEAVSVLPQLRVMQNTQIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17261 - protein, 272 aa, Nicotiana benthamiana
MRTTRRPIHAVATWVRRQPPKVKAFLAVITGMAALVLLRAIVHDHDNLFVAAEAVHSIGISVLIYKLMNEKTCAGLSLKSQELTAMFLAVRLYCSFVMEYDIHTLLDLATLATTLWVIYMIRFKLKSSYMEDKDNFLIYYVVIPCAALALLIHPSTSHLFVNRVFWAFCVYLEAVSVLPQLRVMQNTKIVEPFTAHYVFALGVARFLSCAHWVLQVLDSRGHLLVALGHGLWPSMVLISEIVQTFILADFCYYYVKSVFGGQLVMRLPSGVV

SEQ ID NO: 17262 - protein, 272 aa, Nicotiana benthamiana
MKAPRRPIHAVSTWVRRQPPKVKAFLAVVAGMAALVLLRAIVHDHDNLFVAAEAVHAIGISVLIYKLMKEKTCAGLSLKSQELTAMFLAVRLYCSFVMEYDIHTLLDLATLATTLWVIYMIRFNLKSSYMEDKDNCAIYYVAIPCAALALLIHPSTSHHFINRIFWAFCVYLEAVSVLPQLRVMQNTKIVEPFTAHYVFALGIARFLSCAHWVLQVLDSRGHLLVALGHGLWPSMVLISEIVQTFILADFCYYYVKSVFGGQLVLCLPSGVV

SEQ ID NO: 17263 - protein, 272 aa, Lippia dulcis
MKPPKRPIQAVTTWVRRQPPKVKAFLAVISGMAALVLLRAIVHDHDNLFVAAEAVHSIGISVLIYKLMKERTCAGLSLKSQELTAIFLAVRLYCSFVMEYDIHTLLDMATLATTLWVIYMIRFKLKSSYMEDKDNFALYYVLGPCAVLAFVIHPSTSHHMINRISWAFCVYLEAVSVLPQLRVMQNTKIVEPFTAHYVFALGVARFLSCAHWVLQVLDSRGQLLVALGYGLWPSMVLISEIVQTFILADFCYYYVKSVFGGQLVLRLPSGVV

SEQ ID NO: 17264 - protein, 272 aa, Triphysaria pusilla
MRPPKRPIQAVFSWVRRQPPKVKAFIAVISGMAALVILRAIVHDHDNLFVAAEAVHSIGILVLIYKLMKERTCAGLSLKSQELTAIFLAVRLYCSFVMEYDIHTLLDLATLVTTMWVIYTIRFKLNSSYMADKDNLALYYVAAPCAVLALLIHPSTSHHIVNRIAWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17265 - protein, 272 aa, Triphysaria pusilla
MRPPKRPIQAVFSWVRRQPPKVKAFIAVISGMAALVILRAVVHDHDNLFVAAEAVHSIGILVLIYKLMKERTCAGLSLKSQELTAIFLAVRLYCSFVMEYDIHTLLDLATLVTTLWVIYTIRFKLNSSYMADKDNLALYYVAAPCAVLALLIHPSTSHHIVNRIAWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17266 - protein, 272 aa, Citrullus lanatus
MKATRRPIQAVATWVRRQPPKIKAFLAVVSGMAALVFLRFVVHDHDNLFVAAEAVHAIGISVLIYKLMKERTCAGLSLKSQELTAIFLAVRLYCSFVMEHDIHTLLDTATLVTTLWVIYMIRFKLRSSYMDDKDNFPIYYVVIPCALISFVIHPTTVHNIINRIAWAFCVYLEAVSVLPQLRVMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17267 - protein, 273 aa, Arabidopsis thaliana
MKATTKTPIHVVWSWVRRQPPKVKAFLAVVTGMAALVLLRFIVHDHDNLFVAAEAVHSIGICVLIYKLMKEKTCAGLSLKSQELTAIFLAVRLYCSIVMEYDIHTILDLATLGTTLWVIFMIRFKLRASYMEDKDNFPLYYVLAPCVALAVFIHPSTSHNIINRISWALCVYLEAVSVLPQLRVMQNTKIVEPFTAHYVFALGVARFLSCAHWVLQVVDTRGRLLVALGYGLWPSMVLISEIVQTFILADFCYYYVKSVFGGQLVLRLPSGVV

SEQ ID NO: 17268 - protein, 269 aa, Brassica napus
  Sequence also found in Organisms: Brassica rapa
MKSPIHTVWSWVRRQPPKVKAFLAVITGMAALVLLRFIVHDHDNLFVAAEAVHSIGICVLIYKLMKEKTCAGLSLKSQELTAIFLAVRLYCSFVMEYDIHTVLDLATLGTTLWVIFMIRFKLRASYMEDKDNFALYYVLVPCVVLAVLIHPSTSHNILNRISWALCVYLEAVSVLPQLRVMQNTKIVEPFTAHYVFALGVARFLSCAHWVLQVVDTRGRLLVALGYGLWPSMVLISEIVQTFILADFCYYYVKSVFGGQLVLRLPSGVV

SEQ ID NO: 17269 - protein, 272 aa, Ricinus communis
MKGTKRPIHAVATWVRRQPPKAKAILAVVSGMAALVFLRMVVHDHDNLFVAAEAVHAVGISVLIYKLMKEKTCAGLSLKSQELTAIFLAARLYCSFVMEYDIHTLLDSATLLTTLWVIYTIRFKLRSSYMDDKDNFAIYYVLIPCAVLSLIIHPTTQHHIFNRICWAFCVYLEAVSVLPQLRVMQNTKIVEPFTAHYVFALGVARFLSCAHWVLQVLDTRGRLLTALGYGLWPPMVLLSEIVQTFILADFCYYYVKSLVGGQLVLRLPSGVV

SEQ ID NO: 17270 - protein, 272 aa, Chelidonium majus
MRAPKRPIHAVATWVKRQPPKVKALLAVVSGMAALVFLRFIVNDHDNLFIAAEAVHSIGVSVLIYKLMKEKTCAGLSLKSQELTAIFLAVRLYCSFVMEYDIHTLLDSATLGTTLWVIYMIRFKLKSSYMEDKDNFAIYYVLIPCVILALVIHPSTAHNILNRIFWALCVYLEAVSVLPQLRVMQNTKIVEPFTAHYVFALGVARFLSCAHWVLQVLDTRGRLLTALGYGLWPSMVLLSEIVQTFILADFCYYYVKSVVGGQLVLRLPSGVV

SEQ ID NO: 17271 - protein, 272 aa, Eucalyptus grandis
MSLQKRPIHAVATWVRRQPPKVKAFLAVVSGMAALVLLRFVVHDHDNLFVAAEAVHSIGIGVLIYKLMKEKTCAGLSLKSQELTAIFLAVRLYCSFVMEYDIHTILDLSTLAATLWVMYMIRFKLKSSYMEDKDNFANYYVLIPCAVLALFIHPSTSHNLVNRISWAFAVYLEAASVLPQLRVMQNTKIVEPFTAHYVFALGVARFLACAHWVLQVLDSRGHLLVALGYGLWPSMVLISEIVQTFILADFCYYYVKSVLGGQLVLRLPSGVV

SEQ ID NO: 17272 - protein, 269 aa, Fagopyrum esculentum
MKGGKRPIHVLTSWIRRQPSKVKAFLAVVAGMATLVFLRMIVHDHDNLFVAAEAVHAIGISVLIYKLTKEKTCAGLSLKTQELTAMFLAVRLYCSFVMEYDIHTVLDTATLATTLWVIYMIRFKLKTTYMESKDNFKTYYVAIPCVVLSLLIHPTTSHNIVNRISWAFCVYLEAVSVLPQLRVMQNTKIVEPFTAHYVFALGVARFLSCAHWVLQVLDTRGHLLTALGFGLWPSMVLLSEIVQTFILADFCYYYVMSVVGGHLVLRLPS

SEQ ID NO: 17273 - protein, 272 aa, Flaveria ramosissima
MRPPKRTIHIISSWVRRQPPKVKAFLAVVTGMLALVLLRVIVHDHDNLFVAAEAVHSIGISVLIYKLMKEKTCAGLSLKAQELTAMFLAVRLYCSFVMEYDIHTLLDLATLVTTLWVIFMIRFKLKSSYMEDKDNFPTYYVAVPCAVLALLIHPSTSHHIINRIFWAFCVYLEAVSVLPQLRVMQNTKIVEPFTAHYVFALGVARFLSCAHWVLQVLDSRGHLLTALGYGLWPSMVLISEIVQTFILADFCYYYVKSVFGGQLVLRLPSGVV

SEQ ID NO: 17274 - protein, 273 aa, Lotus japonicus
MTGDKKKPIHAITTWVRRQPPKVKAFLAVVSGMAALVVLRFIVHDHDNLFVAAEAVHSLGISLLIYKLIKEKTCAGLSLKSQELTAMFLAVRLYCSFVMEYDIHTLLDLSTLATTLWVIYMIRFNLKSSYMEEKDNFAIYYVVAPCAVLALFIHPSTSHHLLNRIFWAFCVYLEAVSVLPQLRVMQNTQIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17275 - protein, 261 aa, Olea europaea
STWVRRQPPKVKAFLAVVSGMAALVLLRVIVHDHDNLFVAGEAVHSIGISVLIYKLMKEKTCAGLSLKSQELTALFLAVRLYCSFVMEYDIHTLLDLSTLATTLWVMYMIRFKLRSSYMEDKDNFAWYYVVVPCAGLALLIHPSTSHHFVNRIAWAFCVYLEAVSVLPQLRVMQNTKIVEPFTAHYVFALGVARFLSCAHWVLQVLDSRGHLLVALGYGLWPSMVLISEIVQTFILADFCYYYVKSVFGGQLVLRLPSGVV

SEQ ID NO: 17276 - protein, 272 aa, Carica papaya
MKATKRPIHAVATWVRRQPPKIKAFLAVVSGMAALVFLRMVVHDHDNLFVAAEAVHALGISVLIYKLMKEKTCAGLSLKSQELTAIFLAVRLYCSFVMEYDMHTLLDSATLVTTLWVIYMIRFKLRSSYMEDKDNFAIYYVVIPCALLSLLIHPTTQHNIINRISWAFCVYLEAVSVLPQLRVMQNTKIVEPFTAHYVFALGIARFLSCAHWVLQVLDTRGRLLTALGHGLWPSMVLFSEIVQTFILADFCYYYVKSIMGGQLILRLPSGVV

SEQ ID NO: 17277 - protein, 272 aa, Petroselinum crispum
MRAPKRPIYMITTWVKRQPPKVKAFLAVVAGMAALVLLRAIVHDHDNLFVAAESVHAVGISVLIYKLIKEKTCAGLSLKSQELTALFLAVRLYCSLVMEYDIHTVLDSATLATTLWVIYMIRYKLRSSYMEEKDNFTIYHVVIPCAVLAILVHPSTSHNFLNRISWGFCVYLESVSVLPQLRVMQNTKIVEPFTAHYVFALGVARFLSCAHWVLQVLDTRGHLLVALGYGLWPSMVLIAEVVQTFILADFCYYYVKSVFGGQLVLRLPSGVV

SEQ ID NO: 17278 - protein, 268 aa, Raphanus sativus
KSPIQAVWSWVRRQPPKVKAFLAVVSGMAALVLLRFIVHDHDNLFVAAEAVHSIGICVLIYKLMKEKTCAGLSLKSQELTAIFLAVRLYCSFVMEYDIHTVLDLATLGTTLWVIFMIRFKLKASYMEDKDNFALYYVLVPCVVLAVLIHPSTSHNILNRISWALCVYLEAVSVLPQLRVMQNTKIVEPFTAHYVFALGVARFLSCAHWVLQVVDTRGRLLVALGYGLWPSMVLISEIVQTFILADFCYYYVKSVFGGQLVLRLPSGVV

SEQ ID NO: 17279 - protein, 272 aa, Fragaria vesca
MRAPKTPINTVSTWVRRQPPKVKGFLAVVAGMAALVLLRFVVHDHDNLFVAAEAVHSGGILVLIYKLMKEKTCAGLSLKSQELTAMFLAVRLYCSVVMEYDIHTLLDLATLVTTLWVIYMIRFNLKSSYMEDKDNFAIYYVVAPCALLALFIHPSTSHHLLNRISWAFCVYLEAVSVLPQLRVMQNTKIVEPFTAHYVFALGIARFLSCAHWVLQVLDTRGHLLVALGYGLWPSMVLISEIVQTFILADFCYYYVKSVFGGQLVLRLPSGVV

SEQ ID NO: 17280 - protein, 272 aa, Helianthus annuus
MRPPKKTIHIISSWVQRQPPKVKAFLAVVAGMLALVLLRAIVHDHDNLFVAAEAVHSIGISVLIYKLIKEKTCAGLSLKTQELTAMFLAVRLYCSFVMEYDIHTLLDLATLATTLWVIFMIRFKLKSSYMEDKDNFAMYYVVAPCAVLALLIHPSTSHYIINRIFWAFCVYLEAVSVLPQLRVMQNTKIVEPFTAHYVFALGVARFLSCAHWVLQVLDSRGHLLTALGYGLWPSMVLISEVVQTFILADFCYYYVKSVFGGQLVMRLPSGVV

SEQ ID NO: 17281 - protein, 272 aa, Ambrosia trifida
MRPPKKTIQVVSTWVRRQPPKVKAFLAVVTGMLALVLLRAIVHDHDNLFVAAEAVHSIGISLLIYKLMKEKTCAGLSLKAQELTAIFLAVRLYCSLVMEYDIHTLLDLATLVTTLWVIFMIRFKLKSSYMEDKDNFATYYVAVPCAVLALVIHPSTSHHIINRIFWAFCVYLEAVSVLPQLRVMQNTKIVEPFTAHYVFALGVARFLSCAHWVLQVLDSRGHLLTALGYGLWPSMVLISEIVQTFILADFCYYYVKSVFGGQLVLRLPSGVV

SEQ ID NO: 17282 - protein, 272 aa, Malus domestica
MRAPKRPIHTVWTWARRQPSKVQAFLAVVSGMAALVLLRFIVHDHDNLFVAAEAVHSIGISVLIYKLMKEKTCAGLSLKSQELTAMFLAVRLYCSVVMEYDIHTLLDLATLVTTLWVIYMIRFNLKSSYMEDKDNFAIYYVVVPCALLALFIHPSTSHHLLNRISWAFCVYLEAVSVLPQLRVMQNTKIVEPFTAHYVFALGVARFLSCAHWVLQVLDTRGQLLVALGYGLWPSMVLISEIVQTFILADFCYYYIKSVFGGQLVLRLPSGVV

SEQ ID NO: 17283 - protein, 272 aa, Arnica chamissonis
MRPPKRTIHMISSWVRRQPPKVKAFLAVVTGMLALVLLRTIVHDHDNLFVAAEAVHSIGISVLIYKLMKEKTCAGLSLKAQELTAMFLAVRLYCSFVMEYDIHTLLDLATLVTTLWVIFMIRFKLKSSYMEDKDNFATYYVAVPCAALALLIHPSTSHHIINRIFWAFCVYLEAVSVLPQLRVMQNTKIVEPFTAHYVFALGVARFLSCAHWVLQVLDSRGHLLTALGYGLWPSMVLISEIVQTFILADFCYYYVKSVVGGQLVLRLPSGVV

SEQ ID NO: 17284 - protein, 272 aa, Cucumis sativus
MRPARNPIHIASVWVRRQPPKVKAFMAVVLGMLTLVVLRFIVHDHDNLFVAAEALHSIGILVLIYKLTKERTCAGLSLKSQELTAIFLAVRLYCSFVMEFDIHTLLDLATLATTLWVIYMIRFKLKSSYMEDKDNFALYYVIAPCAVLALLIHPSTSHHFVNRVFWAFCVYLEAVSVLPQLRVMQNTKIVEPFTAHYVFALGIARFLSCAHWVLQVLDSRGHLLVALGYGLWPSMVLISEIVQTFILADFCYYYVKSVLGGQLVIRLPSGVV

SEQ ID NO: 17285 - protein, 272 aa, Panax ginseng
MRPPKRPIHAVSTWVRRQPPKVKAFLAVVAGMAALVLLRAIVHDHDNLFVAAEAVHSIGISVLIYKLMKEKTCVGLSLKTQELTAMFLAVRLYCSFVMEYDIHTLLDLATLGTTLWVIYMIRFKLRSSYMEDKDNFAIYYVVVPCAVFALLIHPSTSHHFINRIFWAFCVYLESVSVLPQLRVMQNTKIVEPFTSHYVFALGVSRFLSCAHWVLQVLDTSGHLLTALGHGLWPSMVLISEVVQTFILADFCYYYIKSVFGGQLVLRLPSGVV

SEQ ID NO: 17286 - protein, 272 aa, Panax ginseng
MRPPRRPINAVLTWAKRQPPKVKAFIAVVSGMISLVLLRIIVNDHDNLFVAAEIVHFIGISVLIYKLMKEKTCAGLSLKSQELTALFLAVRLYCSFVMEYDIHTLIDLATLGTTLWVIYMIRFKLRSSYMEDKDNFAIYYVVVPCAVLALLIHPSTSHNLINRIFWGFCVYLESVSVLPQLRVMQNTKIVEPFTSHYVFALGVARFLSCAHWVLQVLDTRGHLLTALGYGLWPSMVLISEIVQTFILADFCYYYVKSVIGGQLVLRLPSGVV

SEQ ID NO: 17287 - protein, 272 aa, Quercus alba
MKGAKTPIHSVAMWVRRQPPKVKAFLAVVSGIAALVFLRLVVHDHDNLFVAAEAVHALGIAVLIFKLTKEKTCAGLSLKSQELTAIFLAVRLYCSFVMEFDIHTLLDSATLVTTLWVIYMIRFTLKSSYMDDKDNFKSYYVLLPCAVLSLLIHPTTQHYIINRILWAFCVYLEAVSVLPQLRVMQNTKIVEPFTAHYVFALGVARFLSCAHWILQVLDTHGRLLTTLGYGLWPSMVLLSEIVQTFILADFCYYYVKSLVGGQLVLRLPSGVV

SEQ ID NO: 17288 - protein, 272 aa, Arachis hypogaea
MRGQRMSIHSMTTWLKRQPPKVKAFLAVISGMAALVLLRFIVHDHDNLFVAAEAVHSLGISVLIYKLIKEKTCAGLSLKSQELTAIFLAVRLYCSFVMEYDIHTLLDFATFVTTMWVIYMIRFKLKASYMEEKDNFAIYYVVIPCAVLALLIHPSTSHHLLNRIFWAFCVYLEAVSVLPQLRVMQNTKIVEPFTAHYVFALGVARFLSCAHWVLQVLDTRGHLLVALGYGLWPPMVLISEIVQTFILADFCYYYVKSVFGGQLVLRLPSGVV

SEQ ID NO: 17289 - protein, 272 aa, Populus trichocarpa
MKATKRPVQAVATWVRRQPPKIKVFLAVVSGLAALVFLRMVVHDHDNLFVAAEAVHSIGISVLIYKLMKEKTCAGLSLKSQDLTAIFLAARLYCSFVMEYDIHTLLDSATLLTTLWVIYMIRFNLRSSYMEDKDNFAIYYLVIPCALLALIIHPTTHHNIFNRISWAFCVYLESISVLPQLRVMQNTKIVEPFTAHYVFALGVARFLSCAHWVLQVLDTRGRLLTALGYGLWPSMVLLSEIVQTFILADFCYYYVKSVLGGQLVLRLPSGVV

SEQ ID NO: 17290 - protein, 272 aa, Glycine max
MKGSKRPIHAVTTWVRRQPPKIKAFLAVLSALAALLFLRIVVHDHDSLFVAAEFVHALGISVLIYKLTKEKTCAGLSLKSQELTAMFLGVRLYCSFVMEYDIHTLLDMATLATTLWVIYMIRFKLKSSYMDDKDNLAIYYVVIPCAVLSLLIHPTTRHHPLNRILWAFCVYLEAVSVLPQLRVMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17291 - protein, 272 aa, Fragaria vesca
MKGGKGATHAVATWVRRQPPKIKAFLAVVSGMSALVLLRMIVHDHDNLFVAAEAVHSLGISVLIYKLMKEKTCAGISLKSQELTALFLAVRLYCSLVMEYDIHTILDSATLVTTLWVIYMIRFKLRSSYMDDKDNFAIYYVVIPCALLSLAVHPTTHHFIVNRIGWAFCVYLEAVSVLPQLRLMQNTKIVEPFTAHYVFALGVARFLSCAHWVLQVMDTRGQLLTTLGYGFWPCMVLLSEIVQTFILADFCYYYVKSAVDGQLVLRLPSGVV

SEQ ID NO: 17292 - protein, 277 aa, Amborella trichopoda
MMGSGRAMRKNPVHVVATWVKRQPPKVKAFLAVVAGMGLLVFLRLVVHDHDNLFVAAEASHAIGISVLIYKLIKEKTCAGLSLKSQELTALFLAVRLYCSFVMEFDLHTLLDSATLITTLWVIYMIRFKLRSSYMEDKDNFPIYYVVVPCALLALFIRPTTSHNIVNRILWAFCVYLEAVSVLPQLRVMQNVKIVEPFTAHYVFALGVARFLSCAHWVLQVLDSRGYLLTALGHGLWPSMVLLSEIVQTFILADFCYYYVQSVLGGHLVLRLPSGVV

SEQ ID NO: 17293 - protein, 272 aa, Conyza canadensis
MRPPKRTIHIISSWVRRQPPKVKAFLAVVSGMLALVLLRVIVHDHDNLFVAAEAVHSIGISVLIYKLMKEKTCAGLSLKTQYLTAMFLAVRLYCSYVMEYDIHTLLDLATLGTTLWVIFMIRFKLQSSYMEDKDNFAMYYVAVPCAALALLIHPSTSHHFINRIFWAFCVYLEAVSVLPQLRVMQNTKIVEPFTAHYVFALGVARFLSCAHWVLQVLDSRGHLLTALGYGLWPSMVLISEIVQTFILADFCYYYVKSVFGGQLVLRLPSGVV

SEQ ID NO: 17294 - protein, 269 aa, Arabidopsis lyrata
MKTPIHAVSTWVRRQPPKVKAFLAVVSGMAALVLLRFIVHDHDNLFVAAEAVHSIGISVLIYKLMKEKTCAGLSLKSQELTAIFLAVRLYCSFVMEYDIHTILDLATLGTTLWVIYMIRFKLKATYMEEKDNFALYYVLVPCVVLAVLIHPSTSHNILNRISWGFCVYLEAVSVLPQLRVMQNTKIVEPFTAHYVFALGVARFFSCAHWVLQIMDTRGRLLVVLGYGLWPSMVIISEIVQTFILADFCYYYVKSVFGGQLVLRLPSGVV

SEQ ID NO: 17295 - protein, 273 aa, Musa acuminata
MRKGRARPIRAVVGWVRRRSPKVKASLSVIAGMAALVFLRFIVHDHDKLFVIAEAAHALGISVLIYKLIKERTCAGLSLKTQYLTALFLAVRLYCSFVMEYDIHTVLDCATLATTLWVIYMIRFRLKSSYMKEKDNFAIYYVVLPCAILAFTVHPSTTHNLIDRISWAFCVYLEAVSVLPQLRLMQNTKIVEPFTAHYVFALGVSRFLSCAHWVLQVLDTRGRLLTALGHGLWPPLVLLAEIVQTFILADFCYYYVKSVVGGQLVLRLPSGVV

SEQ ID NO: 17296 - protein, 272 aa, Daucus carota
MRPPKRPIHVISTWVRRQPPKVKAFLAVVAGMSALVVLRAIVHDHDNLFVAAEAVHSIGISLLIYKIMKEKTCAGLSLKSQELTALFLAVRLYCSFVMEYDIHTLLDLATLGATMWVIYMMRHKLRSSYMEEKDNFEIHYVVAPCAVLALLIHPSTSHHVINRIFWGFCVYLESVSVLPQLRVMQNTKIVEPFTAHYVFALGVARFLSCAHWVLQVLDTRGHLLTALGYGLWPSMVLISEVVQTFILADFCYYYVLSVFGGQLVLRLPSGVV

SEQ ID NO: 17297 - protein, 273 aa, Catharanthus roseus
MRGPARRPIVAVKSWLRRQPTKVKAFLAVIAGMAALVVLRAIVHDHDNLFVAAEAVHSIGISVLIYKLMKEKTCAGLSLKSQDLTALFLAVRLYCSFVMEYDIHTLLDLATLATTLWVIYMIRFKLRSSYMEDKDTVPLYYVVVPCAVLAFLIHPSTSHHIVNRIAWAFCVYLEAVSVFPQVRVMQNTKIVEPFTSHYVFALGVARFLSCAHWVLQMIDSRGHLLTALGYGLWPVMVLVSEIVQTFILSDFCYYYVQCVLGGELVLRLPSGVV

SEQ ID NO: 17298 - protein, 272 aa, Castanea mollissima
MKGAKTPIHAVAMWVRRQPPKVKAFLAVVSGIAALVFLRLVVHDHDNLFVAAEAVHALGISVLIFKLTKEKTCAGLSLKSQELTAIFLAVRLYCSFVMEFDIHTLLDSATLVTTLWVIYMIRFTLKSSYMDDKDNFKSYYVLLPCAVLSLLIHPTTQHHIINRILWAFCVYLEAVSVLPQLRVMQNTKIVEPFTAHYVFALGVARFLSCAHWILQVLDTHGRLLTTLGYGLWPSMVLLSEIVQTFILADFCYYYVKSLVGGQLVLRLPSGVV

SEQ ID NO: 17299 - protein, 271 aa, Cirsium arvense
RPPKRTIHVISSWVRRQPPKVKAFLAVVTGMVALVLLRVIVHDHDNLFVAAEAVHSIGISVLIYKLIKEKTCAGLSLKTQELTAMFLGVRLYCSFVMEYDIHTLLDMATLATTLWVIFMIRFKLKSSYMEDKDNFAMYYVAVPCGVLALLVHPSTSHHIINRIFWAFCVYLEAVSVLPQLRVMQNTKIVEPFTAHYVFALGVARFLSCAHWVLQVLDSRGHLLTALGYGLWPSTVLISEIVQTFILADFCYYYMKSVFGGQLVLRLPSGVV

SEQ ID NO: 17300 - protein, 272 aa, Euonymus alatus
MKATKRPIHAVAKWVRRQPPKIKAFLAVMSGIAVLLSLRLIVEDHDNLFVAAEAVHAIGISVLIYKLMKEKTCAGLSLKTQELTAMFLAVRLYCSFVMEYDIHTLLDSATLATTLWVIYMIRFKLRSSYMDDKDNFAIYYVVIPCALLSLVIHPTTQHNIVNRICWGFCVYLEAVSVLPQLRVMQNTKIVEPFTAHYVFALGVARFLSCAHWVLQVLDTRGRLLTALGYGLWPSMVLLSEIVQTFILADFCYYYVESLVGGQLVLRLPSGVV

SEQ ID NO: 17301 - protein, 272 aa, Panax ginseng
MRPPRRPINAVLTWAKRQPPKVKAFIAVVSGMISLVLLRIIVNDHDNLFVAAEIVHFIGISVLIYKLMKEKTCAGLSLKSQELTALFLAVRLYCSFVMEYDIHTLIDLATLGTTLWVIYMIRFKLRSSYMEDKDNFAIYYVVVPCAVLALLIHPSTSHNLINRIFWGFCVYLESVSVLPQLWVMQNTKIVEPFTSHYVFALGVARFLSCAHWVLQVLDTRGHLLTALGYGLWPSMVLISEIVQTFILADFCYYYVKSVIGGQLVLRLPSGVV

SEQ ID NO: 17302 - protein, 273 aa, Primula obconica
MRAARKNPIHGVWMWVRRQPPKVKAFLGVVAGMSALVLLRVIVHDHDNLFVAAEAVHSIGICVLIYKLIKETTCAGLSLKTQELTAIFLAVRLYCSYVMEYDIHTLLDLSTLAATLWVIYMIRFKLKSSYMEDKDNLPIYYVLAPCAVLAFLIHPSTSHHFVNRIFWSFCVYLEAVSVLPQLRVMQNTKIVEPFTAHYVFALGVARFLSCAHWVLQVLDTRGRLLTAMGYGLWPSMVLFSEIVQTFILADFCYYYVKSVFGGQLVLRLPSGVV

SEQ ID NO: 17303 - protein, 267 aa, Euphorbia esula
MRAHNRPIYALTTWLRRQPPKVKAFLAVVAGMAALVLLRFIVHDHDNLFVASEAVHSIGIVVLIYKLMKEKTCAGLSLKSQELTAMFLAVRLYCSFVMEYDIHTILDLATLGTTLWVIYMIRFKLKSSYMVDKDNFAIYYVVVPCAALAFLIHPSTSHNFINRIFWAFCVYLEAVSVLPQLRVMQNTKIVEPFTAHYVFALGVARFLSCAHWVLQVLDSRGHLLVALGYGLWPSMVLISEIVQTFILADFCYYYIKSVFGGQLVLRL

SEQ ID NO: 17304 - protein, 255 aa, Valeriana officinalis
QPPKVKAFLAVVAGMSALVLLRVIVHDHDNLFVAAEAVHSIGIAVLIFKLMKEKTCAGISLKSQELTALFLAVRLYCSFVMEYDIHTILDLATLAATMWVIYMIRFKLKSSYMVDKDNFAIYYVVGPCAALALFIHPSTSHYFVNRIFWAFCVYLEAVSVLPQLRVMQNTKIVEPFTAHYVFALGVARFLSCAHWVLQVLDSRGHLLTALGYGLWPSMVLISEIVQTFILADFCYYYVKSVFGGQLVLRLPSGVV

SEQ ID NO: 17305 - protein, 272 aa, Citrullus lanatus
MRPARNPIHIVSVWVRRQPPKVKAFLAVVLGMVALVALRFIVHDHDNLFVVAEAVHSMGISVLIYKFMKERTCAGISLKSQELTAIFLAVRLYCSFVMEHDIHTLLDLATLATTLWVVYMIRFKLKSSYMEDKDNFALYYVIAPCAVLALLIHPSTSHHLVNRVFWAFCVYLEAVSVLPQLRVMQNTKIVEPFTAHYVFALGIARFLSCAHWVLQVLDSRGHLLVALGYGLWPSMVLISEIVQTFILADFCYYYVKSVLGGQLVLRLPSGVV

SEQ ID NO: 17306 - protein, 273 aa, Amsonia hubrichtii
MRGPARRPILAVKSWLRRQPPKVKAFLAVISGMAALVVLRAIVHDHDNLFVAAEAVHSIGISVLIYKLMKEKTCAGLSLKSQDLTALFLAVRLYCSFVMEYDIHTLLDLATLATTLWVIYMIRFKLRSSYMEDKDSVPLYYVVVPCAVLALLIHPSTSHHIINRIAWAFCVYLEAVSVFPQVRVMQNTKIVEPFTSHYVFALGVARFLSCAHWVLQLIDSRGHLLTALGYGLWPVMVLVSEVVQTFILSDFCYYYVQCVLGGELVLRLPSGVV

SEQ ID NO: 17307 - protein, 272 aa, Arabidopsis lyrata
MKAAKRPIHAVTTWVRRQPPKVKAFLGVVSAMTALVLLRMIVHDHDNLFVAAEAVHALGISVLIYKLTKEKTCAGLSLKSQELTALFLAVRLYCSFVMEFDIHTLLDSATLVTTLFVIYMIRFKLKASYMDDKDNFAIYYVVIPCVVLSVLIHPSTHHHIINKISWAFCVYLEAVSVLPQLRVMQNTKIVEPFTAHYVFALGIARFLSCAHWVLQVLDTRGRLLTALGYGFWPIMVLFSEIVQTFILADFCYYYVKSLMGGQLVLRLPSGVV

SEQ ID NO: 17308 - protein, 272 aa, Phaseolus vulgaris
MRGGKKSIHAIITWMRRQPPKAKAFIAVVSSMAALVLLRIIVHDHDNLFVAAEAVHSIGISVLIYKLIKEKTCAGLSLKSQELTALFLAVRLYCSFVMEYDIHTLLDLATFATTLWVIYMIRFKLRSSYMQEKDNFAIYYVAVPCAVLALFIHPSTSHHLLNRIFWAFCVYLEAVSVLPQLRVMQNTKIVEPFTAHYVFALGVARFLSCAHWVLQVLDSRGHLLVALGYGLWPSMVLISEIVQTFILADFCYYYVQSVFGGQLVLRLPSGVV

SEQ ID NO: 17309 - protein, 273 aa, Cephalotaxus harringtonia
MRKSRRNPINAIWVWVTRQPPKVKAFLAVVSGILALVILRFVVHNHDNLFIAAEAIHAVGIAVLIYKLMKEKTCAGLSLKSQELTAMFLAVRVYCSFVMEYDIHTVLDTATLATTLWVIYMIRFELKATHVEDLDNFPILYVVLPCAVLALAIHPSTHHNIVNRILWAFCVYLEAVAVLPQLRVMQNTKIIEPFTAHYVFALGVARFLSCAHWVLQVLDSRGYLLTALGHGLWPSMVLLSEIVQTFILADFCYYYVKSVVGGQLVLRLPSGVV

SEQ ID NO: 17310 - protein, 272 aa, Capsicum annuum
MKAPRRPIHAVSTWVKRQPPKVKAFLAVISGMAILVLLRAIVHDHDNLFVAAEAVHAIGISVLIYKLMNEKTCAGISLKSQELTALFLAVRLYCSFVMEYDIHTLLDLATLGTTLWVIYMIHFNLKSSYMEDKDNCAIYYVVIPCAVLALLIHPSTSHHIINRIFWAFCVYLEAVSVLPQLRVMQNTKIVEPFTAHYVFALGVARFLSCTHWVLQVLDSHGHLLVALGHGLWPSMVLFSEIVQTFILADFCYYYVKSVFGGQLVLRLPSGVV

SEQ ID NO: 17311 - protein, 272 aa, Cajanus cajan
MKGSKRSIHAVTTWVRRQPPKMKAFLAVLLGLAALLFLRIVVHDHDSLFVAAEFVHALGISVLIYKLTKEKTCAGLSLKSQELTAMFLGVRLYCSFVMEYDIHTILDMATLVTTLWVIYMIRFKLKASYMDDKDNLAIYHVVIPCALLSLLIHPTTRHHTVNRILWAFCVYLEAVSVLPQLRVMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17312 - protein, 273 aa, Tabernaemontana elegans
MRGPARRPILAVKSWLRRQPPKVKAFLAVISGMAALVVLRAIVHDHDNLFVAAEAVHSIGISVLIYKLMKEKTCAGLSLKSQDLTALFLAVRLYCSFVMEYDIHTLLDLATLATTLWVIYMIRFKLRSSYMEDKDSIPIYYVVVPCAVLAVLIHPSTSHHIVNRIAWAFCVYLEAVSVLPQVRVMQNTKIVEPFTSHYVFALGVARFLSCAHWVLQLIDSRGHLLTALGYGLWPVMVLVSEVVQTFILSDFCYYYVQCVLGGELVLRLPSGVV

SEQ ID NO: 17313 - protein, 272 aa, Eutrema parvulum
MKAAKRPIHAVTTWVRRQPPKVKAFLGVVSAMTALVFLRMIVHDHDNLFVAAEAVHALGISVLIYKLTKEKTCAGLSLKSQELTALFLAVRLYCSFVMEFDIHTLLDSATLVTTLWVIYMIRFKLKASYMEDKDNFAIYYVVIPCAVLSVLIHPSTHHHIINKISWAFCVYLEAVSVLPQLRVMQNTKIVEPFTAHYVFALGIARFLSCAHWVLQVLDTRGRLLTALGYGFWPIMVLLSEVIQTFILADFCYYYVKSFMGGQLVLRLPSGVV

SEQ ID NO: 17314 - protein, 272 aa, Nicotiana tabacum
MTPPRRPIHAVSTWVRRQPPKVKAFLAVVPGMAALVLLRAIVHDHDNLFVAAEAVHPIGISVLIYKLMKEKTCAGLSLKSQELTAIFLAVRLYCSFVMEYDIHTLLDLATLATTLWVIYMIRFNLKSSYMEDKDNSPIYYVAIPCAALALLIHPSTSHHFINRIFWAFCVYLEAVSVLPQLRVMQNTKIVEPFTAHYVFALGIARFLSCAHWVLQVLDSRGHLLVALGHGLWPSMVLISEIVQTFILADFCYYYVKSVFGGQLVMRLPSGVV

SEQ ID NO: 17315 - protein, 275 aa, Aristolochia fimbriata
MGSARSGKNPIHAVATWVKSQPPKVKAFLAVIAGMASLVFLRLVVHDHDNLFVAAEACHAMGICVLIYKLIKERTCAGLSLKSQELTAIFLAVRLYCSFVMEYDIHTVLDVATLATTLWVIYMIRFKLRSSYMEDKDNFAIYYVLIPCAVLALLIHPSTSHNFVNRISWAFCVYLEAVSVLPQLRVMQNAKIVETFTAHYVFALSVSRFLSCAHWVLQVMDSRGYLLTALGHGLWPSMVLLSEIVQTFILADFCYYYVKSVVGGDLVLRLPSGVV

SEQ ID NO: 17316 - protein, 272 aa, Glycine max
MKGSKRPIHAVTTWVRRQPPKMKAFLAVLSGLAALLFLRIFVHDHDSLFVAAELVHALGISVLIYKLTREKTCAGLSLKSQELTAMFLGVRLYCSFVMEYDIHTLLDMATLVTTLWVIYMIRFKLKSSYMDDKDNLAMYYVVIPCAVLSLLIHPTTRHHPLNRILWAFCVYLEAVSVLPQLRVMQNAKIVEPFTAHYVFALGVARFLSCAHWVLQVLDTRGHLLTALGYGLWPFMVLLSEIVQTFILADFCYYYVKSLVGGQLVLRLPSGVV

SEQ ID NO: 17317 - protein, 272 aa, Ambrosia trifida
MRPPKKTIHIISSWVQRQPPRVKAFLAVVTGMLALVLLRAIVHDHDNLFVAAEAVHSIGISVLIYKLIKEKTCAGLSLKTQELTAMFLAVRLYCSFVMEYDIHTLLDLATLATTLWVIFMIRFKLKSSYMEDKDNFAMYYVVVPCAVLALLIHPSTSHHMINRIFWAFCVYLEAVSVLPQLRVMQNTKIVEPFTAHYVFALGVARFLSCAHWVLQVLDSRGHLLTALGYGLWPSMVLISEVVQTFILADFCYYYMKSVFGGQLVMRLPSGVV

SEQ ID NO: 17318 - protein, 272 aa, Artemisia annua
MRPPKRTINIITSWVRRQPPKVKAFLAVVSGMLALVLLRAIVHDHDNLFVAAEAVHSLGISVLIYKLMKEKTCAGLSLKTQELTAIFLAVRLYCSFVMEYDIHTLLDLATLATTLWVIFMIRFKLKSSYMEDKDNLPMYYVAVPCVILALVIHPSTSHHIINRIFWAFVVYLEAVSVLPQLRVMQNTKIVEPFTAHYVFALGVARFLSCAHWVLQVLDSRGHLLTALGYGLWPSMVLISEIVQTFILADFCYYYIKSVFGGQLVLRLPSGVV

SEQ ID NO: 17319 - protein, 272 aa, Brassica oleracea
MKAAKKPIHAVTTWVRRQPPKVKAFLGVVSAMTALVLLRVIVHDHDNLFVAAEAVHALGISVLIYKLTKEKTCAGLSLKSQELTALFLAVRLYCSFVMEFDIHTLLDSATLVTTLWVIYMIRFKLKASYMEDKDNFAIYYVVVPCAVLSVLIHPSTHHHIINKISWAFCVYLEAVSVLPQLRVMQNTKIVEPFTAHYVFALGIARFLSCAHWVLQVLDTRGRLLTALGYGFWPIMVLLSEVVQTFILADFCYYYVKSLMGGQLVLRLPSGVV

SEQ ID NO: 17320 - protein, 272 aa, Manihot esculenta
MKATKRPIHAVTTWVRRQPPKIKAFLAAVSGMAALVFIRMVVHDHDNLFVAAEAVHAIGISVLIYKLMKEKTCAGLSLKSQELTAMFLAVRLYCSLVMEYDIHTLLDSATLITTLWVIYMIRFKLRSSYMDDKDNFAIYYVLIPCAVLSLIIHPTTTHHIINRICWAFCVFLEAVSVLPQLWVMQNTKIVEPFTAHYIFALGVARFLSCAHWVLQVWDTRGRLLTALGYGLWPPVVLLSEIVQTFILADFCYYYVKSLLGGQLVLRLPSGVV

SEQ ID NO: 17321 - protein, 272 aa, Eutrema halophilum
MKAAKRPIHAVTTWVRRQPPKVKAFLGVVSAMTALVFLRMIVHDHDNLFVAAEAVHALGISVLIYKLTKEKTCAGLSLKSQELTALFLAVRLYCSFVMEFDIHTLLDSATLVTTLWVIYMIRFKLKASYMEDKDNFAIYYVVIPCAVLSVLIHPSTHHHIINKISWAFCVYLEAVSVLPQLRVMQNTKIVEPFTAHYVFALGIARFLSCAHWVLQVLDTRGRLLTALGYGFWPIMVLLSEIIQTFILADFCYYYIQSLMGGQLVLRLPSGVV

SEQ ID NO: 17322 - protein, 273 aa, Vinca minor
MRGPARRPIVAVRSWLRRQPPKVKAFLAVISGMAALVLLRVIVHDHDNLFVAAEALHSIGISVLIYKLIKEKTCAGLSLKSQELTALFLAVRLYCSFVMEYDIHTLLDLATLATTFWVIYMIRFKLRSSYMEDKDSVPLYYVVVPCAVLAFLIHPSTSHHIVNRIAWAFCVYLEAVSVFPQVRVMQNTKIVEPFTSHYVFALGVARFLSCAHWVLQLIDSRGHLLTALGYGLWPVMVLVSEIVQTFILSDFCYYYVQCVLGGELVLRLPSGVV

SEQ ID NO: 17323 - protein, 272 aa, Arabidopsis thaliana
MKAATRPIHAVTTWVRRQPPKVKGFLGVVSAMTALVLLRVIVHDHDNLFVAAEAVHSLGISVLIYKLTKERTCAGLSLKSQELTALFLAVRLYCSFVMEFDIHTLLDSATLVTTLFVIYMIRFKLKASYMDDKDNFAIYYVVIPCVVLSVLIHPSTHHHIINKISWAFCVYLEAVSVLPQLRVMQNTKIVEPFTAHYVFALGIARFLSCAHWVLQVLDTRGRLLTALGYGFWPIMVLLSEIVQTFILADFCYYYVKSLMGGQLVLRLPSGVV

SEQ ID NO: 17324 - protein, 272 aa, Brassica rapa
MKAAKKPIHAVTTWVRRQPPKVKAFLGVVSAMTALVLLRVIVHDHDNLFVAAEAVHALGISVLIYKLTKEKTCAGLSLKSQELTALFLAVRLYCSFVMEFDIHTLLDSATLVTTLWVIYMIRFKLKASYMEDKDNFAIYYVVVPCAVLSVLIHPSTHHHIINKISWAFCVYLEAVSVLPQLRVMQNTKIVEPFTAHYVFALGIARFLSCAHWVLQVLDTRGRLLTALGYGFWPIMVLFSEVVQTFILADFCYYYVKSLMGGQLVLRLPSGVV

SEQ ID NO: 17325 - protein, 272 aa, Cichorium intybus
MRPPKKTIHVISSWIHRQPPKVKGFLAVVAGMLALVLLRAIVHDHDNLFIAAEAVHSIGITVLIYKLSKEKTCAGISLKSQELTAMFLAVRLYCSFVMEYDIHTLLDLSTLAATLWVIFMIRFRLKSSYMEEKDNFAMYYVAVPCAILALLIHPSTSHHIINRVFWAFCVYLEAVSVLPQLRVMQNTKIVEPFTAHYVFALGVARFLSCAHWVLQVLDSRGHLLTALGYGLWPSMVLISEIVQTFILADFCYYYVKSVFGGQLVLRLPSGVV

SEQ ID NO: 17326 - protein, 272 aa, Echinacea purpurea
MRPPKKTIHIISSWLNRQPPKVKAFLAVVTGMLVLVLLRAIVHDHDNLFVAAEAVHSIGISVLIYKLIKEKTCAGLSLKTQELTAIFLAVRLYCSFVMEYDIHTLLDLATLATTLWVIFMIRFKLKASYMEDKDNFAMYYVVVPCAVLALLIHPTTSHHFVNRIFWAFCVYLEAVSVLPQLRVMQNTKIVEPFTAHYVFALGVARFLSCAHWVLQVLDSRGHLLTALGYGLWPSMVLISEVVQTFILADFCYYYVKSVFGGQLVMRLPSGVV

SEQ ID NO: 17327 - protein, 272 aa, Lupinus angustifolius
MKGTKRPIYAVTTWVRRQPPKVKAFLAFLSGITALLFIRMVVHDHDNLFVAAEAVHALGISVLIFKLSKDKTCSGLSLKSQELTALFLAVRLYCSFVMEYDIHTILDLATLGTTLWVIYMIRFKLKANYMDDKDNLAIYYVVLPCALLSLLIHPTTRHQIVNRVLWAFCVYLEAVSVLPQLRVMQNAKFVEPFTAHYVFALGVARFLSCAHWVLQVIDTRGRLLTALGYGLWPSMVLLSEIVQTFILADFCYYYVKSIVGGQLVVRLPSGVV

SEQ ID NO: 17328 - protein, 273 aa, Pinus taeda
MRKSRRNPVHVVSSWVARQPPKVKAFLAVVSGIAALVALRFVVHNHDNLFVAAEATHAVGISVLIYKLFKERNCSGLSLKSQELTAIFLAVRVYCSFVMEYDIHTVLDCATLVTTLLVIYMIRFKLKATHDEDLDNFPIYYVVIPCAVLALFIHPSTSHNIVNRILWAFCVYLEAVAVLPQLRVMQNTKIVEPFTAHYVFALGIARFFSCAHWVLQVLDSRGYLLIALGHGLWPSMVLLSEIVQTFILADFCYYYVQSVVGGQLVLRLPSGVV

SEQ ID NO: 17329 - protein, 272 aa, Populus trichocarpa
MKATRRPIQAVARWVRRQPPKMKAFLAVVSGLAALVFLRMVVRDHDNLFVAAEVVHSIGISVLIYKLMKEKTCAGLSLKSQELIAIFLAVRLYCSFVMEYDIHTLLDSATLLTTLWVIYTIRFNLRSSYMEGKDNFAIYYLVIPCAVLALYIHPRTHHHIVNRICWAFCVYLESISVLPQLRVMQNTKIVEPFTAHYVFALGVARFLGCAHWVLQVLDTRGRLLTALGYGLWPLMVLLSEIVQTFILADFCYYYVKSVLGGQLVLRLPSGVV

SEQ ID NO: 17330 - protein, 253 aa, Chenopodium quinoa
PKVKAFLAVVAGMAALVLLRAVVRDHDNLFVAAEAVHVIGIAVLIYKLTKEKTCAGLSLKSQELTAIFLAVRLYCSFVMEYDIHTLLDSATLVFTLWVIYMIRFNLRSTYMEDKDNFALYYVLVPCAVLAVLVHPSTSHNILNRISWAFCVYLEASSVLPQLRVMQNTKIVEPFTAHYVFALGVARFLSCAHWVLQVLDSRGHLLTALGYGLWPSFVLISEIVQTFILADFCYYYVQSIFGGQLVLRLPSGVV

SEQ ID NO: 17331 - protein, 272 aa, Sciadopitys verticillata
MRKSRNPIYKISAWVTRQPPKVKAFLAVVSGIVALVILRFLVHNHDNLFIAAEATHAVGISVLIYKLMKEKTCAGLSLKSQELTAIFLTVRVYCSFVMEYDIHTVLDSATLATTLWVIYMIRFKLKATHVEDLDNFPILYVVLPCAVLALAIHPSTRHNIVNRILWAFCVYLEAVAVLPQLRVMQNTKIIEPFTAHYVFALGIARFLSCAHWVLQVLDSRGYLLTALGHGLWPSMVLLSEIVQTFILADFCYYYVKSVVGGQLVLRLPSGVV

SEQ ID NO: 17332 - protein, 273 aa, Taxus baccata
MRKSRRNPISAMWAWVTRQPPKVKAFLAVVSGILALVILRFLVHNHDNLFIAAEAIHAVGIVVLIYKLMKEKTCAGLSLKSQELTAIFLAVRVYCSFVMEYDIHTVLDTATLATTLWVIYMIRFKLKATHVGDLDNFPIHYVVVPCAVLSLAIHPSTRHNIVNRILWAFCVYLEAVAVLPQLRVMQNTKIIEPFTAHYVFALGVARFLSCAHWVLQVLDSRGYLLTALGHGLWPSMVLLSEIVQTFILADFCYYYVKSVVGGQPVLRLPSGVV

SEQ ID NO: 17333 - protein, 272 aa, Solanum lycopersicum
MMAPRRPIHAVSTWVKRQPPKVKAFLAVVTGMTVLVLLRAIVHDHDNLFVAAEAVHAIGISVLIYKLTKEKTCAGISLKSQELTALFLAVRLYCSFVMEYDIHTLLDLATLATTLWVIFMIRFKLESSYMEDKDNCSVYYVVIPCAALALLIHPSTSHHLINRIFWAFCVYLEAVSVLPQLRVMQNTQIVEPFTAHYVFALGVARFLSCAHWILQVLDSNGHLLVALGHGLWPSMVLISEVVQTFILADFCYYYVKSVFGGQLVLRLPSGVV

SEQ ID NO: 17334 - protein, 273 aa, Vinca minor
MRGPARRPIVAVRSWLRRQPPKVKAFLAVISGMAALVLLRAIVHDHDNLFVAAEAVHSIGISVLIYKLIKEKTCAGLSLKSQELTALFLAVRLYCSFVMEYDIHTLLDFATLATTLWVIYMIRFKLRSSYMEDKDSVPLYYVVVPCAVLAFLIHPSTSHHTVNRIAWAFCVYLEAVSVFPQVRVMQNTKIVEPFTSHYVFALGVARFLSCAHWVLQLVDSRGHLLTALGFGLWPVMVLVSEIVQTFILSDFCYYYVQCVLGGELVLRLPSGVV

SEQ ID NO: 17335 - protein, 273 aa, Cycas rumphii
MGRKSKNPIYVVWGWVRRQPPTVKAFLAVITGIAALVFLRSVVDDHDNLFIAAEAAHALGIAVLIYKLTRQKTCAGLSLKSQELTAIFLGVRLYCSVVMEYDIHTLLDSATLASTLWVIYVIRYKLQSTYMKDLDNFPIYYMVIPCALLALAIHPTTSHNIINRLLWAFCVYLEAVSVLPQLRVMQNTEIVEPFTAHYVFALGVARFLSCAHWVLQVLDTRGYLLTALGRGLWPSMVLLSEIVQTFILADFCYYYVKSVVGGQLVMRLPPGVV

SEQ ID NO: 17336 - protein, 273 aa, Rosmarinus officinalis
MRGPARKPILAVRSWLRRQPPKVKAFLAVIAGMASLVVLRAIVHDHDNLFVAAEAVHSIGISVLIYKLMKEKTCAGLSLKSQDLTALFLAVRLYCSFVMEYDIHTLLDLSTLATTLWVIYMIRFKLRSSYMEDKDSVPLYYVVVPCAVLAFLIHPSTSHHIINRIAWAFCVYLEAVSVFPQVRVMQNTKIVEPFTSHYVFALGVARFLSCAHWVLQLIDSRGHLLTALGYGLWPVMVLISEVVQTFILSDFCYYYVQCVLGGELVLRLPSGVV

SEQ ID NO: 17337 - protein, 272 aa, Aquilegia formosa
MRGSKTPIHTVATWVKRQPFKIKMFLAGVSCLATLVFLKIIVHDHDNLFVAAEAVHALGICILIYKLMKENSCAGLSLKSQELTALFLAVRLYCSVVMEYDIHTLLDSATLGTTLWVIYMMRFKLKSTYMEDKDNFAIYYVVVPCAVLALVVHPSTSHYILNRVFWAFCVYLEAVSVLPQLRAMQNTKIVEPFTAHYVFALGVARFLSCAHWILQVVDTRGRLLTALGYGLWPSMVLLSEAVQTFILADFCYYYVKSLVGGQLVLRLPAGVV

SEQ ID NO: 17338 - protein, 272 aa, Brassica juncea
MKAAQKPIHAVTTWVRRQPPKVKAFLGVVSAMTALVLLRVIVHDHDNLFVAAEAVHALGISVLIYKLTKEKTCAGLSLKSQELTALFLAVRLYCSFVMEFDIHTLLDSATLVTTLWVIYMIRFKLKASYMEDKDNFAIYYVVVPCAVLSVLIHPSTHHHIINKISWAFCVYLEAVSVLPQLRVMQNTKIVEPFTAHYVFALGIARFLSCAHWVLQVLDTRGRLLTALGYGFWPIMVLFSEVIQTFILADFCYYYVKSLMGGQLVLRLPSGVV

SEQ ID NO: 17339 - protein, 272 aa, Brassica rapa
MRTTKSPIHAVSTWVRRQPPKVKVFLAVASGITALVLLKFIVHDHDNLFVAAESVHSIGISLLIYKLTKEKTCAGLSLKSQELTATFLAVRLYCSLVMEYDIHTILDLATLAATLWVIFMIRFKLKASYMVDKDTLPLYYVLVPCAVLAVLIHPSTSHNILNRISWAFCVYLEAVSVLPQLRVMQNTKIVEPFTAHYVFALGVARFLSCAHWVLQLVDTRGHLLVALGYGLWPSMFLISEVVQTFILADFCYYYVKSVFGGQLVLRLPSGVV

SEQ ID NO: 17340 - protein, 270 aa, Brassica napus
AAKKPIHAVTTWVRRQPPKVKAFLGVVSAMTALVLLRVIVHDHDNLFVAAEAVHALGISVLIYKLTKEKTCAGLSLKSQELTALFLAVRLYCSFVMEFDIHTLLDSATLVTTLWVIYMIRFKLKASYMEDKDNFAIYYVVVPCAVLSVLIHPSTHHHIINKISWAFCVYLEAVSVLPQLRVMQNTKIVEPFTAHYVFALGIARFLSCAHWVLQVLDTRGRLLTALGYGFWPIMVLFSEVVQTFILADFCYYYVKSLMGGQLVLRLPSGVV

SEQ ID NO: 17341 - protein, 272 aa, Chrysanthemum coronarium
MRPPKRTINIITSWVGRQPPKVKGFLAVVSGMLALVLLRAIVHDHDNLFVAAEAVHSLGISVLIYKLMKEKTCAGLSLKTQELTAIFLAVRLYCSFVMEYDIHTLLDLATLATTLWVIFMIRFKLKSSYMEDKDNLPMYYVAVPCVILALAIHPSTSHHIINRIFWAFVVYLEAVSVLPQLRVMQNTKIVEPFTAHYVFALGVARFLSCAHWVLQVLDSRGHLLTALGYGLWPSMVLISEIVQTFILADFCYYYIKSVFGGQLVLRLPSGVV

SEQ ID NO: 17342 - protein, 272 aa, Tropaeolum majus
MRPQKKSIQAVTTWVKRQPPKVKAFLAVVAGMSALVLLRFIVHDHDNLFVASEAVHSIGISVLIYKLMKEKTCAGLSLKSQELTALFLSVRLYCSFVMEYDIHTLLDLCTFATTVWVMYMIQFRLRSSYMEDKDNFTIYYVVIPCALLAVFVHPSTSHHVINRIFWAFCVYLEAVSVLPQLRVMQNTKIVEPFTAHYVFALGVARFLSCAHWVLQVLDTQGHLLVALGYGLWPSMVLISEIVQTFILADFCYYYVKSVIGGQLVLRLPSGVV

SEQ ID NO: 17343 - protein, 272 aa, Raphanus sativus
MKAAQKPIHAVTTWVRRQPPKVKAFLAVVSAMAALVLLRMIAHDHDNLFVAAEAVHALGISVLIYKLTKEKTCAGLSLKSQELTALFLAVRLYCSFVMEFDIHTLLDSATLVTTLWVIYMTRFKLNASYMEDKDNFAIYYVVVPCAVLSVLIHPSTHHHIINKISWAFCVYLEAVSVLPQLRVMQNTKIVEPFTAHYVFALGIARFLSCAHWVLQVLDTRGRLLTALGYGFWPIMVLISEVIQTFILADFCYYYVKSLMGGQLVLRLPSGVV

SEQ ID NO: 17344 - protein, 272 aa, Tripterygium wilfordii
MKATKRPIHAVATWVRRQPPKIKAFLGVMLGIAVLLSLRLIVEDHDNLFVAAEAVHAIGISVLIYKLMKEKTCAGLSLKTQELTAMFLAVRLYCSFVMEYDIHTLLDSATLATTLWVIYMIRFKLRSSYMDDKDNCAIYYVVMPCALLSLVIHPTTQHNIVNRICWGFCVYLEAVSVLPQLRVMQNTKIVEPFTAHYVFALGVARFLSCAHWVLQVLDTRGRLLTALGYGLWPPMVLLSEIVQTFILADFCYYYVESLVGGQLILRLPSGVV

SEQ ID NO: 17345 - protein, 275 aa, Gnetum gnemon
MGPGRRSKNPVYVLYAWVRRQPPKVKAFLAVIAGIASLVFLRMVVHDHDNLFVAAEAIHAFGISILIYKLTKEKTCAGLSLKSQELTALFLGVRLYCSFVMEYDIHTILDFATFVTTLWVIYMMRYKLRSTYMEDLDNLSSLIVVLPCALLALLIHPTTSHNIVNRILWAFVVYLEAVSVLPQLRMMQNTKVVEPFTAHYVFALGIVRFLSCAHWVLQVLDSRGHLLIALGQGLWPPMVLLSEIVQTFILADFCYYYVKSVVGGQLVVRLPSGVV

SEQ ID NO: 17346 - protein, 275 aa, Podocarpus macrophillus
MGLLRRSKNPVHMLAGWVRRQPPKVKAFLAVVTGIASLVFLRFVVHDHDNLFVAAEAIHALGISVLIYKLTKEKTCAGLSLKSQELTAIFLAVRLYCSYVMEYDIHTLLDLATLVTTLWVIYMIRYKLRSTYMENLDNLPVYYVVIPCALLAFAIHPSTSHNIVNRILWAFCVYLEAVSVLPQLRVMQNTQVVEPFTAHYVFALGVVRFLSCAHWILQVLDSRGYLLTALGHGLWPSMVLLSEIVQTFILADFCYYYVKSVVGGQLVVRLPAGVV

SEQ ID NO: 17347 - protein, 280 aa, Flaveria ramosissima
MRPPKRTIHIISSWVRRQPPKVKAFLAVVTGMLALVLLRVIVHDHDNLFVAAEAVHSIGISVLIYKLMKEKTCAGLSLKAQELTAMFLAVRLYCSLVMEYDIHTLLDLATLVTTLWVIFMIRFKLKSSYMEDKDNFPTYYVVVPCAVLALLIHPSTSHHIINRIFWAFCVYLEAVSVLPQLRVMQNTKIVEPFTAHYVFALGVARFLSCAHWVLQVLDSRGHLLTALGYGLWPSMVLISEIVQTFILADFCYYYVKSVFGGQLVLRLPSGVVYKLRKCWH

SEQ ID NO: 17348 - protein, 269 aa, Arabidopsis thaliana
MKTPIHAVSTWVRRQPPKVKAFLAVVSGMAALVLLKLIVHDHDNLFVAAEAVHSIGISVLIYKLMKEKTCAGLSLKSQELTAIFLAVRLYCSFVMEYDIHTILDLATLGTTLWVIYMIRFNLKTTYMEEKDNFALYYVLAPCVVLAVWIHPSTSHNILNRISWGFCVYLEAVSVLPQLRVMQNTKIVEPFTAHYVFALGVARFFSCAHWVLQMMDTHGRLLVVLGYGLWPSMVIISEIVQTFILADFCYYYVKSVFGGQLVLRLPSGVV

SEQ ID NO: 17349 - protein, 272 aa, Brassica rapa
MKAAKKPIHAVTTWVRRQPPKVKAFLGVVSAMAALVLLRMIVHDHDNFFVAAEAVHALGISVLIYKLTKEKTCAGLSLKTQELTALFLAVRLYCSFVMEFDIHTLLDSATLVTTLWVIYMIRFKLKATYMEDKDNFPIYYVVIPCAVLSVLFHPSTHHHIINKVSWAFCVYLESVSVLPQLRVMQNTKIVEPFTAHYVFALGIARFLSCAHWVLQVLDTRGRLLTALGYGLWPIMVLLSEVIQTFILADFCYYYVKSLMGGQLVLRLPSGVV

SEQ ID NO: 17350 - protein, 272 aa, Manihot esculenta
MKATKRPIHAVATWVQRQPPKIKAFLAIISGMAALVFLRMVVHDHDNLFVAAEAVHAIGISVLIYKLMKERTCAGLSLKSQELTAIFLAVRLYCSLVMEYDIHTLLDSATLLTTLWVIYMIRFKLRSSYMDDKDNFAIYYVLIPCVVLSLLIHPTTQHHLINRICWSFCVFLEAVSVLPQLRVMQNTKIVEPFTAHYVFALGIARFLSCAHWVLQVLDTRGRLLTALGYGLWPPMVLLSEIVQTFILADFCYYYVKSLVGGQLVLRLPSGVV

SEQ ID NO: 17351 - protein, 272 aa, Chrysanthemum coronarium
MRPPKNTLTVISSWVRRQPPKVKGFLAVVAGMTALVLLRAIVHDHDNLFKAAEAVHSIGLAVLIYKFSKEKTCAGISLKSQELTAMFLAVRLYCSFVMEYDIHTLLDLCTLAATLWVIYMIRFKLKSSYMEDKDNFATYYVAVPCAILALFIHPTTPHYLINRISWAFAVYLEAVSVLPQLRVMQNTKIVEPFTAHYVFALGVARFLSCAHWVLQVLDSHGRLLTALGYGLWPSMVLISEIVQTFILADFCYYYVKSVFGGQLVMRLPSGVV

SEQ ID NO: 17352 - protein, 272 aa, Citrus clementina
MKGYKTPIHAAATWVRRQPPKIKIFLAVITALAALVFLRMVVEDHDSLFVVAEAAHAIGISVLIYKLTKERTCAGLSLKSQELTAIFLAVRLYCSFVMEYDIHTLLDSATLVTTLWVIYMMRFKLRASYMDDKDNFAIYYVLIPCAVLSFLIHPSTHHHLVNRISWAFCVYLEAVSVLPQLRVMQNTKIVEPFTAHYVFALGVARFLSCAHWILQVLDTRGRLLTALGYGLWPSMVLLSEIVQTFILADFCYYYVKSLIGGQLVLRLPSGVV

SEQ ID NO: 17353 - protein, 272 aa, Euonymus alatus
MKATKRPIHAVATWVRRQPPKIKAFLAVMSGIAVLLSLRLIVEDHDNLFVAAEAVHAIGISVLIYKLMKEKTCAGLSLKTQELTAMFLAVRLYCSFVMEYDIHTLLDLTTLATTLWVIYMIRFKLQSSYMEDKDNFAIYYVVIPCALLSLVIHPTTQHNIVNRLCWGFCVYLEAVSVLPQLRVMQNTKIVEPFTAHYVFALGVSRFLSCAHWVLQVLDTRGRLLTALGYGLWPLMVLLSEVVQTFILADFCYYYVKSLVGGQLVLRLPSGVV

SEQ ID NO: 17354 - protein, 272 aa, Lotus japonicus
MKATKRPIHALTTWVRRQPPKMKAFLAVVAGLATLLFLRMVVHDHDNLFIAAEFVHALGISLLIFKLTKEKTCAGLSLKSQELTAMFLAVRLYCSFVMEYDIHTILDTATLVTTLWVIYMMRFKLKSSYMDDKDNLPIYYVVMPCAALSLLIHPNTRHNPINRILWGFCVYLEAVSVLPQLRVMQNAKIVEPFTGHYVFALGVARFLSCAHWVLQVLDTRGRLLTALGYGLWPSMVLLSEIVQTFILADFCYYYVKSIFGGQLVVRLPSGVV

SEQ ID NO: 17355 - protein, 275 aa, Cycas rumphii
MVTVRKSRNPIHVVSGWVAKQPPKVKAFLAVVSGITALVFLRFVVHNHDNLFVAAEATHAVGISVLIYKLTKEKTCAGLSLKSQELTAIFLVVRVYCSFVMEYDIHTVLDSATLATTLWVIYMIRFKLKATHAEDLDNFPIYYVVIPCAVIALAIHPTTSHNIINRILWAFCVYLEAVAVLPQLRVMQNTKIIEPFTAHYVFALGIARFLSCAHWVLQVLDSRGYLLTALGHGLWPSMVLLSEIVQTFILADFCYYYVKSVVGGQLVLRLPSGVV

SEQ ID NO: 17356 - protein, 272 aa, Brassica oleracea
MKAAKKPIHAVTTWVRRQPPKVKAFLGVVSAMAALVLLRMIVHDHDNFFVAAEAVHALGISVLIYKLTKEKTCAGLSLKTQELTALFLAVRLYCSFVMEFDIHTLLDSATLVTTLWVIYMIRFKLKATYMEDKDNFPIHYVVIPCAVLSVLFHPSTHHHIINKVSWAFCVYLESVSVLPQLRVMQNTKIVEPFTAHYVFALGIARFLSCAHWVLQVLDTRGRLLTALGYGLWPIMVLLSEVIQTFILADFCYYYVKSLMGGQLVLRLPSGVV

SEQ ID NO: 17357 - protein, 272 aa, Brassica napus
MKAAKKPIHAVTTWVRRQPPKVKAFLGVVSAMAALILLRMIVHDHDNFFVAAEAVHALGISVLIYKLTKEKTCAGLSLKTQELTALFLAVRLYCSFVMEFDIHTLLDSATLVTTLWVIYMIRFKLKTTYMEDKDNFPIHYVVIPCAVLSVLFHPSTHHHIINKVSWAFCVYLESVSVLPQLRVMQNTKIVEPFTAHYVFALGVARFLSCAHWVLQVLDTRGRLLTALGYGLWPIMVLLSEVIQTFILADFCYYYVKSLMGGQLVLRLPSGVV

SEQ ID NO: 17358 - protein, 272 aa, Brassica napus
MRATKSPIHAVSTWVRRQPPKVKVFLAVASGITALVLLKFIVHDHDNLFVAAESVHSIGISLLIYKLTKEKTCAGLSLKSQELTATFLAVRLYCSLVMEYDIHTILDLATLAATLWVIFMIRYKLKASYMEDKDTLPLYYVLVPCAVLAVLIHPSTSHNILNRISWAFCVYLEAVSVLPQLRVMQNTKIVEPFTAHYVFALGVARFLSCAHWVLQLVDTRGHLLVALGYGLWPSMFLISEVVQTFILADFCYYYVKSVFGGHLVLRLPSGVV

SEQ ID NO: 17359 - protein, 272 aa, Medicago truncatula
MKATKSPIHAVTKWLRRQPPKMKLFLAILSGIAALVFLRMIVHDHDNLFVAAEFVHALGVALLIYKLAQEKTCAGLSLKSQELTAIFLAVRLYCSFVMEYDIHTLLDTATLGTTLWVIYMIRFKLKSSYMDAKDNLAIYYVVIPCAVLSLLIHPTTRHHYANRILWAFCVYLEAVSVLPQLRVMQNTKIVEPFTAHYVFALGVARFLSCAHWVLQVLDTRGRLLTALGYGLWPSMVLLSEIVQTSILADFCYYYIKSLVGGQLVLRLPSGVV

SEQ ID NO: 17360 - protein, 230 aa, Saccharum officinarum
HDHDNLFVAAEAAHALGIGVLIYKLTKEKTCAGLSLKSQDLTALFLAVRLYCSFVMEYDIHTILDTATLVATLFVIYMIRFKQRSTYMVDKDNFALYYVVLPCAGLALLIHPSTSHNIVNRISWAFCVYLEAVSVLPQLRLMQNTKIVEPFTAHYVFALGVARFLSCAHWVLQVLDTRGRLLTALGYGLWPSMVLLSEIVQTFILADFCYYYVKSLVGGQLVLRLPSGVV

SEQ ID NO: 17361 - protein, 277 aa, Musa acuminata
MDSKTRKGRARPIRAVVGWVRRRSPKVKASLSVIAGMAALVFLRFIVHDHDKLFVVAEAAHALGISVLIYKLVKERTCAGLSLKTQYLTALFLAVRLYCSFVMEYDIHTVLDCATLATTLWVIYMIRFRLKSSYMKEKDNFAIYFVVLPCAILAFAVHPSTTHNVIDRISWAFCVYLEAVSVLPQLRLMQNTKIVEPFTAHYVFALGVSRFLTCAHWVLQVLDTRGRLLTALGRGLWPPMVLLAEIVQTFILADFCYYYVKSVVGGQLVLRLPSGAV

SEQ ID NO: 17362 - protein, 275 aa, Cycas rumphii
MGPLRRSRNPLHVLSGWVRRQPPKVKAFLGVVTGIASLVFLRMVVHDHDNLFVAAEAIHAVGISVLIYKLMKEKTCAGLSLVSQELTAIFLGVRLYCSFVMEYDIHTLLDLATLATTLWVIYMIRYKLKSTYMEDLDNFPIYYVLIPCALLAFAIHPTTSHNIVNRVLWAFCVYLEAVSVLPQLRVMQNTKVVEPFTAHYVFALGVVRFLSCAHWVLQVLDSRGYLLTALGHGLWPSMVLLSEIVQTFILADFCYYYVKSVVGGQLVVRLPSGVV

SEQ ID NO: 17363 - protein, 275 aa, Sciadopitys verticillata
MGPLRRSKNPVQMVASWVRRQPPKVKAFLAVITGIVSLIFLRFVVHDHDNLFVAAEAIHALGISVLIYKLSKERTCAGLSLKSQELTAIFLGVRLYCSFVMEYDIHTLLDLATLATTIWVIYMIRFKLRSTYMEDLDNLPVYYVVIPCAVLALAIHPTTSHNIVNRILWAFCVYLEAVSILPQLRVMQNTQVVEPFTAHYVFALGVVRFLSCAHWILQVLDTRGFLLTALGHGLWPPMVLLSEIVQTFILADFCYYYVKSVVGGQLVVRLPAGVV

SEQ ID NO: 17364 - protein, 276 aa, Sequoia sempervirens
MVTTRKSRRNPINAMWGWITRQPPKVKAFLAVVSGILALVILRFLVHNHDNLFIAAEAIHAVGIAVLIYKLMKEKTCAGLSLKSQELTAMFLAVRVYCSFVMEYDIHTVLDTATLATTLWVIYMIRFKLKATHVEDLDNFPIHYVVLPCAVLALAIHPTTHHNIVNRILWAFCVYLEAVAVLPQLRVMQNTKIIEPFTAHYVFALGIARFLSCAHWVLQVLDSRGYLLTALGHGLWPSMVLLSEIVQTFILADFCYYYVKSVVGGQLVLRLPSGVV

SEQ ID NO: 17365 - protein, 276 aa, Picea glauca
MAIVRKSRRNPVHVVSSWVARQPPKVKAFLAVVSGITALIVLRFVVHNHDNLFVAAEATHAVGISVLIYKLFKERNCAGLSLKSQELTAIFLAVRVYCSFVMEYDIHTVLDSATLATTLWVIYMIRFKLNATHDEDLDNFPIYYVVIPCAALALFVHPTTSHNIVNRILWAFCVYLEAVAVLPQLRVMQNTKIVEPFTAHYVFALGIARFFSCAHWVLQVLDSRGYLLTALGHGLWPSMVLLSEIVQTFILADFCYYYVQSVVGGQLVLRLPSGVV

SEQ ID NO: 17366 - protein, 273 aa, Centaurea maculosa
MKGSSKRPIQVVRTWVRRQPPKVKVFLGFVCAIAALIFIRMVVYDHDNLFIAAEAVHALGISVLIYKIATEKTCAGLSLKSQELTAIFLGTRLYCSFVMEYDVHTLLDLATLAATVWVVYMMRFNLNASYMHEKDNVPNYYVVIPCALLSLLIHPSTQHYIVNRILWAFCVYLEAVSVLPQLRVMQNTKIVEPFTAHYVFALGVARFLSCAHWILQVLDTRGRLLTALGYGLWPSMVLLSEIVQTFILADFCYYYVQSVMGGQLVLRLPSGVV

SEQ ID NO: 17367 - protein, 272 aa, Vigna unguiculata
MKGSKRPIHTVTTWFRRQPPKMKVFLAVLIGLAALLFLRIVVHDHDSLFVAAEFVHALGISVLIYKLTKEKTCAGLSLKSQELTAIFLGVRLYCSFVMEYDIHTLLDMATLGTTIWVIYMIRFKLKSSYMDDKDNLAIYYVVIPCAVLSLFIHPTTRHHTVNRILWAFCVYLEAVSVLPQLRVMQNTKIVEPFTAHYVFALGVARFLSCAHWVLQVIDTHGRLLTALGYGLWPSFVLLSEIVQTFILADFCYYYVKSLVGGQLVVRLPAGVV

SEQ ID NO: 17368 - protein, 272 aa, Euphorbia peplus
MKATKRPIHAVSTWVRKQPPKIKAFLAVVTGMAALVFLRMVVRDHDNLFVAAESVHAIGISVLIYKLTKEKTCAGLSLKTQELTAIFLAVRLYCSFVMEFDIHTILDSATLITTLWVIYMIRFNLRTSYMEDKDNFPNHFVLIPCAVLSFLIHPTTQHYLINRICWAFCVYLEAVSVLPQLRVMQNTKIVEPFTAHYVFALGVARFLSCAHWVLQVLDSGGRLLTALGYGLWPPMVLISEIVQTFILADFCYYYVKSLFGGQLVLRLPSGVV

SEQ ID NO: 17369 - protein, 273 aa, Arachis hypogaea
MKGNNKRPIYAVTTWVRRQPPKMKAFLALLSAIAALVFLRMVVNDHDNLFVAAEAVHALGISLLIYKLTKDKTCAGLSLKSQELTALFLAVRLYCSFVMEYDIHTILDLATLVTTLWVIYMIRFKLKSTYMDDKDNLAIYLVVAPCAVVSFFIHPTTRNSIVNRILWAFCVYLEAVSVLPQLRVMQNTKIVEPITAHYVFALGVARFLSCAHWVLQVIDTRGRLLVVLGYGLWPSMVLISEIVQTFILADFCYYYVKSIIGGQLVVRLPSGVV

SEQ ID NO: 17370 - protein, 272 aa, Eutrema parvulum
MKAEKSPIQSVMSWIRRQPPKVKAFLAVVTAMTVLVFLRVIVHEHDNLFIASEAVHAVGISVLIYKLTKEKTCAGISLKTQELTALFLAVRLYCSFVMEFDLHTLLDSATLVTTLWVIYMIRFKLRPTYMEDKDNFAIYYVVIPCAVVAFLIHPSTRHHIINRLFWAFCVYLEAVSVLPQLRVMQNTKIVEPFTAHYVFALGIARFLSCAHWILQVLDTRGRLLTALGYGLWPLMVLLSEIIQTFILADFCYYYVQSLMGGQLVLRLPSGVV

SEQ ID NO: 17371 - protein, 464 aa, Oryza sativa
MSRRGLMEQDLSKLDVTKLHPLSPEVISRQATINIGTIGHVAHGKSTVVKAISGVQTVRFKNELERNITIKLGYANAKIYKCEDEKCPRPMCYKAYGSGKEDSPHCDVPGFENTRMKLLRHVSFVDCPGHDILMATMLNGAAIMDGALLLIAANESCPQPQTSEHLAAVEIMRLQHIIILQNKIDLIQESAAMNQHEAIQKFIQGTIAEGAPVVPISAQLKYNIDVICEYIVKKIPIPERNFTSPPNMIVIRSFDVNKPGSEVDEIRGGVAGGSILRGVLRVNQNIEVRPGIVMKDESGNIKCTPIYSRIVSLYAEQNELQFAVPGGLIGVGTTMDPTLTRADRLVGQVLGEVGSLPDVYVELEINFFLLRRLLGVRTKGTEKAGKVSKLTKGEILMLNIGSMSTGARVVAVKNDLAKLQLTAPVCTSKGEKVALSRRVEKHWRLIGWGQIQAGTTLEVPPCPL

SEQ ID NO: 17372 - protein, 464 aa, Setaria italica
MARRGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPHCDVPGFENTRMKLLRHVSFVDCPGHDILMATMLNGAAIMDGALLLIAANESCPQPQTSEHLAAVEIMRLQHIIILQNKIDLIQESAAMNQHEAIQKFIQGTIAEGAPVVPISAQLKYNIDVICEYIVKKIPIPERNFTSPPNMIVIRSFDVNKPGSEVDEIRGGVAGGSILRGVLRVNQKIEVRPGIVMKDESGNIKCTPIYSRIVSLYAEQNELQFAVPGGLIGVGTTMDPTLTRADRLVGQVLGEVGSLPDVYVELEINFFLLRRLLGVRTKGTEKAGKVSKLTKGEILMLNIGSMSTGARVLAVKNDLAKLQLTAPVCTSKGEKVALSRRVEKHWRLIGWGQIQAGSTLEVPPCPL

SEQ ID NO: 17373 - protein, 464 aa, Sorghum bicolor
MARRGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENTRMKLLRHVSFVDCPGHDILMATMLNGAAIMDGALLLIAANESCPQPQTSEHLAAVEIMRLQHIIILQNKIDLIQESAAMNQHEAIQKFIQGTIAEGAPVVPISAQLKYNIDVICEYIVKKIPIPERNFTSPPNMIVIRSFDVNKPGSEVDEIRGGVAGGSILRGVLRVNQKIEVRPGIVMKDESGNIKCTPIYSRIVSLYAEQNELQFAVPGGLIGVGTTMDPTLTRADRLVGQVLGEVGSLPDVYVELEINFFLLRRLLGVRTKGTEKAGKVSKLTKGEILMLNIGSMSTGARVLAVKNDLAKLQLTAPVCTSRGEKVALSRRVEKHWRLIGWGQIQAGTTLDVPPCPL

SEQ ID NO: 17374 - protein, 464 aa, Zea mays
MARRGLMEQDLSKLDVTKLDPLSPEVISRQATINIGTIGHVAHGKSTVVKAISGVQTVRFKNELERNITIKLGYANAKIYKCEDDRCPRPMCYKAYGSGKEDSPLCDVPGFENTRMKLLRHVSFVDCPGHDILMATMLNGAAIMDGALLLIAANESCPQPQTSEHLAAVEIMRLQHIIILQNKIDLIQESAAMNQHEAIQKFIQGTIAEGAPVVPISAQLKYNIDVICEYIVKKIPIPERNFTSPPNMIVIRSFDVNKPGSEVDEIRGGVAGGSILRGVLRVNQKIEVRPGIVMKDENGNIKCTPIYSRIVSLYAEQNELQFAVPGGLIGVGTTMDPTLTRADRLVGQVLGEVGSLPDVYVELEINFFLLRRLLGVRTKGTEKAGKVSKLTKGEILMLNIGSMSTGARVLAVKNDLAKLQLTAPVCTSRGEKVALSRRVEKHWRLIGWGQIQAGTTLEVPPCPL

SEQ ID NO: 17375 - protein, 464 aa, Avena sativa
MARRGLMEQDLSKLDVTKLHPLSPEVISRQATINIGTIGHVAHGKSTVVKAISGVQTVRFKNELERNITIKLGYANAKIYKCEDDKCPRPVCYKAYGSGKEDTPYCDVPGFENTRMKLLRHVSFVDCPGHDILMATMLNGAAIMDGALLLIAANESCPQPQTSEHLAAVEIMRLQHLIILQNKIDLIQESAAMNQHEAIQKFIQGTIAEGAPVVPISAQLKYNIDVICEYIVKKIPIPERNFTSPPNMIVIRSFDVNKPGSEVDEIRGGVAGGSILRGVLRVNQNIEVRPGIVMKDESGNIKCTPIYSRIVSLYAEQNELQFAVPGGLIGVGTTMDPTLTRADRLVGQVLGEIGSLPDVFVELEINFFLLRRLLGVRTKGTEKAGKVSKLTKGEILMLNIGSMSTGARVVAVKNDLAKLQLTAPVCTSKGEKVALSRRVEKHWRLIGWGQIQAGATLEVPPCPL

SEQ ID NO: 17376 - protein, 464 aa, Saccharum officinarum
MARRGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPPCDVPGFENTRMKLLRHVSFVDCPGHDILMATMLNGAAIMDGALLLIAANESCPQPQTSEHLAAVEIMRLQHIIILQNKIDLIQESAAMNQHEAIQKFIQGTIAEGAPVVPISAQLKYNIDVICEYIVKKIPIPERNFTSPPNMIVIRSFDVNKPGSEVDEIRGGVAGGSILRGVLRVNQKIEVRPGIVMKDETGNIKCTPIYSRIVSLYAEQNELQFAVPGGLIGVGTTMDPTLTRADRLVGQVLGEVGSLPDVYVELEINFFLLRRLLGVRTKGTEKAGKVSKLTKGEILMLNIGSMSTGARVLAVKNDLAKLQLTAPVCTSRGEKVALSRRVEKHWRLIGWGQIQAGTTLDVPPCPL

SEQ ID NO: 17377 - protein, 464 aa, Lolium multiflorum
MARRGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDTPACDVPGFENTRMKLLRHVSFVDCPGHDILMATMLNGAAIMDGALLLIAANESCPQPQTSEHLAAVEIMRLQHLIILQNKIDLIQESAAMNQHEAIQKFIQGTIAEGAPVVPISAQLKYNIDVICEYIVKKIPIPERNFTSPPNMIVIRSFDVNKPGSEVDEIRGGVAGGSILRGVLRVNQNIEVRPGIVMKDESGNIKCTPIYSRIVSLYAEQNELQFAVPGGLIGVGTTMDPTLTRADRLVGQVLGEIGSLPDVFVELEINFFLLRRLLGVRTKGTEKAGKVSKLTKGEILMLNIGSMSTGARVVAVKNDLAKLQLTAPVCTSKGEKVALSLRVEKHWRLIGWGQIQAGATLEVPPCPL

SEQ ID NO: 17378 - protein, 464 aa, Secale cereale
MARRGLMEQDLTKLDVTKLHPLSPEVISRQATINIGTIGHVAHGKSTVVKAISGVQTVRFKNELERNITIKLGYANAKIYKCEDDKCPRPMCYKAYGSGKEDTPACDVPGFENTRMKLLRHVSFVDCPGHDILMATMLNGAAIMDGALLLIAANESCPQPQTSEHLAAVEIMRLQHLIILQNKIDLIQESAAMNQHEAIQKFIQGTIAEGAPVVPISAQLKYNIDVICEYIIKKIPIPERNFTSPPNMIVIRSFDVNKPGSEVDEIRGGVAGGSILRGVLRVNQNIEVRPGIVMKDESGNIKCTPIYSRIVSLYAEQNELQFAVPGGLIGVGTTMDPTLTRADRLVGQVLGEIGSLPDVFVELEINFFLLRRLLGVRTKGTEKAGKVSKLTKGEILMLNIGSMSTGARVVAVKNDLAKLQLTAPVCTSKGEKVALSRRVEKHWRLIGWGQIQAGATLEVPPCPL

SEQ ID NO: 17379 - protein, 464 aa, Pennisetum glaucum
MARRGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDTPPCDVPGFENTRMKLLRHVSFVDCPGHDILMATMLNGAAIMDGALLLIAANESCPQPQTSEHLAAVEIMRLQHIIILQNKIDLIQESAAMNQHEAIQKFIQGTIAEGAPVVPISAQLKYNIDVICEYIVKKIPIPERNFTSPPNMIVIRSFDVNKPGSEVDEIRGGVAGGSILRGVLRVNQKIEVRPGIVMKDENGSIKCTPIYSRIVSLYAEQNELQFAVPGGLIGVGTTMDPTLTRADRLVGQVLGEVGSLPDVYVELEINFFLLRRLLGVRTKGTEKAGKVSKLAKGEILMLNIGSMSTGARVLAVKNDLAKLQLTAPVCTSKGEKVALSRRVEKHWRLIGWGQIQAGSTLEVPPCPL

SEQ ID NO: 17380 - protein, 464 aa, Pseudoroegneria spicata
  Sequence also found in Organisms: Secale cereale, Triticum aestivum
MARRGLMEQDLTKLDVTKLHPLSPEVISRQATINIGTIGHVAHGKSTVVKAISGVQTVRFKNELERNITIKLGYANAKIYKCEDDRCPRPMCYKAYGSGKEDTPACDVPGFENTRMKLLRHVSFVDCPGHDILMATMLNGAAIMDGALLLIAANESCPQPQTSEHLAAVEIMRLQHLIILQNKIDLIQESAAMNQHEAIQKFIQGTIAEGAPVVPISAQLKYNIDVICEYIIKKIPIPERNFTSPPNMIVIRSFDVNKPGSEVDEIRGGVAGGSILRGVLRVNQNIEVRPGIVMKDESGNIKCTPIYSRIVSLYAEQNELQFAVPGGLIGVGTTMDPTLTRADRLVGQVLGEIGSLPDVFVELEINFFLLRRLLGVRTKGTEKAGKVSKLTKGEILMLNIGSMSTGARVVAVKNDLAKLQLTAPVCTSKGEKVALSRRVEKHWRLIGWGQIQAGATLEVPPCPL

SEQ ID NO: 17381 - protein, 464 aa, Triticum aestivum
MARRGLMEQDLTKLDVTKLHPLSPEVISRQATINIGTIGHVAHGKSTVVKAISGVQTVRFKNELERNITIKLGYANAKIYKCEDDRCPRPMCYKAYGSGKEDTPACDVPGFENTRMKLLRHVSFVDCPGHDILMATMLNGAAIMDGALLLIAANESCPQPQTSEHLAAVEIMRLQHLIILQNKIDLIQESAAMNQHEAIQKFIQGTIAEGAPVVPISAQLKYNIDVICEYIINKIPIPERNFTSPPNMIVIRSFDVNKPGSEVDEIRGGVAGGSILRGVLRVNQNIEVRPGIVMKDESGNIKCTPIYSRIVSLYAEQNELQFAVPGGLIGVGTTMDPTLTRADRLVGQVLGEIGSLPDVFVELEINFFLLRRLLGVRTKGTEKAGKVSKLTKGEILMLNIGSMSTGARVVAVKNDLAKLQLTAPVCTSKGEKVALSRRVEKHWRLIGWGQIQAGATLEVPPCPL

SEQ ID NO: 17382 - protein, 464 aa, Brachypodium distachyon
MARRGLMEQDLTKLDVAKLHPLSPEVISRQATINIGTIGHVAHGKSTVVKAISGVQTVRFKNELERNITIKLGYANAKIFKCEDDRCPRPMCYKAYGSGKEDTPICDVPGFENTRMKLLRHVSFVDCPGHDILMATMLNGAAIMDGALLLIAANESCPQPQTSEHLAAVEIMRLQHLIILQNKIDLIQESAAMNQHEAIQKFIQGTIAEGAPVVPISAQLKYNIDVICEYIVKKIPIPERNFTSPPNMIVIRSFDVNKPGSEVDDIRGGVAGGSILRGVLRVNQNIEVRPGIVMKDESGNIKCTPIYSRIVSLYAEQNELQFAVPGGLIGVGTTMDPTLTRADRLVGQVLGEIGSLPDVFVELEINFFLLRRLLGVRTKGTEKAGKVSKLTKGEILMLNIGSMSTGARVVAVKNDLAKLQLTAPVCTSKGEKVALSRRVEKHWRLIGWGQIQAGATLEVPPCPL

SEQ ID NO: 17383 - protein, 464 aa, Musa acuminata
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPPCDVPGFENTRMKLLRHVSFVDCPGHDILMATMLNGAAIMDGALLLIAGNESCPQPQTSEHLAAVEIMRLQHIIILQNKIDLIQESAAINQHEAIQKFIQGTIADGAPVVPISAQLKYNIDVVCEYLVKKIPIPERNFISPPNMIVIRSFDVNKPGSEVDEIKGGVAGGSILRGVLKVNQFIEVRPGIVVKDESGNIKCTPIYSRIVSLYAEQNELQFAVPGGLIGVGTTMDPTLTRADRLVGQVLGEVGSLPDVFVELEVNFFLLRRLLGVRTKGTEKQGKVSKLTKGEILMLNIGSMSTGARVVAVKNDLAKLQLTAPVCTSKGEKIALSRRVEKHWRLIGWGQIQAGGTLEVPPCPI

SEQ ID NO: 17384 - protein, 451 aa, Triticum aestivum
LDVTKLHPLSPEVISRQATINIGTIGHVAHGKSTVVKAISGVQTVRFKNELERNITIKLGYANAKIYKCEDDRCPRPMCYKAYGSGKEDTPACDVPGFENTRMKLLRHVSFVDCPGHDILMATMLNGAAIMDGALLLIAANESCPQPQTSEHLAAVEIMRLQHLIILQNKIDLIQESAAMNQHEAIQKFIQGTIAEGAPVVPISAQLKYNIDVICEYIIKKIPIPERNFTSPPNMIVIRSFDVNKPGSEVDEIRGGVAGGSILRGVLRVNQNIEVRPGIVMKDESGNIKCTPIYSRIVSLYAEQNELQFAVPGGLIGVGTTMDPTLTRADRLVGQVLGEIGSLPDVFVELEINFFLLRRLLGVRTKGTEKAGKVSKLTKGEILMLNIGSMSTGARVVAVKNDLAKLQLTAPVCTSKGEKVALSRRVEKHWRLIGWGQIQAGATLEVPPCPL

SEQ ID NO: 17385 - protein, 464 aa, Cocos nucifera
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENTRMKLLRHVSFVDCPGHDILMATMLNGAAIMDGALLLIAGNESCPQPQTSEHLAAVEIMRLQHIIILQNKIDLIQESVAINQHEAIQKFIQGTIADGAPVVPISAQLKYNIDVVCEYIVNKIPIPERNFTSPPNMIVIRSFDVNKPGSEVDEIKGGVAGGSILRGVLKVNQYIEVRPGIVIKDESGNIKCTPIYSRIVSLYAEQNELQFAVPGGLIGVGTTMDPTLTRADRLVGQVLGEVGTLPDVFVELEVNFFLLRRLLGVRTKGTEKQGKVSKLAKGEILMLNIGSMSTGARVIAVKNDLAKLQLTAPVCTSKGEKVALSRRVEKHWRLIGWGQIQAGVTLDVPPCSI

SEQ ID NO: 17386 - protein, 464 aa, Panicum virgatum
MARRGLMEQDLSKLDVTKLHPLSPEVISRQATINIGTIGHVAHGKSTVVKAISGVQTVRFKNELERNITIKLGYANAKIYKCEDDKCPRPMCYKAYGSGKEDSPLCDVPGFENCRMKLLRHVSFVDCPGHDILMATMLNGAAIMDGALLLIAANESCPQPQTSEHLAAVEIMRLQHIIILQNKIDLIQESAAMNQHEAIQKFIQGTIAQGAPVVPISAQLKYNIDVICEYIVKKIPIPERNFISPPNMIVIRSFDVNKPGSEVDEIKGGVAGGSILKGVLRVNQKIEVRPGIVMKDEHGKLKCTPIYSRIVSLYAEQNELQFAVPGGLIGVGTTMDPTLTRADRLVGQVLGEVGSLPDVYIELEVNFFLLRRLLGVRTSGTERASRVSKLAKGEILMLNIGSMSTGARVLAVKNDLAKLQLTAPVCTSKGEKLALSRRIEKHWRLIGWGTIQAGTTLDVPPCPL

SEQ ID NO: 17387 - protein, 464 aa, Echinochloa colona
MARRGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENCRMKLLRHVSFVDCPGHDILMATMLNGAAIMDGALLLIAANESCPQPQTSEHLAAVEIMRLQHIIILQNKIDLIQESAAMNQHEAIQKFIQGTIAQGAPVVPISAQLKYNIDVICEYIVKKIPIPERNFISPPNMIVIRSFDVNKPGSEVNEIKGGVAGGSILKGVLRVNQKIEVRPGIVMKDEHGKLKCTPIYSRIVSLYAEQNELQFAVPGGLIGVGTTMDPTLTRADRLVGQVLGEVGSLPDVYIELEVNFFLLRRLLGVRTSGTERASRVSKLAKGEILMLNIGSMSTGARVVAVKNDLAKLQLTAPVCTSKGEKLALSRRIEKHWRLIGWGTIQAGTTLDVPPCPL

SEQ ID NO: 17388 - protein, 464 aa, Elaeis guineensis
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENTRMKLLRHVSFVDCPGHDILMATMLNGAAIMDGALLLIAGNESCPQPQTSEHLAAVEIMRLQHIIILQNKIDLIQESVAINQHEAIQKFIQGTIADGAPVVPISAQLKYNIDVVCEYIVNKIPIPERDFTSPPNMIVIRSFDVNKPGSEVDEIKGGVAGGSILRGVLKVNQYIEVRPGIVIKDESGNIKCTPIYSRIVSLYAEQNELQFAVPGGLIGVGTTMDPTLTRADRLVGQVLGEVGTLPDVFVELEVNFFLLRRLLGVRTKGSEKQGKVSKLAKGEILMLNIGSMSTGARVIAVKNDLAKLQLTAPVCTSKGEKVALSRRVEKHWRLIGWGQIQAGVTLDVPPCPF

SEQ ID NO: 17389 - protein, 464 aa, Gossypium hirsutum
  Sequence also found in Organisms: Gossypium raimondii
MSKKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPLCDVPGFENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFVSPPNMIVIRSFDVNKPGFEVDEIKGGVAGGSILRGVLKVNQFIEVRPGIVVKDESGNIKCTPIYSRIVSLYAEQNELQYAVPGGLIGVGTTMDPTLTRADRLVGQVLGEVGSLPEVYVELEVNFFLLRRLLGVRTKGSERQGKVSKLAKGEILMLNIGSMSTGARVIAVKNDLAKLQLTSPVCTSKGEKIALSRRVEKHWRLIGWGQIQAGTTLEVPPCPL

SEQ ID NO: 17390 - protein, 464 aa, Cocos nucifera
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENTRMKLLRHVSFVDCPGHDILMATMLNGAAIMDGALLLIAGNESCPQPQTSEHLAAVEIMRLQHIIILQNKIDLIQESVAINQHEAIQKFIQGTIADGAPVVPISAQLKYNIDVVCEYLVNKIPIPERNFTSPPNMIVIRSFDVNKPGSEVDEIKGGVAGGSILRGVLKVNEPIEVRPGIVIKDENGNIKCTPIYSRIVSLYAEQNELQFAVPGGLIGVGTTMDPTLTRADRLVGQVLGQVGSLPDVFVELEVNFFLLRRLLGVRTKGTEKQGKVSKLAKGEILMLNIGSMSTGARVIAVKNDLAKLQLTAPVCTSKGEKVALSRRVEKHWRLIGWGQIQAGVTLDVPPCSI

SEQ ID NO: 17391 - protein, 464 aa, Echinochloa colona
MARRGLMEQDLSKLDVTKLHPLSPEVISRQATINIGTIGHVAHGKSTVVKAISGVQTVRFKNELERNITIKLGYANAKIYICEDDRCPRPMCYKAYGSGKEDTPPCDVPGFENCRMKLLRHVSFVDCPGHDILMATMLNGAAIMDGALLLIAANESCPQPQTSEHLAAVEIMRLQHIIILQNKIDLIQESAAMNQHEAIQKFIQGTIAQGAPVVPISAQLKYNIDVICEYIVKKIPIPERNFISPPNMIVIRSFDVNKPGSEVNEIKGGVAGGSILKGVLRVNQKIEVRPGIVMKDEHGKLKCTPIYSRIVSLYAEQNELQFAVPGGLIGVGTTMDPTLTRADRLVGQVLGEVGSLPDVYIELEVNFFLLRRLLGVRTSGTERASRVSKLAKGEILMLNIGSMSTGARVVAVKNDLAKLQLTAPVCTSKGEKLALSRRIEKHWRLIGWGTIQAGTTLDVPPCPL

SEQ ID NO: 17392 - protein, 464 aa, Echinochloa colona
MARRGLMEQDLSKLDVTKLHPLSPEVISRQATINIGTIGHVAHGKSTVVKAISGVQTVRFKNELERNITIKLGYANAKIYICEDDRCPRPMCYKAYGSGKEDTPLCDVPGFENCRMKLLRHVSFVDCPGHDILMATMLNGAAIMDGALLLIAANESCPQPQTSEHLAAVEIMRLQHIIILQNKIDLIQESAAMNQHEAIQKFIQGTIAQGAPVVPISAQLKYNIDVICEYIVKKIPIPERNFISPPNMIVIRSFDVNKPGSEVNEIKGGVAGGSILKGVLRVNQKIEVRPGIVMKDEHGKLKCTPIYSRIVSLYAEQNELQFAVPGGLIGVGTTMDPTLTRADRLVGQVLGEVGSLPDVYIELEVNFFLLRRLLGVRTSGTERASRVSKLAKGEILMLNIGSMSTGARVVAVKNDLAKLQLTAPVCTSKGEKLALSRRIEKHWRLIGWGTIQAGTTLDVPPCPL

SEQ ID NO: 17393 - protein, 464 aa, Panicum virgatum
MARRGLMEQDLSTLDVFKLSPLSPEVISRQATINIGTIGHVAHGKSTVVKAISGVQTVRFKNELERNITIKLGYANAKIYKCEDDRCPRPMCYKAYGSGKEDSPLCDVPGFENCRMKLLRHVSFVDCPGHDILMATMLNGAAIMDGALLLIAANESCPQPQTSEHLAAVEIMRLQHIIILQNKIDLIQESAAMNQHEAIQKFIQGTIAQGAPVVPISAQLKYNVDVICEYIVKKIPIPERNFTSPPNMIVIRSFDVNKPGSEVDEIKGGVAGGSILKGVLRVNQKIEVRPGIVMKDENGKIKCTPIYSRIVSLYAEQNELQFAVPGGLIGVGTTMDPTLTRADRLVGQVLGEVGSLPDVYIELEVNFFLLRRLLGVRTSGTERASRVSKLAKGEILMLNIGSMSTGARVVAVKNDLAKLQLTAPVCTSKGEKLALSRRIEKHWRLIGWGTIQAGTTLDVPPCLL

SEQ ID NO: 17394 - protein, 464 aa, Gossypium hirsutum
  Sequence also found in Organisms: Gossypium raimondii
MSKKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPLCDVPGFENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFVSPPNMIVIRSFDVNKPGFEVDEIKGGVAGGSILRGVLKVNQFIEVRPGIVVKDESGNIKCTPIYSRIVSLYAEQNELQYAVPGGLIGVGTTMDPTLTRADRLVGQVLGEVGSLPEVYVELEVNFFLLRRLLGVRTKGSERQGKVSKLAKGEILMLNIGSMSTGARVIAVKNDLAKLQLTSPVCTSKGEKIALSRRVEKHWRLIGWGQIQAGTTIEVPPCPV

SEQ ID NO: 17395 - protein, 464 aa, Setaria italica
MARRGLMEQDLSRLDVATLHPLSPEVISRQATINIGTIGHVAHGKSTVVKAISGVQTVRFKNELERNITIKLGYANAKIYKCEDDRCPRPMCYKAYGSGKEDSPLCDVPGFENCRMKLLRHVSFVDCPGHDILMATMLNGAAIMDGALLLIAANESCPQPQTSEHLAAVEIMRLQHIIILQNKIDLIQESAAMNQHEAIQKFIQGTIAQGAPVVPISAQLKYNIDVICEYIVKRIPIPERNFTSPPNMIVIRSFDVNKPGSEVDEIKGGVAGGSILKGVLRVNQRIEVRPGIVMKDEHGKLKCTPIYSRIVSLYAEQNELQFAVPGGLIGVGTTMDPTLTRADRLVGQVLGEVGSLPDVYIELEVNFFLLRRLLGVRTSGTERASRVSKLAKGEILMLNIGSMSTGARVVAVRNDLAKLQLTAPVCTSKGEKLALSRRIEKHWRLIGWGTIQAGNTLEVPPCPL

SEQ ID NO: 17396 - protein, 464 aa, Amorphophallus konjac
MSRKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPLCDVPGFENTRMKLLRHVSFVDCPGHDILMATMLNGAAIMDGALLLIAGNESCPQPQTSEHLAAVEIMRLKHIIILQNKIDLIQESVAINQHEAIQNFIQGTIADGAPVVPISAQLKYNIDVVCEYLVNKIPIPDRNFVAPPNMIVIRSFDVNKPGFEVDEIKGGVAGGSILRGVLKVNQFIEVRPGIVVKDESGNIKCTPIYSRIVSLYAEQNELQFAVPGGLIGVGTTMDPTLTRADRLVGQVLGEVGSLPDVFVELEVNFFLLRRLLGVRTKGTEKQGKVSKLAKGEILMLNIGSMSTGARVVAVRNDLAKLQLTAPVCTSRGEKVALSRRVEKHWRLIGWGQIQAGVTLDVPPCPI

SEQ ID NO: 17397 - protein, 464 aa, Fagus grandifolia
MSRKGLMEQDLTKLDVTKLHPLSPEVISRQATINIGTIGHVAHGKSTVVKAISGVQTVRFKNELERNITIKLGYANAKIYKCEEERCPRPMCYKAYGSGKEDNPLCDVPGFENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFVSPPNMIVIRSFDVNKPGFEVDEIRGGVAGGSILRGVLKVNQFIEVRPGIVVKDESGNIRCTPIYSRIVSLYAEQNELQFAVPGGLIGVGTTMDPTLTRADRLVGQVLGEVGSLPEVFVELEVNFFLLRRLLGVRTKGTERQGKVSKLTKQEILMLNIGSMSTGARVVAVKNDLAKLQLTSPVCTSRGEKIALSRRVEKHWRLIGWGQIQAGTTLEVPPCPI

SEQ ID NO: 17398 - protein, 464 aa, Gossypium hirsutum
MSKKGLMEQDLSKLDVTKLHPLSPEVISRQATINIGTIGHVAHGKSTVVKAISGVQTVRFKNELERNITIKLGYANAKIYKCEDERCPRPMCYKAYGSAKEDSPLCDVPGFENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFVSPPNMIVIRSFDVNKPGFEVDEIKGGVAGGSILRGVLKVNQFIEVRPGIVVKDESGNIKCTPIYSRIVSLYAEQNELQYAVPGGLIGVGTTMDPTLTRADRLVGQVLGEVGSLPEVYVELEVNFFLLRRLLGVRTKGSERQGKVSKLAKGEILMLNIGSMSTGARVIAVKNDLAKLQLTSPVCTSKGEKIALSRRVEKHWRLIGWGQIQAGTTIEVPPCPV

SEQ ID NO: 17399 - protein, 464 aa, Cucumis sativus
MSRKGLMEQDLKKLDVTKLHPLSPEVISRQATINIGTIGHVAHGKSTVVKAISGVQTVRFKNELERNITIKLGYANAKIYKCEDDKCPRPACYKAYGSGKEDSPLCDVLGFENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFVSPPNMIVIRSFDVNKPGFEVDEIKGGVAGGSILRGVLKVNQFIEVRPGIVVKDESGNIKCTPIYSRIVSLYAEQNELQFAVPGGLIGVGTTMDPTLTRADRLVGQVLGEVGSLPDVYVELEVNFFLLRRLLGVRTKGSERQGKVSKLAKGEILMLNIGSMSTGARVVAVKNDLAKLQLTSPVCTSKGEKIALSRRVEKHWRLIGWGQIQAGSTLDVPPCPI

SEQ ID NO: 17400 - protein, 464 aa, Gossypium raimondii
MSRKGLMEQDLSKLDVTKLHPLSPEVISRQATINIGTIGHVAHGKSTVVKAISGVQTVRFKNELERNITIKLGYANAKIYKCEDERCPRPMSFKAYGSGKEDSPLCDVPGFENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFISPPNMIVIRSFDVNKPGFEVDEIKGGVAGGSILQGVLKVNQFIEVRPGIVVKDENGNIKCTPIYSRIVSLYAEQNELQFAVPGGLIGVGTTMDPTLTRADRLVGQVLGEVGSLPDVFVELEVNFFLLRRLLGVRTKGSERQGKVSKLAKGEILMLNIGSMSTGARVIAVKNDLAKLQLTSPVCTSKGEKIALSRRVEKHWRLIGWGQIQAGTTLEVPPCPL

SEQ ID NO: 17401 - protein, 464 aa, Vitis vinifera
MSRRGLMEQDLSKLDVTTLHPLSPEVISRQATINIGTIGHVAHGKSTVVKAISGVQTVRFKNELERNITIKLGYANAKIYKCEDERCPRPMCYKAYGSGKEDSPLCDVPGFENCRMKLLRHVSFVDCPGHDILMATMLNGAAIMDGALLLIAANESCPQPQTAEHLAAVEIMRLQHIIILQNKVDLIQENVAINQHEAIQKFIQGTVADGAPVVPISAQLKYNIDVVCEYIVKKIPIPERDFTSPPNMIVIRSFDVNKPGFEVDEIRGGVAGGSILRGVLKVNQFIEVRPGIVVKDENGNIKCTPIYSRIVSLYAEQNELQFAVPGGLIGVGTTMDPTLTRADRLVGQVLGEVGSLPDVFVELEVNFFLLRRLIGVRTKGTEKQGKVSKLTKGEILMLNIGSMSTGARVLAVRNDLAKLQLTSPVCTSRGEKIALSRRVEKHWRLIGWGQIQAGTTLDVPPSPI

SEQ ID NO: 17402 - protein, 464 aa, Tripterygium wilfordii
MSRKGLMEQDLKKLDVTKLHPLSPEVISRQATINIGTIGHVAHGKSTVVKAISGVQTVRFKNELERNITIKLGYANAKIYKCEDERCPRPMCYKAYGSGKEDNPQCDVPGFENCRMKLLRHVSFVDCPGHDILMATMLNGAAIMDGALLLIAANESCPQPQTSEHLAAVEIMRLQHIIILQNKVDLIQENVAINQHEAIQAFIQGTVADGAPVVPISAQLKYNIDVVCEYIVKKIPIPERNFVSPPNMIVIRSFDVNKPGFEVDDIKGGVAGGSILRGVLKVNQFIEVRPGIVLKDESGNIKCTPIYSRIVSLYAEQNELQFAVPGGLIGVGTTMDPTLTRADRLVGQVLGEVGSLPEVYVELEVNFFLLRRLLGVKTKGTERQGKVSKLAKGEILMLNIGSMSTGARVLAVKNDLAKLQLTSPVCTSKGEKIALSRRVEKHWRLIGWGQIQAGTTLEVPPCPL

SEQ ID NO: 17403 - protein, 464 aa, Citrullus lanatus
MSRKGLMEQDLKKLDVTKLHPLSPEVISRQATINIGTIGHVAHGKSTVVKAISGVQTVRFKNELERNITIKLGYANAKIYKCEDDKCPRPMCYKAYGSGKEDSPLCDVLGFENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFVSPPNMIVIRSFDVNKPGFEVDEIKGGVAGGSILRGVLKVNQFIEVRPGIVVKDESGNIKCTPIYSRIVSLYAEQNELQFAVPGGLIGVGTTMDPTLTRADRLVGQVLGEVGSLPDVFVELEVNFFLLRRLLGVRTKGSERQGKVSKLAKGEILMLNIGSMSTGARVLAVKNDLAKLQLTSPVCTSKGEKIALSRRVEKHWRLIGWGQIQAGTTLDVPPCPI

SEQ ID NO: 17404 - protein, 464 aa, Manihot esculenta
MSRKGLMEQDLSKLDVTKLHPLSPEVISRQATINIGTIGHVAHGKSTVVKAISGVQTVRFKNELERNITIKLGYANAKIYKCEDEKCPRPMCYKAYGSGKEDSPMCDVPGFENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFISPPNMIVIRSFDVNKPGFEVDEIKGGVAGGSIFRGVLKVNQFIEVRPGIVVKDETGNIKCTPIYTRIVSLYAEQNELQFAVPGGLIGVGTTMDPTLTRADRLVGQVLGDVGSLPEVFVELEVNFFLLRRLIGVRTKGTEKQGKVSKLAKGEILMLNIGSMSTGARVIAVKNDLAKLQLTSPVCTSKGEKIALSRRVEKHWRLIGWGMIQAGTTLDVPPCPL

SEQ ID NO: 17405 - protein, 464 aa, Gossypium hirsutum
MSRKGLMEQDLSKLDVTKLHPLSPEVISRQATINIGTIGHVAHGKSTVVKAISGVQTVRFKNELERNITIKLGYANAKIYKCEDERCPRPMSFKAYGSGKEDSPLCDVPGFENCRMKLLRHVSFVDCPGHDILMATMLNGAAIMDGALLLIAANESCPQPQTSEHLAAVEIMRLQYIIILQNKVDLIQENVAINQHEAIQKFIQGTVADGAPVVPISAQLKYNIDVVCEYIVKKIPIPERNFISPPNMIVIRSFDVNKPGFEVDEIKGGVAGGSILQGVLKVNQFIEVRPGIVVKDENGNIKCTPIYSRIVSLYAEQNELQFAVPGGLIGVGTTMDPTLTRADRLVGQVLGEVGSLPDVFVELEVNFFLLRRLLGVRTKGSERQGKVSKLAKGEILMLNIGSMSTGARVIAVKNDLAKLQLTSPVCTSKGEKIALSRRVEKHWRLIGWGQIQAGTTLEVPPCPL

SEQ ID NO: 17406 - protein, 464 aa, Euonymus alatus
MSRKGLMEQDLSKLDATKLHPLSPEVISRQATINIGTIGHVAHGKSTVVKAISGVQTVRFKNELERNITIKLGYANAKIYKCEDERCPRPMCYKAYGSGKEDNPPCDVPGFENCRMKLLRHVSFVDCPGHDILMATMLNGAAIMDGALLLIAANESCPQPQTSEHLAAVEIMRLQHIIILQNKVDLIQENVAINQNEAIQAFIQGTVADGAPVVPISAQLKYNIDVVCEYIVKRIPIPERNFISPPNMIVIRSFDVNKPGYEVDEIKGGVAGGSILRGVLKVNQFIEVRPGIVLKDESGNIKCTPIYSRIVSLYAEQNELQFAVPGGLIGVGTTMDPTLTRADRLVGQVLGEVGSLPEVYVELEVNFFLLRRLLGVKTKGTERQGKVSKLAKGEILMLNIGSMSTGARVLAVKNDLAKLQLTSPVCTSKGEKIALSRRVEKHWRLIGWGQIQAGTTLEVPPCPL

SEQ ID NO: 17407 - protein, 464 aa, Euonymus alatus
MSRKGLMEQDLSKLDATKLHPLSPEVISRQATINIGTIGHVAHGKSTVVKAISGVQTVRFKNELERNITIKLGYANAKIYKCEDERCPRPMSYKAYGSGKEDSPPCDVPGFENSRMKLLRHVSFVDCPGHDILMATMLNGAAIMDGALLLIAANESCPQPQTSEHLAAVEIMRLQHIIILQNKVDLIQENVAINQHEAIQGFIQGTVADGAPVVPISAQLKYNIDVVCEYIVKKIPIPERNFVSPPNMIVIRSFDVNKPGFEVDDIKGGVAGGSILRGVLKVNQFIEVRPGIVLKDESGNIKCTPIYSRIVSLYAEQNELQFAVPGGLIGVGTTMDPTLTRADRLVGQVLGEVGSLPEIYVELEVNFFLLRRLLGVKTKGTERQGKVSKLAKGEILMLNIGSMSTGARVLAVKNDLAKLQLTSPVCTSKGEKIALSRRVEKHWRLIGWGQIQAGTTLEVPPCPL

SEQ ID NO: 17408 - protein, 464 aa, Elaeis guineensis
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENTRMKLLRHVSFVDCPGHDILMATMLNGAAIMDGALLLIAGNESCPQPQTSEHLAAVEIMRLQHIIILQNKIDLIQESVAINQHEAIQKFIQGTIADGAPVVPVSAQLKYNIDVVCEYLVNKIPIPERDFTSPPNMIVIRSFDVNKPGSEVDEIKGGVAGGSILRGVLKVNEPIEVRPGIVVKDENGNIKCTPIYSRIVSLYAEQNELQFAVPGGLIGVGTTMDPTLTRADRLVGQVLGQVGSLPDVFVELEVNFFLLRRLLGVRTKGTEKQGKVSKLAKGEILMLNIGSMSTGARVIAVKNDLAKLQLTAPVCTSKKEKVALSRRVEKHWRLIGWGQIQAGATLDVPPCSI

SEQ ID NO: 17409 - protein, 464 aa, Cucumis melo
MSRKGLMEQDLKKLDVTKLHPLSPEVISRQATINIGTIGHVAHGKSTVVKAISGVQTVRFKNELERNITIKLGYANAKIYKCEDDKCPRPACYKAYGSGKEDSPLCDVLGFENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFVSPPNMIVIRSFDVNKPGFEVDEIKGGVAGGSILRGVLKVNQFIEVRPGIVVKDESGNIKCTPIYSRIVSLYAEQNELQFAVPGGLIGVGTTMDPTLTRADRLVGQVLGEVGSLPDVFVELEVNFFLLRRLLGVRTKGSERQGKVSKLAKGEILMLNIGSMSTGARVLAVKNDLAKLQLTSPVCTSKGEKIALSRRVEKHWRLIGWGQIQAGSTLDVPPCPI

SEQ ID NO: 17410 - protein, 464 aa, Amaranthus tuberculatus
MARKGLMDQDLRKLDVTKLHPLSPEVISRQATINIGTIGHVAHGKSTVVKAISGVQTVRFKNELERNITIKLGYANAKIYKCEDERCPRPMCYKAYGSGKEDSPMCDVPGFENARMKLLRHVSFVDCPGHDILMATMLNGAAIMDGALLLIAANESCPQPQTSEHLAAIEIMRLQHIIILQNKVDLIQENVAINQHEAIKKFVQGTVADNAPVVPISAQLKYNIDVVCEYIVKKIPIPERNFISPPNMIVIRSFDVNKPGFEVDEIRGGVAGGSILKGVLKVNQNIEVRPGIVVKDESGNVKCTPIYSRIVSLYAEQNELQFAVPGGLIGVGTTMDPTLTRADRLVGQVLGEVGSLPEVYVELEVNFFLLRRLLGVRTKGTEKQGKVTKLTKGEILMLNIGSMSTGARVLAVKNDLAKLQLTSPVCTSKGEKIALSRRVEKHWRLIGWGQIQAGITLDIPPCPL

SEQ ID NO: 17411 - protein, 464 aa, Malus domestica
MSRKGLMEQDLSKLDVTKLHPLSPEVISRQATINIGTIGHVAHGKSTVVKAISGVQTVRFKNELERNITIKLGYANAKIYICEDERCPRPMAYKAYGSGKEDAPLCDVPGFENCRMKLLRHVSFVDCPGHDILMATMLNGAAIMDGALLLIAANESCPQPQTSEHLAAVEIMRLQHIIILQNKVDLIQENVAINQHEAIRKFIQGTVADNAPVVPISAQLKYNIDVVCEYIVKKIPIPERNFISPPNMIVIRSFDVNKPGYEVDEIRGGVAGGSILRGVLKVNQFIEVRPGIVVKDESGNIKCTPIYSRIVSLYAEQNELQFAVPGGLIGVGTTMDPTLTRADRLVGQVLGEVGSLPEVFVELEVNFFLLRRLLGVRTKGSEKQGKVSKLVKGEILMLNIGSMSTGARVLAVRNDLAKLQLTSPVCTSKGEKIALSRRVEKHWRLIGWGQIQAGTTLDVPPCPI

SEQ ID NO: 17412 - protein, 464 aa, Aristolochia fimbriata
MSRKGLMEQDLSKLDVTKLHPLSPEVISRQATINIGTIGHVAHGKSTVVKAISGVQTVRFKNELERNITIKLGYANAKIYKCEDERCSRPMCYKAYGSGKEDSPLCDVPGFENARMKLLRHVSFVDCPGHDILMATMLNGAAIMDGALLLIASNESCPQPQTSEHLAAIEIMRLQHIIIVQNKIDLIQESVAINQHESIQKFIQGTIADGAPVVPISAQLKYNIDVVCEYIVKKIPIPVRDFTSAPNMIVIRSFDVNKPGSEVDEIKGGVAGGSILRGVLKVNQNVEVRPGIVVKDESGNIKCTPIYSRIVSLYAEQNELQFAVPGGLIGVGTTMDPTLTRADKLVGQVLGEVGSLPDVFVELEVNFFLLRRLLGVRTKGAEKQGKVSKLTKGEILMLNIGSMSTGARVIAVRNDLAKLQLTSPVCTRQGEKVALSRRVEKHWRLIGWGQIQAGVTLDVPPCPL

SEQ ID NO: 17413 - protein, 464 aa, Theobroma cacao
MSRKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPLCDVPGFENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFVSPPNMIIIRSFDVNKPGFEVDEIKGGVAGGSILRGVLKVNQFIEVRPGIFHKDENGNIKAAPIYSRIVSLFAEQNELQFAVPGGLIGVGTTMDPTLTRADRLVGQVLGEVGSLPEVFVELEVNFFLLRRLLGVRTKGSERQGKVSKLAKGEILMLNIGSMSTGARVIAVKNDLAKLQLTSPVCTSKGEKIALSRRVEKHWRLIGWGQIQAGTTLEVPPCPL

SEQ ID NO: 17414 - protein, 464 aa, Chenopodium quinoa
MARKGLMEQDLSKLDVTKLHPLSPEVISRQATINIGTIGHVAHGKSTVVKAISGVQTVRFKNELERNITIKLGYANAKIYKCDDDRCPRPMCYKAYGSGKEDTPMCDVPGFENARMKLLRHVSFVDCPGHDILMATMLNGAAIMDGALLLIAANESCPQPQTSEHLAAIEIMRLQHIIILQNKVDLIQENVAINQHEAIQKFVQGTVADGAPVVPISAQLKYNIDVVCEYIVKKIPIPERNFVSPPNMIVIRSFDVNKPGYEVDDIRGGVAGGSILKGVLRINQNIEVRPGIVVKDDSGNIKCTPIYSRIVSLFAEQNELQFAVPGGLIGVGTTMDPTLTRADRLVGQVLGEVGSLPDVYVELEVNFFLLRRLLGVRTKGTEKQGKVTKLTKAEILMLNIGSMSTGARVVAVKNDLAKLQLTSPVCTSKGEKIALSRRVEKHWRLIGWGQIQAGITLEIPPCPL

SEQ ID NO: 17415 - protein, 464 aa, Fragaria vesca
MSRKGLMEQDLSKLDVTTLHPLSPEVISRQATINIGTIGHVAHGKSTVVKAISGVQTVRFKNELERNITIKLGYANAKIYKCEDEKCPRPSCYKAYGSGKEDAPLCDVAGFENCRMKLLRHVSFVDCPGHDILMATMLNGAAIMDGALLLIAANESCPQPQTSEHLAAVEIMRLQHIIILQNKVDLIQENVAINQHEAIRKFIEGTVADGAPVVPISAQLKYNIDVVCEYIVKKIPIPERNFISPPNMIVIRSFDVNKPGFEVDEIRGGVAGGSILRGVLKVNQFIEVRPGIVVKDESGNIKCTPIYSRIVSLYAEQNELQFAVPGGLIGVGTTMDPTLTRADRLVGQVLGEVGSLPEVFVELEVNFFLLRRLLGVRTKGSEKQGKVSKLAKAEILMLNIGSMSTGARVIAVRNDLAKLQLTSPVCTSKGEKIALSRRVEKHWRLIGWGQIQAGTTLEVPPCPI

SEQ ID NO: 17416 - protein, 464 aa, Malus domestica
MSRKGLMEQDLSKLDVTKLHPLSPEVISRQATINIGTIGHVAHGKSTVVKAISGVQTVRFKNELERNITIKLGYANAKIYTCEDERCPRPMAYKAYGSGKEDAPLCDVPGFENCRMKLLRHVSFVDCPGHDILMATMLNGAAIMDGALLLIAANESCPQPQTSEHLAAVEIMRLQHIIILQNKVDLIQENVAINQHEAIRKFIQGTVADNAPVVPISAQLKYNIDVVCEYIVKKIPIPERNFISPPNMIVIRSFDVNKPGYEVDEIRGGVAGGSILRGVLKVNQFIEVRPGIVVKDESGNIKCTPIYSRIVSLYAEQNELQFAVPGGLIGVGTTMDPTLTRADRLVGQVLGEVGSLPEVFVELEVNFFLLRRLLGVRTKGSEKQGKVSKLVKGEILMLNIGSMSTGARVLAVRNDLAKLQLTSPVCTSKGEKIALSRRVEKHWRLIGWGQIQAGTTLDIPPCPI

SEQ ID NO: 17417 - protein, 464 aa, Ricinus communis
MSKKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPMCDVPGFENVRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFISPPNMIVIRSFDVNKPGFEVDEIKGGVAGGSIFRGVLKVNQFIEVRPGIVVKDETGNIKCTPIYTRIVSLYAEQNELQFAVPGGLIGVGTTMDPTLTRADRLVGQVLGDVGSLPEVFVELEVNFFLLRRLIGVRTKGSEKQGKVSKLAKGEILMLNIGSMSTGARVIAVKNDLAKLQLTSPVCTSKGEKIALSRRVEKHWRLIGWGMIQAGTTLDVPPCPL

SEQ ID NO: 17418 - protein, 464 aa, Vitis vinifera
MSRRGLMEQDLSKLDVTTLHPLSPEVISRQATINIGTVGHVAHGKSTVVKAISGVQTVRFKNELERNITIKLGYANAKIYKCEDERCPRPMCYKAYGSGKEDSPLCDVPGFENCRMKLLRHVSFVDCPGHDILMATMLNGAAIMDGALLLIAANESCPQPQTAEHLAAVEIMRLQHIIILQNKVDLIQENVAINQHEAIQKFIQGTVADGAPVVPISAQLKYNIDVVCEYIVKKIPIPERDFTSPPNMIVIRSFDVNKPGFEVDEIRGGVAGGSILRGVLKVNQFIEVRPGIVVKDENGNIKCTPIYSRIVSLYAEQNELQFAVPGGLIGVGTTMDPTLTRADRLVGQVLGEVGSLPDVFVELEVNFFLLRRLIGVRAKGTEKQGKVSKLTKGEILMLNIGSMSTGARVLAVRNDLAKLQLTSPVCTSRGEKIALSRRVEKHWRLIGWGQIQAGTTLDIPANPI

SEQ ID NO: 17419 - protein, 464 aa, Papaver somniferum
MARKGLMEQDLSKLDVTLLHPLSPEVISRQATINIGTIGHVAHGKSTVVKAISGVQTVRFKNELERNITIKLGYANAKIYKCEDERCPRPMCYKAYGSGKEDTPACDVPGFETAKMKLLRHVSFVDCPGHDILMATMLNGAAIMDGALLLIAANESCPQPQTSEHLAAVEIMRLQHIIILQNKVDLIQENVAINQHEAIQKFIQKTVADGAPVIPISAQLKYNIDVVCEYIVKRIPIPERNFISPPNMIVIRSFDVNKPGSEVDEIKGGVAGGSILRGVLRVNQFIEVRPGIVLKDESGAIKCTPIYSRIVSLFAEQNELQFAVPGGLIGVGTTMDPTLTRADRLVGQVLGEVGSLPDVFVELEVNFFLLRRLLGVRTKGTERQGKVSKLAKGEILMLNIGSMSTGARVLAVKNDLAKLQLTSPVCTSKGEKVALSRRVEKHWRLIGWGQIQAGSTLEVPPCPI

SEQ ID NO: 17420 - protein, 464 aa, Papaver somniferum
MARKGLMEQDLSKLDVTLLHPLSPEVISRQATINIGTIGHVAHGKSTVVKAISGVQTVRFKNELERNITIKLGYANAKIYKCEDERCPRPMCYKAYGSGKEDTPACDVPGFETAKMKLLRHVSFVDCPGHDILMATMLNGAAIMDGALLLIAANESCPQPQTSEHLAAVEIMRLQHIIILQNKVDLIQENVAINQHEAIQKFIQKTVADGAPVIPISAQLKYNIDVVCEYIVKRIPIPERNFISPPNMIVIRSFDVNKPGSEVDEIKGGVAGGSILRGVLRVNQFIEVRPGIVLKDESGTIKCTPIYSRIVSLFAEQNELQFAVPGGLIGVGTTMDPTLTRADRLVGQVLGEVGSLPDVFVELEVNFFLLRRLLGVRTKGTERQGKVSKLAKGEILMLNIGSMSTGARVLAVKNDLAKLQLTSPVCTSKGEKVALSRRVEKHWRLIGWGQIQAGSTLEVPPCPI

SEQ ID NO: 17421 - protein, 464 aa, Tripterygium wilfordii
MSRKGLMEQDLSKLDVTKLHPLSPEVISRQATINIGTIGHVAHGKSTVVKAISGVQTVRFKNELERNITIKLGYANAKIYKSEDERCPRPMCYKAYGSGKEDNPPCDVPGFENCRMKLLRHVSFVDCPGHDILMATMLNGAAIMDGALLLIAANESCPQPQTSEHLAAVEIMRLQHIIILQNKVDLIQENVAINQNEAIQLFIQGTVADGAPVVPISAQLKYNIDVVCEYIVKKIPIPERNFISPPNMIVIRSFDVNKPGFEVDEIKGGVAGGSILRGVLKVNQFIEVRPGIVLKDENGNIKCTPIYSRIVSLYTEQNELQFAVPGGLIGVGTTMDPTLTRGDRLVGQVLGEVGSLPEVYVELEVNFFLLRRLLGVKTKGTERQGKVAKLAKGEILMLNIGSMSTGARVLAVKNDLAKLQLTSPVCTSKGEKIALSRRVEKHWRLIGWGQIQAGTTLEVPPCPL

SEQ ID NO: 17422 - protein, 465 aa, Aquilegia formosa
MASRKGLMEQDLSKLDVTQLHPLSPEVISRQATINIGTIGHVAHGKSTVVKAISGVQTVRFKNELERNITIKLGYANAKIYKCEDEKCPRPMCYKAYGSGKEDSPYCDVPGFENARMKLLRHVSFVDCPGHDILMATMLNGAAIMDGALLLIAANESCPQPQTSEHLAAVEIMRLQHIIILQNKVDLVQENAAINQHEAIQKFIQKTVADGAPVVPISAQLKYNIDVVCEYIVKRIPIPERNFISPPNMIVIRSFDVNKPGYEVDDIKGGVAGGSILRGVLKVNQYIEVRPGIVVKDESSNIKCTPIYSRIVSLFTEQNELQFAVPGGLIGVGTTMDPTLTRADRLVGQVLGEVGSLPDVFVELEVNFFLLRRLLGVRTKGTERQGKVAKLTKGEILMLNIGSMSTGAKVIAVKNDLAKLQLTSPVCTSKGEKVALSRRVEKHWRLIGWGQIQAGSTLEVPPCPI

SEQ ID NO: 17423 - protein, 464 aa, Cirsium arvense
MSRKGLMEQDLSKLDVTQLHPLSPEVISRQATINIGTIGHVAHGKSTVVKAISGVQTVRFKNELERNITIKLGYANAKIYKCEDERCPRPMCYKAYGSGKEDSPLCDVPGFENAKMTLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGSEVDEIRGGVAGGSILKGVLKVNQNIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTERQGKVSKLAKGEILMLNIGSMSTGARVLAVKNDLAKLQLTSPVCTSKGEKIALSRRVEKHWRLIGWGQIQAGLTLEIPPCPI

SEQ ID NO: 17424 - protein, 464 aa, Panax ginseng
MSRKGLMEQDLSKLDVTKLHPLSPEVISRQATINIGTIGHVAHGKSTVVKAISGVQTVRFKNELERNITIKLGYANAKIYKCEDERCPRPMSYKAYGSGKEDAPLCDVPGFENARMNLLRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIVKRIPIPERNFISPPNMIVIRSFDVNKPGFEVDEIRGGVAGGSILKGVLKVNQYIEVRPGIVVKDESGNIKCTPIYSRIVSLYAEQNELQFAVPGGLIGVGTTMDPTLTRADRLVGQVLGEVGSLPEVYVELEVNFFLLRRLLGVRTKGTERQGKVSKLAKGEILMLNIGSMSTGARVLAVRNDLAKLQLTSPVCTSKGEKIALSRRVEKHWRLIGWGQIQAGTTLDVPPSPI

SEQ ID NO: 17425 - protein, 464 aa, Tragopogon dubius
MSRKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPLCDVPGFENSKMTLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGSEVDEIRGGVAGGSILKGVLKVNQFIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTERQGKVSKLTKSEILMLNIGSMSTGARVLAVKNDLAKLQLTSPVCTSKGEKIALSRRVEKHWRLIGWGQIQAGLTLEIPPCPI

SEQ ID NO: 17426 - protein, 466 aa, Glycine max
MSRKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAINQHEAISKFIQGTVADGAPVVPISAQLKYNIDVVCEYIVKKIPIPERNFVSPPNMIVIRSFDVNKPGYEVDEIKGGVAGGSILRGVLKVNQFIEVRPGIVVKDESGNIRCTPIYSRIVSLYAEQNELQFAVPGGLIGVGTTMDPTLTRADRLVGQVLGEVGSLPEVFVELEVNFFLLRRLLGVRTKGSERQGKVSKLAKGEMLMLNIGSMSTGARVVAVKNDLAKLQLTSPVCTSKGEKIALSRRVEKHWRLIGWGQIQAGITLDVPPAPHLS

SEQ ID NO: 17427 - protein, 466 aa, Glycine max
MSRKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAINQHEAISKFIQGTVADGAPVVPISAQLKYNIDVVCEYIVKKIPIPERNFVSPPNMIVIRSFDVNKPGYEVDEIKGGVAGGSILRGVLKVNQFIEVRPGIVVKDESGNIRCTPIYSRIVSLYAEQNELQFAVPGGLIGVGTTMDPTLTRADRLVGQVLGEVGSLPEVFVELEVNFFLLRRLLGVRTKGSERQGKVSKLAKGEMLMLNIGSMSTGARVVAVKNDLAKLQLTSPVCTSKGEKIALSRRVEKHWRLIGWGQIQAGITLDVPPAPQLS

SEQ ID NO: 17428 - protein, 464 aa, Amsonia hubrichtii
MSRKGLMEQDLSKLDVTQLHPLSPEVISRQATINIGTIGHVAHGKSTVVKAISGVQTVRFKNELERNITIKLGYANAKIYKCEDERCPRPMCYKAYGSGKEDSPMCDVPGFENCRMKLLRHVSFVDCPGHDILMATMLNGAAIMDGALLLIAANESCPQPQTSEHLAAVEIMRLQHIIILQNKVDLVQENVAINQHEAIQKFIQGTVADGAPVVPISAQLKYNIDVVCEYIVKKIPIPERNFVSPPNMIVIRSFDVNKPGFEVDEIKGGVAGGSILKGVLKVNQYIEVRPGIVVKDENGNIKCTPIYSRIVSLYAEQNELQFAVPGGLIGVGTTMDPTLTRADRLVGQVLGEVGSLPEVFVELEVNFFLLRRLLGVRTKDTERQGKVSKLAKGEILMLNIGSMSTGARVIAVKNVFAKLQLTSPVCTSKGEKIALSRRIEKHWRLIGWGQIQAGTTLDVPPCPI

SEQ ID NO: 17429 - protein, 465 aa, Daucus carota
MSRKGLMEQDLSKLDVTTLHPLSPEVISRQATINIGTIGHVAHGKSTVVKAISGVQTVRFKNELERNITIKLGYANAKIYKCEDDRCPRPMCYKAYGSGKEDAPMCDVPGFENARMKLLRHVSFVDCPGHDILMATMLNGAAIMDGALLLIAANESCPQPQTSEHLAAIEIMRLQHIIILQNKVDLIQENVAINQHEAIQKFIQGTVADNAPVIPVSAQLKYNIDAVCEYIVKKIPIPERNFISPPNMIVIRSFDVNKPGSEVDDIRGGVAGGSILKGVLRVNQNIEVRPGIVVKDESGNIKCTPIYSRIVSLYAEQNELQFAVPGGLIGVGTTMDPTLTRADRLVGQVLGEVGSLPEVYVELEVNFFLLRRLLGVRTKGTERQGKVAKLTKAEILMLNIGSMSTGARVVAVKNDLAKLQLTSPVCTSKGEKIALSRRVEKHWRLIGWGQIQAGTTLDIPPFPTF

SEQ ID NO: 17430 - protein, 464 aa, Chelidonium majus
MARKGLMEQDLAKLDVAKLHPLSPEVISRQATINIGTIGHVAHGKSTVVKAISGVQTVRFKNELERNITIKLGYANAKIYKCEDDRCPRPSCYKAYGSGKEDAPLCDVPGFENARMKLLRHVSFVDCPGHDILMATMLNGAAIMDGALLLIAANESCPQPQTSEHLAAVEIMRLQHIIILQNKVDLIQENVAINQHESIQKFIQKTVADGAPVIPISAQLKYNIDVVCEYLVKKIPIPERNFISPPNMIVIRSFDVNKPGSEVDEIKGGVAGGSILRGVLKVNQFIEVRPGIVVKDETGNIKCTPIYSRIVSLYAEQNELQFAVPGGLIGVGTTMDPTLTRADRLVGQVLGEVGSLPDVFVELEVNFFLLRRLLGVRTKGTERQGKVSKLAKGEILMLNIGSMSTGARVIAVKNDLAKLQLTSPVCTSKGEKVALSRRVEKHWRLIGWGQIQAGATLEVPPCPI

SEQ ID NO: 17431 - protein, 466 aa, Vigna unguiculata
MSRKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAINQHEAISKFIQGTVADGAPVVPISAQLKYNIDVVCEYIVKKIPIPERNFVSPPNMIVIRSFDVNKPGFEVDEIKGGVAGGSILRGVLKVNQFIEVRPGIVVKDESGNIRCTPIYSRIVSLYAEQNELQFAVPGGLIGVGTTMDPTLTRADRLVGQVLGEVGSLPEVFVELEVNFFLLRRLLGVRTKGSERQGKVSKLTKGEMLMLNIGSMSTGARVIAVKNDLAKLQLTSPVCTSKGEKIALSRRVEKHWRLIGWGQIQAGITLDVPPAPHLS

SEQ ID NO: 17432 - protein, 464 aa, Euphorbia peplus
MSRKGLMEQDLSKLDVTKLHPLSPEVISRQATINIGTIGHVAHGKSTVVKAISGVQTVRFKNELERNITIKLGYANAKIYKCEDERCSRPMCYKAYGSGKEDSPMCDVPGFENAKMKLLRHVSFVDCPGHDILMATMLNGAAIMDGALLLIAANESCPQPQTSEHLAAVEIMRLQHIIILQNKVDLIQENVAVNQHDTIQKFIQGTVADGAPVVPISAQLKYNIDVVCEYIVKKIPIPERNFISPPNMIVIRSFDVNKPGFEVDEIKGGVAGGSIFRGVLKVNQNIEVRPGIVVKDESGNIKCTPIYTRIVSLYAEQNELQFAVPGGLIGVGTTMDPTLTRADRLVGQVLGDVGSLPEVFVELEVNFFLLRRLIGVRTKGSEKQGKVAKLAKTEILMLNIGSMSTGARVIAVKNDLAKLQLTSPVCTSKGEKIALSRRVEKHWRLIGWGMIQAGTTLEVPPCPL

SEQ ID NO: 17433 - protein, 464 aa, Quercus alba
MSRKGLMEQDLSKLDVTTLHPLSPEVISRQATINIGTIGHVAHGKSTVVKAISGVQTVRFKNELERNITIKLGYANAKIYKCEEERCPRPMCYKAYGSGKEDNPLCDVLGYENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERDFVSPPNMIVIRSFDVNKPGYEVDEIRGGVAGGSILRGVLKVNQFIEVRPGIVVKDESGGIKCTPIYSRIVSLYAEQNELQFAVPGGLIGVGTTMDPTLTRADRLVGQVLGEVGSLPEVFVELEVNFFLLRRLLGVRTKGTERQGKVTKLTKSEILMLNIGSMSTGARVMAVKNDLAKLQLTSPVCTSKGEKIALSRRVEKHWRLIGWGQIQAGTTLEIPPRPI

SEQ ID NO: 17434 - protein, 464 aa, Petroselinum crispum
MSRKGLMEQDLSKLDVTTLHPLSPEVISRQATINIGTIGHVAHGKSTVVKAISGVQTVRFKNELERNITIKLGYANAKIYKCEDERCPRPMCYKAYGSGKEDAPMCDVPDFENARMKLLRHVSFVDCPGHDILMATMLNGAAIMDGALLLIAANESCPQPQTSEHLAAIEIMRLQHIIILQNKVDLIQENVAINQHDAIQKFIQGTVADGAPVIPVSAQLKYNIDAVCEYIVKKIPIPERNFISPPNMIVIRSFDVNKPGSEVDDIRGGVAGGSILKGVLRVNQNIEVRPGIVVKDESGNIKCTPIYSRIVSLYAEQNELQYAVPGGLIGVGTTMDPTLTRADRLVGQVLGEVGSLPEVYVELEVNFFLLRRLLGVRTKGTERQGKVAKLAKAEILMLNIGSMSTGARVVAVKNDLAKLQLTSPVCTSKGEKIALSRRVEKHWRLIGWGQIQAGSTLDVPPCPI

SEQ ID NO: 17435 - protein, 466 aa, Trigonella foenum-graecum
MARRGLMEQDLSTLDVTKLHPLSPEVISRQATINIGTIGHVAHGKSTVVKAISGVQTVRFKNELERNITIKLGYANAKIYKCEDERCPRPMSYKAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAINQHEAIQKFIQGTVADSAPVVPISAQLKYNIDVVCEYIVKKIPIPERNFISPPNMIVIRSFDVNKPGYEVDEIKGGVAGGSILRGVLRVNQFIEVRPGIVVKDESGNIRCTPIYSRIVSLFAEQNELQFAVPGGLIGVGTTMDPTLTRADRLVGQVLGEVGSLPDVFVELEVNFFLLRRLLGVRTKGSERQGKVSKLAKAEMLMLNIGSMSTGARVVAVKNDLAKLQLTSPVCTSKGEKIALSRRVEKHWRLIGWGQIQAGITLEVPPAPLLS

SEQ ID NO: 17436 - protein, 468 aa, Phalaenopsis aphrodite
MSRKGLMEQDLSKLDVAKLHPLSPEVISRQATINIGTIGHVAHGKSTVVKAISGVQTVRFKNELERNITIKLGYANAKIYKCEDEKCPRPMCYKAYGSGKEDGPLCDVPGFENARMKLLRHVSFVDCPGHDILMATMLNGAAIMDGALLLIAGNESCPQPQTSEHLAAVEIMRLQHIIILQNKIDLIQESVALNQHEAIQKFIQGTIADGAPVVPISAQLRYNIDVVCEYLVNKIPIPVRNFTSPPNMIVIRSFDVNKPGSEVDEIKGGVAGGSILWGVLKVNQFIEVRPGIVMKDENGNIKCTPIYSRIVSLFAEQNELQFAVPGGLIGVGTTMDPTLTRADRLVGQVLGEVNSLPDVFVELEVNFFLLRRLLGVRTKGAEKQGKVAKLTKGEILMLNIGSMSTGARVIAVKNDLAKLQLTAPVCTSKGEKVALSRRVEKHWRLIGWGQIQAGATLQVPEAPKNLFG

SEQ ID NO: 17437 - protein, 464 aa, Amborella trichopoda
MSRKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPLCDVPGFENARMKLLRHVSFVDCPGHDILMATMLNGAAIMDGALLLIAANESCPQPQTSEHLAAVEIMRLQHIIILQNKIDLIQESVAINQHEAIQKFIQKTIADGAPVVPISAQLKYNVDVVCEYLINKIPVPERNFVDPPNMIVIRSFDVNKPGSEVEEIKGGVAGGSILRGVLKVNQKIEVRPGIVVKDENGNMKCTPIYSRIVSLYAEQNELQFAVPGGLIGVGTTMDPTLTRADRLVGQVLGDIGSLPDVFVELEVNFFLLRRLLGVRTKGTEKQGKVSKLTKAEILMLNIGSMSTGAKVVAVKNDLAKLQLTSPVCTSKGEKVALSRRIEKHWRLIGWGQIQAGLTLDVPPCLI

SEQ ID NO: 17438 - protein, 464 aa, Amborella trichopoda
MSRKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDTPLCDVPGFENARMKLLRHVSFVDCPGHDILMATMLNGAAIMDGALLLIAANESCPQPQTSEHLAAVEIMRLQHIIILQNKIDLIQESVAINQHDAIQKFIQQTIADGAPVVPISAQLKYNIDVVCEYLVHKIPVPERNFVAPPNMIVIRSFDVNKPGSEVEEIKGGVAGGSILSGVLRVNQKIEVRPGIVVKDENGNMKCTPIYSRIVSLFAEQNELQFAVPGGLIGVGTTMDPTLTRADRLVGQVLGEVGSLPDVFVELEVNFFLLRRLLGVRTKGTEKQGKVSKLAKAEILMLNIGSMSTGAKVLAVKNDLAKLQLTSPVCTSKGEKVALSRRIEKHWRLIGWGQIQAGATLDVPPCPI

SEQ ID NO: 17439 - protein, 464 aa, Centaurea maculosa
  Sequence also found in Organisms: Cirsium arvense
MSRKGLMEQDLSKLDVAQLHPLSPEVISRQATINIGTIGHVAHGKSTVVKAISGVQTVRFKNELERNITIKLGYANAKIYKCEDERCPRPMCYKAYGSGKEDAPLCDVPGFENSKMTLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGSEVDEIRGGVAGGSILKGVLKVNQNIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTERQGKVSKLAKGEILMLNIGSMSTGARVLAVKNDLAKLQLTSPVCTSKGEKIALSRRVEKHWRLIGWGQIQAGLTLEIPPCPI

SEQ ID NO: 17440 - protein, 466 aa, Cicer arietinum
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDNPLCDVPGFENCKMKLLRHVSFVDCPGHDILMATMLNGAAIMDGALLLIAANESCPQPQTSEHLAAVEIMRLQHMIILQNKVDLIQENVAINQHEAIQKFIQGTVADGAPVVPISAQLKYNIDVVCEYIVKKIPIPERNFISPPNMIVIRSFDVNKPGFEVDEIKGGVAGGSILRGVLRVNQFIEVRPGIVVKDESGNIKCTPIYSRIVSLYAEQNELQFAVPGGLIGVGTTMDPTLTRADRLVGQVLGEVGSLPDVFVDLEVNFFLLRRLLGVRTKGSERQGKVSKLAKGEMLMLNIGSMSTGARVIAVKNDLAKLQLTSPVCTSKGEKIALSRRVEKHWRLIGWGQIQAGITLYVPPAPILS

SEQ ID NO: 17441 - protein, 464 aa, Cichorium intybus
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENSKMTLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGSEVDEIRGGVAGGSILKGVLKVNQFIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTERQGKVSKLSKAEILMLNIGSMSTGARVLAVKNDLAKLQLTSPVCTSKGEKIALSRRVEKHWRLIGWGQIQAGLTLEIPPCPI

SEQ ID NO: 17442 - protein, 464 aa, Cichorium intybus
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENAKMTLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGSEVDEIRGGVAGGSILKGVLKVNQFIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTERQGKVSKLSKAEILMLNIGSMSTGARVLAVKNDLAKLQLTSPVCTSKGEKIALSRRVEKHWRLIGWGQIQAGLTLEIPPCPI

SEQ ID NO: 17443 - protein, 464 aa, Prunus persica
  Sequence also found in Organisms: Prunus mume
MSRKGLMEQDLSKLDVTKLHPLSPEVISRQATINIGTIGHVAHGKSTVVKAISGVQTVRFKNELERNITIKLGYANAKIYMCEDERCPRPMSYKAYGSGKEDTPLCDVPGFENCRMKLLRHVSFVDCPGHDILMATMLNGAAIMDGALLLIAANESCPQPQTSEHLAAVEIMRLQHIIILQNKVDLIQENVAINQHEAIRKFIQGTVADNAPVVPISAQLKYNIDVVCEYIVKKIPIPERNFISPPNMIVIRSFDVNKPGFEVDEIRGGVAGGSILRGVLKVNQYIEVRPGIVVKDESGNIKCTPIYSRIVSLYAEQNELQFAVPGGLIGVGTTMDPTLTRADRLVGQVLGEVGSLPEVFVELEVNFFLLRRLLGVRTKGSEKQGKVSKLAKGEILMLNIGSMSTGAKVIAVRNDLAKLQLTSPVCTSRGEKIALSRRVEKHWRLIGWGTIQAGTTLDVPPSPI

SEQ ID NO: 17444 - protein, 464 aa, Helianthus annuus
MARKGLMEQDLSKLDVATLHPLSPEVISRQATINIGTIGHVAHGKSTVVKAISGVQTVRFKNELERNITIKLGYANAKIYKCEDEKCPRPMCYKAYGSGKEDSPPCDVPGFENSKMKLVRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLRYNIDVVCEYIIKRIPIPERNFISPPNMIVIRSFDVNKPGSEVDEIRGGVAGGSILKGVLKVNQNIEVRPGIVVKDESGNIKCTPIYSRIVSLYAEQNELQYAVPGGLIGVGTTMDPMLTRADRLVGQVLGEVGSLPDVYVELEVNFFLLRRLLGVKTKGTEKQGKVSKLSKAEILMLNIGSMSTGARVLAVKNDLAKLQLTSPVCTSKGEKIALSRRVEKHWRLIGWGQIQAGLTLEIPPCPI

SEQ ID NO: 17445 - protein, 464 aa, Tabernaemontana elegans
MSRKGLMEQDLSKLDVTQLHPLSPEVISRQATINIGTIGHVAHGKSTVVKAISGVQTVRFKNELERNITIKLGYANAKIYKCDDERCPRPMCYKAYGSGKEDSPMCDVPGFENCRMKLLRHVSFVDCPGHDILMATMLNGAAIMDGALLLIAANESCPQPQTSEHLAAVEIMRLQHIIILQNKVDLVQENVAINQHEAIQKFIQGTVADGAPVIPISAQLKYNIDVVCEYIVKKIPIPERNFISPPNMIVIRSFDVNKPGFEVDEIRGGVAGGSILKGVLKVNQYIEVRPGIVVKDENGNIKCTPIYSRIVSLYAEQNELQFAVPGGLIGVGTTMDPTLTRADRLVGQVLGEVGSLPEVFVELEVNFFLLRRLLGVRTKDTERQGKVSKLAKGEILMLNIGSMSTGARVVAVKNVFAKLQLTSPVCTSKGEKIALSRRIEKHWRLIGWGQIQAGITLDVPPCPI

SEQ ID NO: 17446 - protein, 464 aa, Cycas rumphii
MSRRGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENTRMKLLRHVSFVDCPGHDILMATMLNGAAIMDGAQLLIASNESCPQPQTSEHLAAVEIMRLQHIIILQNKIDLIQESVAINQHEAIQKFIQGTIADGAPVVPISAQLKYNIDVVCEYITNKIPIPERNFVAPPNMIVIRSFDVNKPGAEVDEIKGGVAGGSILRGVLRVNQKIEVRPGIVVKDESGNIKCTPIFSRIISLYAEQNELQFAVPGGLIGVGTTIDPTLTRADRLVGQVLGEVGELPDVFVELEVNFFLLRRLLGVRTKGTEKQGKVSKLSKGEVLMLNIGSMSTGARVLAVKNDLAKLQLTSPVCTSKGEKMALSRRVEKHWRLIGWGQIQAGVMLDIPQGSI

SEQ ID NO: 17447 - protein, 464 aa, Amsonia hubrichtii
MSRKGLMEQDLSKLDVTQLHPLSPEVISRQATINIGTIGHVAHGKSTVVKAISGVQTVRFKNELERNITIKLGYANAKIYKCEDERCPRPMCYKAYGSGKEDSPMCDVPGFENCRMKLLRHVSFVDCPGHDILMATMLNGAAIMDGALLLIAANESCPQPQTSEHLAAVEIMRLQHIIILQNKVDLVQENVAINQHEAIQKFIQGTVADAAPVVPISAQLKYNIDVVCEYIVKKIPVPERNFISPPNMIVIRSFDVNKPGFEVDEIKGGVAGGSILKGVLKVNQKIEVRPGIVVKDENGNIKCTPIYSRIVSLYAEQNELQFAVPGGLIGVGTTMDPTLTRADRLVGQVLGEVGSLPEVFVELEVNFFLLRRLLGVRTKDTERQGKVSKLAKGEILMLNIGSMSTGARVIAVKNVFAKLQLTSPVCTSKGEKIALSRRIEKHWRLIGWGQIQAGTTLDVPPCPI

SEQ ID NO: 17448 - protein, 466 aa, Phaseolus vulgaris
MSRKGLMEQDLSKLDVTKLHPLSPEVISRQATINIGTIGHVAHGKSTVVKAISGVQTVRFKNELERNITIKLGYANAKIYKCEDERCSRPMCYKAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAINQHEAISKFIQGTVADGAPVVPISAQLKYNIDVVCEYIVKKIPIPERNFVSPPNMIVIRSFDVNKPGFEVDEIKGGVAGGSILRGVLKVNQFIEVRPGIVVKDESGNIRCTPIYSRIVSLYAEQNELQFAVPGGLIGVGTTMDPTLTRADRLVGQVLGEVGSLPEVFVELEVNFFLLRRLLGVRTKGSERQGKVSKLAKGEMLMLNIGSMSTGARVIAVKNDLAKLQLTSPVCTSKGEKIALSRRVEKHWRLIGWGQIQAGVTLDVPPAPHFS

SEQ ID NO: 17449 - protein, 464 aa, Castanea mollissima
MSRKGLMEQDLSKLDVTTLHPLSPEVISRQATINIGTIGHVAHGKSTVVKAISGVQTVRFKNELERNITIKLGYANAKIYKCEEERCPRPMCYKAYGSGKEDNPLCDVLGYENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERDFVSPPNMIVIRSFDVNKPGYEVDEIRGGVAGGSILRGVLKVNQFIEVRPGIVVKDESGGIKCTPIYSRIVSLYAEQNELQFAVPGGLIGVGTTMDPTLTRADRLVGQVLGEVGSLPEVFVELEVNFFLLRRLLGVRTRGTERQGKVTKLTKSEILMLNIGSMSTGARVMAVKNDLAKLQLTSPVCTSKGEKIALSRRVEKHWRLIGWGQIQAGTTLDIPPRPI

SEQ ID NO: 17450 - protein, 464 aa, Chrysanthemum coronarium
MAKKGLMEQDLSKLDVAKLHPLSPEVISRQATINIGTIGHVAHGKSTVVKAISGVQTVRFKNELERNITIKLGYANAKIYKCEDEKCPRPMCYKAYGSGKEDSPACDVPGFENSKMKLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGAEVEEIRGGVAGGSILKGVLKVNQNIEVRPGIVVKDESGNIKCTPIYSRIVSLFAEQNELQFAVPGGLIGVGTTMDPMLTRADRLVGQVLGEVGSLPDVYVELEVNFFLLRRLLGVKTKGTERQGKVSKLSKAEILMLNIGSMSTGARVLAVKNDLAKLQLTSPVCTSKGEKIALSRRVEKHWRLIGWGQIQAGLTLEIPPCPI

SEQ ID NO: 17451 - protein, 464 aa, Cichorium intybus
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENSKMTLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGSEVDEIRGGVAGGSILKGVLKVNQFIEVRPGIVVKDESGNIKCTPIYSRIVSLYAEQNELQFAVPGGLIGVGTTMDPMLTRADRLVGQVLGEVGSLPDVYVELEVNFFLLRRLLGVKTRGTERQGKVSKLSKAEILMLNIGSMSTGARVLAVKNDLAKLQLTSPVCTSKGEKIALSRRVEKHWRLIGWGQIQAGLTLEIPPCPI

SEQ ID NO: 17452 - protein, 466 aa, Trifolium pratense
MSRKGLMEQDLSKLDVTKLHPLSPEVISRQATINIGTIGHVAHGKSTVVKAISGVQTVRFKNELERNITIKLGYANAKIYKCEDERCPRPMSYKAYGSGKEDNPMCEVPGFENCKMKLLRHVSFVDCPGHDILMATMLNGAAIMDGALLLIAANESCPQPQTSEHLAAVEIMRLQHIIILQNKVDLIQENVAINQHEAIQKFIEGTVADGAPVVPISAQLKYNIDVVCEYIVKKIPIPERNFISPPNMIVIRSFDVNKPGFEVDEIKGGVAGGSILRGVLKVNQFIEVRPGIVVKDESGNIKCTPIYSRIVSLFAEQNELQFAVPGGLIGVGTTMDPTLTRADRLVGQVLGEVGSLPEVYVELEVNFFLLRRLLGVRTKGSERQGKVSKLVKAEMLMLNIGSMSTGARVVAVKNDLAKLQLTSPVCTSKGEKIALSRRVEKHWRLIGWGQIQAGITLEVPPAPVFS

SEQ ID NO: 17453 - protein, 464 aa, Actinidia deliciosa
MSRKGLMEQDLSKLDVKTLHPLSPEVISRQATINIGTIGHVAHGKSTVVKAISGVQTVRFKNELERNITIKLGYANAKIYKCEDERCPRPMSYKAFGSGKEDSPMCDVPGFENCRMKLLRHVSFVDCPGHDILMATMLNGAAIMDGALLLIAANESCPQPQTSEHLAAVEIMRLQHIIILQNKVDLIQENVAINQHEAIQKFIQGTVAGGAPVIPVSAQLKYNIDVVCEYIVKKIPIPERNFISPPNMIVIRSFDVNKPGFEVDEIRGGVAGGSILKGVLKVNQFIEVRPGIVVKDENGNIKCTPIYSRIVSLYAEQNELQFAVPGGLIGVGTTMDPTLTRADRFVGQVLGEVGSLPEIYVELEVNFFLLRRLLGVRTKGTERQGKVSKLVKGEILMLNIGSMSTGARVLAVRTDLAKLQLTSPVCTSKGEKIALSRRVEKHWRLIGWGQIQAGTTLDVPPCPI

SEQ ID NO: 17454 - protein, 464 aa, Lactuca sativa
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPQCDVPGFENSKMTLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGSEVDEIRGGVAGGSILKGVLKVNQFIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTERQGKVSKLAKAEILMLNIGSMSTGARVLAVKNDLAKLQLTSPVCTSKGEKIALSRRVEKHWRLIGWGQIQAGLTLEIPPSPI

SEQ ID NO: 17455 - protein, 464 aa, Pseudotsuga menziesii
MSKKGLMEQDLNKLDVTKLHPLSPEVISRQATINIGTIGHVAHGKSTVVKAISGVQTVRFKNELERNITIKLGYANAKIYKCEDERCPRPMSYKAYGSGKEDSPLCDVPGFENTRMKLLRHVSFVDCPGHDILMATMLNGAAIMDGALLLIAGNESCPQPQTSEHLAAVEIMRLKHIIILQNKIDLIQESVAINQHEAIQKFIQGTIADGAPVVPISAQLKYNIDVVCEYIVNKIPIPERNFVAPPNMIVIRSFDVNKPGAEVDEIKGGVAGGSILRGVLKVNQKIEVRPGIVVKDESGNIKCTPIFSRIVSLYAEQNELQFAVPGGLIGVGTTIDPTLTRADRLVGQVLGEVGELPDVFVELEVNFFLLRRLLGVRTKGTEKQGKVSKLAKGEVLMLNIGSMSTGARVLAVKNDLAKLQLTSPVCTSKGEKMALSRRVEKHWRLIGWGQIQAGAMLEIPQAAI

SEQ ID NO: 17456 - protein, 464 aa, Silene vulgaris
MARKGLMEQDLRKLDVTKLHPLSPEVISRQATINIGTIGHVAHGKSTVVKAISGVQTVRFKNELERNITIKLGYANAKIYKCEDERCPRPMSYKAYGSGKEDSPACDVPGFENCKMKLLRHVSFVDCPGHDILMATMLNGAAIMDGALLLIAANESCPQPQTSEHLAAIEIMRLQHIIILQNKVDLVQENVAINQHEAIQKFVQGTVADAAPVVPISAQLKYNIDVVCEYIVKKIPIPERNFISPPNMIVIRSFDVNKPGYEVDDIRGGVAGGSILKGVLRVNQNIEVRPGIVVKDENGNIKCTPIYSRIVSLFADQNELQFAVPGGLIGVGTTMDPTLTRADRLVGQVLGEVGSLPDVFVELEVNFFLLRRLLGVRTKGTEKQGKVTKLTKAEILMLNIGSMSTGARVIAVKNDLAKLQLTSPVCTSKGEKIALSRRVEKHWRLIGWGQIQAGTTLEIPACPI

SEQ ID NO: 17457 - protein, 464 aa, Valeriana officinalis
MARKGLMEQDLSKLDVTLLHPLSPEVISRQATINIGTIGHVAHGKSTVVKAISGVQTVRFKNELERNITIKLGYANAKIYKCEDEKCPRPMCYKAYGSGKEDSPMCDVPGFENSRMKLLRHVSFVDCPGHDILMATMLNGAAIMDGALLLIAANESCPQPQTSEHLAAVEIMRLQHIIILQNKVDLIQENVAINQHESIQKFIEGTVADGAPVIPVSAQLKYNIDVVCEYITKRIPIPERNFISPPNMIVIRSFDVNKPGSEVDEVRGGVAGGSILKGVLKVDQFIEVRPGIVVKDESGNIKCTPIYSRIISLFAEQNELQFAVPGGLIGVGTTMDPTLTRADRLVGQVLGEVGSLPEVYVELEVNFFLLRRLLGVRTKGTERQGKVTKLAKAEILMLNIGSMSTGARVVAVKNDLAKLQLTSPVCTSKGEKIALSRRVEKHWRLIGWGQIQAGLTLEVPPCPI

SEQ ID NO: 17458 - protein, 464 aa, Ambrosia trifida
MARKGLMEQDLSKLDVAALHPLSPEVISRQATINIGTIGHVAHGKSTVVKAISGVQTVRFKNELERNITIKLGYANAKIYKCEDEKCPRPMCYKAYGSGKEDSPPCDVPGFENSKMKLMRHVSFVDCPGHDILMATMLNGAAIMDGALLLIAANESCPQPQTSEHLAAVEIMRLQHIIILQNKVDLIQENVAINQHDAIQQFIQGTVADGAPVIPVSAQLRYNIDVVCEYIIKRIPIPERNFISPPNMIVIRSFDVNKPGSEVDEIRGGVAGGSILKGVLKVNQHIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTEKQGKVSKLSKAEILMLNIGSMSTGARVLAVKNDLAKLQLTAPVCTSKGEKIALSRRVEKHWRLIGWGQIQAGVTLDIPPCPI

SEQ ID NO: 17459 - protein, 464 aa, Arnica chamissonis
MARKGLMEQDLSKLDVATLHPLSPEVISRQATINIGTIGHVAHGKSTVVKAISGVQTVRFKNELERNITIKLGYANAKIYKCEDEKCPRPMCYKAYGSAKEDNPLCDVPGFENSKMKLMRHVSFVDCPGHDILMATMLNGAAIMDGALLLIAANESCPQPQTSEHLAAVEIMRLQHIIILQNKVDLIQENVAMNQQEAIQKFIQGTVADGAPVIPVSAQLRYNIDVVCEYIIKRIPIPERNFISPPNMIVIRSFDVNKPGSEVDEIRGGVAGGSILKGVLKVNQHIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTEKQGKVSKLSKAEILMLNIGSMSTGARVVAVKNDLAKLQLTSPVCTSKGEKIALSRRVEKHWRLIGWGQIQAGLILEIPPCPI

SEQ ID NO: 17460 - protein, 466 aa, Phaseolus vulgaris
MSRKGLMEQDLSKLDVTKLHPLSPEVISRQATINIGTIGHVAHGKSTVVKAISGVQTVRFKNELERNITIKLGYANAKIYKCEDERCSRPMCYKAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAINQHEAISKFIQGTVADGAPVVPISAQLKYNIDVVCEYIVKKIPIPERNFISPPNMIVIRSFDVNKPGFEVDEIKGGVAGGSILRGVLKVNQFIEVRPGIVVKDESGNIRCTPIYSRIVSLYAEQNELQFAVPGGLIGVGTTMDPTLTRADRLVGQVLGEVGSLPEVFVELEVNFFLLRRLLGVRTKGSERQGKVSKLTKAEMLMLNIGSMSTGARVIAVRNDLAKLQLTSPVCTSKGEKIALSRRVEKHWRLIGWGQIQAGITLDVPPAPQFS

SEQ ID NO: 17461 - protein, 464 aa, Cannabis sativa
MSRKGLMEQDLGKLDVTKLHPLSPEVISRQATINIGTIGHVAHGKSTVVKAISGVQTVRFKNELERNITIKLGYANAKIYKCEDERCPRPMCYKAYGSGKEDSPLCDVPGFENARMKLLRHVSFVDCPGHDILMATMLNGAAIMDGALLLIAANESCPQPQTSEHLAAVEIMRLQHIIILQNKVDLIQENVAINQNEAIKKFIEGTVADGAPVVPISAQLKYNIDVVCEYIVKKIPIPERNFISPPNMIVIRSFDVNKPGFEVDDIKGGVAGGSILRGVLKVNQFIEVRPGIVVKDENGNTKCTPIYSRIVSLYAEQNELQYAVPGGLIGVGTTMDPTLTRADRLVGQVLGEVGSLPEVFVELEVNFFLLRRLLGVKTKGSEKQGRVTKLTKGEMLMLNIGSMSTGARVLAVKNDLAKLQLTSPVCTSKGEKIALSRRVEKHWRLIGWGQIQAGTTLDVPPCPI

SEQ ID NO: 17462 - protein, 466 aa, Citrus clementina
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDNPLCDVPGFENCRMKLLRHVSFVDCPGHDILMATMLNGAAIMDGALLLIAANESCPQPQTSEHLAAVEIMRLQHIIILQNKVDLIQENVAINQHEAIMKFIQGTVADGAPVVPISAQLKYNIDVVCEYIVKKIPIPERNFIDPPNMIVIRSFDVNKPGFEVDDIRGGVAGGSILRGVLKVNQFIEVRPGIVVKDESGNIKCTPIYSRIVSLFAEQNELQFAVPGGLIGVGTTMDPTLTRADRLVGQVLGEVGSLPEVFVELEVNFFLLRRLLGVRTKGSERQGKVSKLAKQEILMLNIGSMSTGARVLAVKNDLAKLQLTSPVCTSRGEKIALSRRVEKHWRLIGWGQIQAGTTLDVPASHPLQ

SEQ ID NO: 17463 - protein, 467 aa, Trifolium pratense
MATRRGLMEQDLSKLDVTKLHPLSPEVISRQATINIGTIGHVAHGKSTVVKAISGVQTVRFKNELERNITIKLGYANAKIYKCEDERCPRPMSYKAYGSGKEDNPMCDVPGFENSKMKLLRHVSFVDCPGHDILMATMLNGAAIMDGALLLIAANESCPQPQTSEHLAAVEIMRLQHIIILQNKVDLIQENVAINQHEAIQKFIQGTVADSAPVVPISAQLKYNIDVVCEYIVKKIPIPERNFISPPNMIVIRSFDVNKPGYEVDEIKGGVAGGSILRGVLRVNQFIEVRPGIVIKDESGNIRCTPIYSRIVSLFAEQNELQFAVPGGLIGVGTTMDPTLTRADRLVGQVLGEVGSLPDVFVELEVNFFLLRRLLGVRTKGSERQGKVSKLVKAEMLMLNIGSMSTGARVVAVKNDLAKLQLTSPVCTSKGEKIALSRRVEKHWRLIGWGQIQAGITLEVPPAPVFS

SEQ ID NO: 17464 - protein, 464 aa, Eschscholzia californica
MARKGLMEQDLSKLDVAKLHPLSPEVISRQATINIGTIGHVAHGKSTVVKAISGVQTVRFKNELERNITIKLGYANAKIYKCEDERCPRPSAYKAYGSGKEDSPLCDVPGFENTRMKLLRHVSFVDCPGHDILMATMLNGAAIMDGALLLIAANESCPQPQTSEHLAAVEIMRLQHIIILQNKVDLIQENVAINQHEAIKKFIQKTVADNAPIVPISAQLKYNIDVVCEYIVKKIPIPERDFISPPTMIVIRSFDVNKPGSEVDEVKGGVAGGSILNGVLRVNQFIEVRPGIVVKDENGRIKCTPIYSRIVSLYAEQNELQFAVPGGLIGVGTTMDPTLTRADRLVGQVLGEVGSLPEVFVELEVNFFLLRRLLGVKTTGTERQGKVSKLTKAEILMLNIGSMSTGARVIAVKNDLAKLQLTSPVCTSKGEKVALSRRVEKHWRLIGWGQIQAGTTLEVPPCPI

SEQ ID NO: 17465 - protein, 464 aa, Eucalyptus grandis
MSRKGLMEQDLSKLDVTKLTPLSPEVISRQATINIGTIGHVAHGKSTVVKAISGVQTVRFKNELERNITIKLGYANAKIYKCEDERCPRPTCYKAYGSGKEDSPLCDVPGFENCRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFVSPPNMIVIRSFDVNKPGYEVDEIRGGVAGGSILRGVLKVNQMIEVRPGIIVKDENGNTKCTPIYSRIVSLYAEQNELQFAVPGGLIGVGTTMDPTLTRADRLVGQVLGEVGSLPEIFVELEVNFFLLRRLLGVRTKGSERQGKVSKLAKGEILMLNIGSMSTGARVVAVRNDLAKLQLTSPVCTSKNEKIALSRRVEKHWRLIGWGQIQAGMTLDIPPVQF

SEQ ID NO: 17466 - protein, 464 aa, Humulus lupulus
MSRKGLMEQDLGKLDVTKLNPLSPEVISRQATINIGTIGHVAHGKSTVVKAISGVQTVRFKNELERNITIKLGYANAKIYKCEDERCPRPMCYKAYGSGKEDSPLCDVPGFETARMKLLRHVSFVDCPGHDILMATMLNGAAIMDGALLLIAANESCPQPQTSEHLAAVEIMRLQHIIILQNKVDLIQENVAINQNEAIKKFIEGTVADGAPVVPISAQLKYNIDVVCEYIVKKIPIPERNFISPPNMIVIRSFDVNKPGFEVDDIKGGVAGGSILRGVLKVNQFIEVRPGIVVKDENGNTKCTPIYSRIVSLYAEQNELQFAVPGGLIGVGTTMDPTLTRADRLVGQVLGEVGSLPEVFVELEVNFFLLRRLLGVKTKGSEKQGKVTKLTKGEMLMLNIGSMSTGARVLAVKNDLAKLQLTSPVCTSKGEKIALSRRVEKHWRLIGWGQIQAGTTLDVPPCPI

SEQ ID NO: 17467 - protein, 466 aa, Medicago truncatula
MARRGLMEQDLSTLDVNKLHPLSPEVISRQATINIGTIGHVAHGKSTVVKAISGVQTVRFKNELERNITIKLGYANAKIYKCEDERCPRPMSYKAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAINQHEAIQKFIQGTVADSAPVVPISAQLKYNIDVVCEYIVKKIPIPERNFISPPNMIVIRSFDVNKPGYEVDEIKGGVAGGSILRGVLKVNQFIEVRPGIVVKDESGNIRCTPIYSRIVSLFAEQNELQFAVPGGLIGVGTTMDPTLTRADRLVGQVLGEVGSLPDVFVELEVNFFLLRRLLGVRTKGSERQGKVSKLTKSEILMLNIGSMSTGAKVTAVKNDLAKLQLTSPVCTSKGEKIALSRRVEKHWRLIGWGQIQAGITLDVPPAPLLS

SEQ ID NO: 17468 - protein, 464 aa, Nicotiana benthamiana
MSKKGLMEQDLSKLDVTKLHPLSPEVISRQATINIGTIGHVAHGKSTVVKAISGVQTVRFKNELERNITIKLGYANAKIYKCEEDRCPRPMCYKAYGSGKEDSPMCDVPGFENCRMKLLRHVSFVDCPGHDILMATMLNGAAIMDGALLLIAANESCPQPQTSEHLAAVEIMRLQHIIILQNKVDLVQENVAINQHEAIQKFIQGTVADGAPVVPISAQLKYNIDVVAEYIVKKIPIPERNFISPPNMIVIRSFDVNKPGFEVDDIRGGVAGGSILKGVLKVNQLIEVRPGIVVKDESGNIKCTPIYSRIVSLFAEQNELQFAVPGGLIGVGTTMDPTLTRADRLVGQVLGEVGSLPEVFVELEVNFFLLRRLLGVRTKDSERQGKVSKLAKGEILMLNIGSMSTGARVVAVKNVFAKLQLTSPVCTSKGEKIALSRRIEKHWRLIGWGQIQAGITLDVPPCPV

SEQ ID NO: 17469 - protein, 462 aa, Citrus sinensis
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDNPLCDVPGFENCRMKLLRHVSFVDCPGHDILMATMLNGAAIMDGALLLIAANESCPQPQTSEHLAAVEIMRLQHIIILQNKVDLIQENVAINQHEAIMKFIQGTVADGAPVVPISAQLKYNIDVVCEYIVKKIPIPERNFIDPPNMIVIRSFDVNKPGFEVDDIRGGVAGGSILRGVLKVNQFIEVRPGIVVKDESGNIKCTPIYSRIVSLFAEQNELQFAVPGGLIGVGTTMDPTLTRADRLVGQVLGEVGSLPEVFVELEVNFFLLRRLLGVRTKGSERQGKVSKLAKQEILMLNIGSMSTGARVLAVKNDLAKLQLTSPVCTSRGEKIALSRRVEKHWRLIGWGQIQAGTTLDVPAS

SEQ ID NO: 17470 - protein, 466 aa, Cajanus cajan
MSRKGLMEQDLSKLDVTKLHPLSPEVISRQATINIGTIGHVAHGKSTVVKAISGVQTVRFKNELERNITIKLGYANAKIYKCEDERCSRPMCYKAYGSGKEDNPMCDVPGFENSKMKLLRHVSFVDCPGHDILMATMLNGAAIMDGALLLIAANESCPQPQTSEHLAAVEIMRLQHIIILQNKVDLIQENVAINQHEAISKFIQGTVADGAPVVPISAQLKYNIDVVCEYIVKKIPIPERNFISPPNMIVIRSFDVNKPGFEVDEIKGGVAGGSILRGVLKVNQFIEVRPGIVVKDESGNIRCTPIYSRIVSLYAEQNELQFAVPGGLIGVGTTMDPTLTRADRLVGQVLGEVGSLPEVFVELEVNFFLLRRLLGVRTKGSERQGKVSKLAKGEMLMLNIGSMSTGARVIAVKNDLAKLQLTSPVCTSKGEKIALSRRVEKHWRLIGWGQIQAGITLDVPPAPHLS

SEQ ID NO: 17471 - protein, 464 aa, Helianthus annuus
MARKGLMEQDLSKLDVATLHPLSPEVISRQATINIGTIGHVAHGKSTVVKAISGVQTVRFKNELERNITIKLGYANAKIYKCEDEKCPRPMCYKAYGSGKEDSPPCDVPGFENSKMKLMRHVSFVDCPGHDILMATMLNGAAIMDGALLLIAANESCPQPQTSEHLAAVEIMRLQHIIILQNKVDLIQENVAINQHDAIQQFIQGTVADGAPVIPVSAQLRYNIDVVCEYIIKRIPIPERNFISPPNMIVIRSFDVNKPGSEVDEIRGGVAGGSILKGVLKVNQHIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTEKQGKVSKLSKAEILMLNIGSMSTGARVLAVKNDLAKLQLTAPVCTSRGEKIALSRRVEKHWRLIGWGQIQAGLTLEIPPCPI

SEQ ID NO: 17472 - protein, 466 aa, Phaseolus vulgaris
MSRKGLMEQDLSKLDVAKLHPLSPEVISRQATINIGTIGHVAHGKSTVVKAISGVQTVRFKNELERNITIKLGYANAKIYKCEDERCSRPMCYKAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAINQHEAISKFIQGTVADGAPVVPISAQLKYNIDVVCEYIVKKIPIPERNFISPPNMIVIRSFDVNKPGFEVDEIKGGVAGGSILRGVLKVNQFIEVRPGIVVKDESGNIRCTPIYSRIVSLYAEQNELQFAVPGGLIGVGTTMDPTLTRADRLVGQVLGEVGSLPEVFVELEVNFFLLRRLLGVRTKGSERQGKVSKLAKGEMLMLNIGSMSTGARVIAVRNDLAKLQLTSPVCTSKGEKIALSRRVEKHWRLIGWGQIQAGITLDVPPAPQFS

SEQ ID NO: 17473 - protein, 466 aa, Cicer arietinum
MSRKGLMEQDLSKLDVTKLHPLSPEVISRQATINIGTIGHVAHGKSTVVKAISGVQTVRFKNELERNITIKLGYANAKIYKCEDERCPRPMSYKAYGSGKEDNPMCDVPGFENSKMKLLRHVSFVDCPGHDILMATMLNGAAIMDGALLLIAANESCPQPQTSEHLAAVEIMRLQHIIILQNKVDLIQENVAINQHEAIQKFIQGTVADSAPVVPISAQLKYNIDVVCEYIVKKIPIPERNFISPPNMIVIRSFDVNKPGYEVDEIKGGVAGGSILRGVLKVNQFIEVRPGIVVKDESGNIRCTPIYSRIVSLYAEQNELQFAVPGGLIGVGTTMDPTLTRADRLVGQVLGEVGSLPEVFVELEVNFFLLRRLLGVRTKGSERQGKVSKLAKAEMLMLNIGSMSTGARVVAVKNDLAKLQLTSPVCTSKGEKIALSRRVEKHWRLIGWGQIQAGITLDIPSAPLLS

SEQ ID NO: 17474 - protein, 467 aa, Trifolium pratense
MATRRGLMEQDLSKLDVTKLHPLSPEVISRQATINIGTIGHVAHGKSTVVKAISGVQTVRFKNELERNITIKLGYANAKIYKCEDERCPRPMSYKAYGSGKEDNPMCDVPGFENSKMKLLRHVSFVDCPGHDILMATMLNGAAIMDGALLLIAANESCPQPQTSEHLAAVEIMRLQHIIILQNKVDLIQENVAINQHEAIQKFIQGTVADSAPVVPISAQLKYNIDVVCEYIVKKIPIPERNFISPPNMIVIRSFDVNKPGYEVDEIKGGVAGGSILRGVLKVNQFIEVRPGIVIKDESGNIRCTPIYSRIVSLFAEQNELQFAVPGGLIGVGTTMDPTLTRADRLVGQVLGEVGSLPDVFVELEVNFFLLRRLLGVRTKGSERQGKVSKLVKAEMLMLNIGSMSTGARVVAVKNDLAKLQLTSPVCTSKGEKIALSRRVEKHWRLIGWGQIQAGITLEVPPAPVFS

SEQ ID NO: 17475 - protein, 466 aa, Allium cepa
MAKKSGLMEQDLSKLDVTKLTPLSPEVISRQATINIGTIGHVAHGKSTVVKAISGVQTVRFKNELERNITIKLGYANAKIYKCEDEKCPRPMCYKAYGSGKEDSPDCDVPGFEKAKMKLLRHVSFVDCPGHDILMATMLNGAAIMDGALLLIAGNESCPQPQTSEHLAAVEIMRLEHIIILQNKIDLIQESVAINQHESIQNFIKGTIADGAPVVPISAQLKYNIDVVCEYLVNKIPIPVRDFTSPPNMIVIRSFDVNKPGSEVDEIKGGVAGGSILRGVLKVNQLIEVRPGIVLKDESGNIKCTPIYSRIKSLFAEQNELQFAVPGGLIGVGTTMDPTLTRADRLVGQVLGEVGSLPDVFVELEVNFFLLRRLLGVRTKGAEKQGKVSKLTKGEILMLNIGSMSTGAKVIAVKNDLAKLQLTAPVCTSKGEKVALSRRVEKHWRLIGWGQIQAGSTLQIPPPPTF

SEQ ID NO: 17476 - protein, 464 aa, Ambrosia trifida
MARKGLMEQDLSKLDVAALHPLSPEVISRQATINIGTIGHVAHGKSTVVKAISGVQTVRFKNELERNITIKLGYANAKIYKCEDEKCPRPMCYKAYGSGKEDSPPCDVPGFENSKMKLMRHVSFVDCPGHDILMATMLNGAAIMDGALLLIAANESCPQPQTSEHLAAVEIMRLQHIIILQNKVDLIPENIAINQHDAIQQFIQGTVADGAPVIPVSAQLRYNIDVVCEYIIKRIPIPERNFISPPNMIVIRSFDVNKPGSEVDEIRGGVAGGSILKGVLKVNQHIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTEKQGKVSKLSKAEILMLNIGSMSTGARVLAVKNDLAKLQLTAPVCTSKGEKIALSRRVEKHWRLIGWGQIQAGVTLDIPPCPI

SEQ ID NO: 17477 - protein, 464 aa, Eucalyptus grandis
MSRKGLMEQDLSKLDVTTLTPLSPEVISRQATINIGTIGHVAHGKSTVVKAISGVQTVRFKNELERNITIKLGYANAKIYKCEDERCPRPMCYKAYGSGKEDTPACDVPGFENCRMKLLRHVSFVDCPGHDILMATMLNGAAIMDGALLLIAANESCPQPQTSEHLAAVEIMRLQHIIILQNKIDLIQENVAINQHEAIQKFIQGTVADGAPVVPISAQLKYNIDVVCEYIVKKIPIPERNFIDPPNMIVIRSFDVNKPGFEVDEIRGGVAGGSILRGVLKVNQMIEVRPGIVVKDANGTIRCTPIYSRIVSLFAEQNELQFAVPGGLIGVGTTMDPTLTRADRLVGQVLGEVGSLPEIYVELEVNFFLLRRLLGVRTIGSERQGKVSKLTKGEILMLNIGSMSTGARVIAVKNDLAKLQLTSPVCTSKGEKIALSRRVESHWRLIGWGQIQAGMILEVPPVQS

SEQ ID NO: 17478 - protein, 464 aa, Nicotiana benthamiana
MSRKGLMEQDLSKLDVTKLHPLSPEVISRQATINIGTIGHVAHGKSTVVKAISGVQTVRFKNELERNITIKLGYANAKIYKCDEDRCPRPMCYKAYGSGKEDSPMCDVPGFENCRMKLLRHVSFVDCPGHDILMATMLNGAAIMDGALLLIAANESCPQPQTSEHLAAVEIMRLQHIIILQNKVDLVQENVAINQHEAIQKFIQGTVADGAPVVPISAQLKYNIDVVAEYIVKKIPIPERNFISPPNMIVIRSFDVNKPGFEVDDIRGGVAGGSILKGVLKVNQLIEVRPGIVVKDESGNIKCTPIYSRIVSLFAEQNELQFAVPGGLIGVGTTMDPTLTRADRLVGQVLGEVGSLPEVFVELEVNFFLLRRLLGVRTKDSERQGKVSKLAKGEILMLNIGSMSTGARVVAVKNVFAKLQLTSPVCTSKGEKIALSRRIEKHWRLIGWGQIQAGITLDVPPCPV

SEQ ID NO: 17479 - protein, 464 aa, Petroselinum crispum
MSRKGLMEQDLSKLDVTQLHPLSPEVISRQATINIGTIGHVAHGKSTVVKAISGVQTVRFKNELERNITIKLGYANAKIYKCEDESCPRPKCYKAYGSGKEDAPQCDVPGFENSKMKLLRHVSFVDCPGHDILMATMLNGAAIMDGALLLIAANESCPQPQTSEHLAAIEIMRLKHIIILQNKVDLIQENVATNQHDAIQKFIQGTVADSSPVIPVSAQLKYNIDVVCEYIVKKIPIPERNFISPPNMIVIRSFDVNKPGSEVDEIKGGVAGGSILKGVLKVNQYIEVRPGIVVKDESGSIKCTPIYSRIVSLFAEQNELQFAVPGGLIGVGTTMDPTLTRADRLVGQVLGEVGSLPEVYVELEVNFFLLRRLLGVRTKGTERQGKVSKLTKGEILMLNIGSMSTGARVLAVRNDLAKLQLTSPVCTSKGEKIALSRRVEKHWRLIGWGQIQAGTTLDIPPCPL

SEQ ID NO: 17480 - protein, 464 aa, Lippia dulcis
MSRKGLMEQDLSKLDVTELHPLSPEVISRQATINIGTIGHVAHGKSTVVKAISGVQTVRFKNELERNITIKLGYANAKIYKCEDDRCPRPMCYKAYGSGKEDSPMCDVPGFENCRMKLLRHVSFVDCPGHDILMATMLNGAAIMDGALLLIAANESCPQPQTSEHLAAVEIMRLQHIIILQNKVDLVQENVAINQHEAISKFIQGTVADGAPVVPISAQLKYNIDVVAEYLVKKIPIPERNFISPPNMIVIRSFDVNKPGSEVDEIKGGVAGGSILKGVLKVNQFIEVRPGIVVKDENDNIKCTPIYSRIVSLYAEQNELQFAVPGGLIGVGTTMDPTLTRADRLVGQVLGEVGSLPEVYVELEVNFFLLRRLLGVRTKDTERQGKVSKLTKGEILMLNIGSMSTGARVVAVKNVFAKLQLTSPVCTSKGEKIALSRRIDRHWRLIGWGQIQAGITLDVPPCPI

SEQ ID NO: 17481 - protein, 464 aa, Populus trichocarpa
MARKGLMEQDLSKLDVTTLHPLSPEVISRQATINIGTIGHVAHGKSTVVKAISGVQTVRFKNELERNITIKLGYANAKIYKCEDERCPRPKCYKAYGSGKEDNPMCDVEGFQNCRMNLLRHVSFVDCPGHDILMATMLNGAAIMDGALLLIAANESCPQPQTSEHLAAVEIMRLQHIIILQNKVDLIQENAAINQHEAIQKFIQGTVADGAPVVPISAQLKYNIDVVCEYIVKKIPIPERNFISPPNMIVIRSFDVNKPGYEVDEIRGGVAGGSILRGVLKVNQFIEVRPGIIVKDEAGNMKCTPIYTRIVSLYAEQNELQFAVPGGLIGVGTTMDPTLTRADRLVGQVLGDVGSLPEVFGELEVNFFLLRRLIGVRTKGSEKQGKVSKLTKGEILMLNIGSMSSGARVLAVKNDLAKLQLTSPVCTSKGEKIALSRRVEKHWRLIGWGMIQAGTTIEVPPCPL

SEQ ID NO: 17482 - protein, 464 aa, Pseudotsuga menziesii
MSRKGLMEQDLSKLDVAKLHPLSPEVISRQATINIGTIGHVAHGKSTVVKAISGVQTVRFKNELERNITIKLGYANAKIYKCEDERCPRPMCYKAYGSGKEDSPMCDVPGFENTRMKLLRHVSFVDCPGHDILMATMLNGAAIMDGALLLIAGNESCPQPQTSEHLAAVEIMRLKHIIILQNKIDLIQESVAINQHEAIQKFIQGTIADGAPVVPISAQLKYNIDVVCEYITNKIPIPERNFVDPPNMIVIRSFDVNKPGAEVDEIKGGVAGGSILKGVLKVNQKIEVRPGIVVKDESGNIKCTPIFSRIISLYAEQNELQFAVPGGLIGVGTTIDPTLTRADRLVGQVLGEVGELPDVFVELEVNFFLLRRLLGVRTKGTEKQGKVSKLAKGEVLMLNIGSMSTGARVLAVKNDLAKLQLTSPVCTSKGEKMALSRRVEKHWRLIGWGQIQAGAMLDIPPASE

SEQ ID NO: 17483 - protein, 464 aa, Sesamum indicum
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPMCDVPGFENYKMKLLRHVSFVDCPGHDILMATMLNGAAIMDGALLLIAANESCPQPQTSEHLAAVEIMRLQHIIILQNKVDLVQENVAINQHEAIQKFIEGTVADGAPVVPISAQLKYNIDVVCEYIVKKIPIPERNFISPPNMIVIRSFDVNKPGSEVDEIKGGVAGGSILKGVLKVNQYIEVRPGIVVKDENDNIKCTPIYSRIVSLYAEQNELQFAVPGGLIGVGTTMDPTLTRADRLVGQVLGEVGSLPEVYVELEVNFFLLRRLLGVRTKDTERQGKVSKLAKGEILMLNIGSMSTGARVVAVKNVFAKLQLTSLVCTSKGEKIALSRRIDRHWRLIGWGQIQAGITLDVPPCPI

SEQ ID NO: 17484 - protein, 464 aa, Silene vulgaris
MARKGLMEQDLKKLDVAKLHPLSPEVISRQATINIGTIGHVAHGKSTVVKAISGVQTVRFKNELERNITIKLGYANAKIYKCEDERCPRPKSYKAYGSGKEDSPMCDVPGFENCKMKLLRHVSFVDCPGHDILMATMLNGAAIMDGALLLIAANESCPQPQTSEHLAAIEIMRLQHIIILQNKVDLVQENVAINQHEAIEKFVQGTVADAAPVVPISAQLKYNIDVVCEYIVKKIPIPERNFISPPNMIVIRSFDVNKPGYEVDDIRGGVAGGSILKGVLRVNQSIEVRPGIVVKDESGNIKCTPIYSRIVSLYADQNELQFAVPGGLIGVGTTMDPTLTRADRLVGQVLGEVGSLPDVFVELEVNFFLLRRLLGVRTKGTEKQGKVTKLTKGEILMLNIGSMSTGARVLAVKNDLAKLQLTSPVCTSKGEKIALSRRVEKHWRLIGWGQIQAGTTIDIPPCPI

SEQ ID NO: 17485 - protein, 464 aa, Solanum lycopersicum
MSRKGLMEQDLSKLDVTQLHPLSPEVISRQATINIGTIGHVAHGKSTVVKAISGVQTVRFKNELERNITIKLGYANAKIYKCEEERCPRPMCYKAYGSGKEDSPMCDVPGFESCKMKLLRHVSFVDCPGHDILMATMLNGAAIMDGALLLIAANESCPQPQTSEHLAAVEIMRLQHIIILQNKVDLVQENVAINQHEAIQKFIQGTVADGAPVVPISAQLKYNIDVVCEYIVKRIPIPVRDFTSPPNMIVIRSFDVNKPGFEVDEIRGGVAGGSILKGVLKVNQLIEVRPGIVVKDESGNIKCTPIYSRIVSLFAEQNELQFAVPGGLIGVGTTMDPTLTRADRLVGQVLGEVGSLPEVFVELEVNFFLLRRLLGVRTKDTERQGKVSKLAKGEILMLNIGSMSTGARVVAVKNVFAKLQLTSPVCTSKGEKIALSRRIEKHWRLIGWGQIQAGITLDVPPCPI

SEQ ID NO: 17486 - protein, 465 aa, Rosmarinus officinalis
MSRKGLMEQDLSKLDVTTLHPLSPEVISRQATINIGTIGHVAHGKSTVVKAISGVQTVRFKNELERNITIKLGYANAKIYQCEDERCPRPMCYKAYGSGKEDSPMCDVPGFENCRMKLLRHVSFVDCPGHDILMATMLNGAAIMDGALLLIAANESCPQPQTSEHLAAVEIMRLQHIIILQNKVDLVQENVAVNQHEAIQKFIQGTVADGAQVIPISAQLKYNIDVVCEYIVKKIPIPVRDFISPPNMIVIRSFDVNKPGFEVDEIKGGVAGGSILKGVLKVNQYIEVRPGIVVKDENGNIKCTPIYSRIVSLYAEQNELQFAVPGGLIGVGTTMDPTLTRADRLVGQVLGEVGSLPEVYSELEVNFFLLRRLLGVRTKDTERQGKVSKLAKGEILMLNIGSMSTGARVVAVKNVFAKLQLTSPVCTSKGEKIALSRRIEKHWRLIGWGQIQAGITLDVPPCPLK

SEQ ID NO: 17487 - protein, 466 aa, Trifolium pratense
MSRKGLMEQDLSKLDVTKLHPLSPEVISRQATINIGTIGHVAHGKSTVVKAISGVQTVRFKNELERNITIKLGYANAKIYKCEDERCPRPMSYKAYGSGKEDNPMCDVPGFENCKMKLLRHVSFVDCPGHDILMATMLNGAAIMDGALLLIAANESCPQPQTSEHLAAVEIMRLQHIIILQNKVDLIQENVAINQHEAIQKFIEGTVADGAPVVPISAQLKYNIDVVCEYIVKKIPIPERNFISPPNMIVIRSFDVNKPGFEVDEIKGGVAGGSILRGVLKVNQFIEVRPGIVVKDESGNIKCTPIYSRIVSLFAEQNELQFAVPGGLIGVGTTMDPTLTRADRLVGQVLGEVGSLPEVFVKLEVNFFLLRRPLGVRTKGSERQGKASKLVKAEMLMLNIGSMSTGARVVAVKNDLAKLQLTSPVCTSKGEKIALSRRVEKHWRLIGWGQIQAGITLEVPPAPVFS

SEQ ID NO: 17488 - protein, 467 aa, Distylium racemosum
MSRRGLMEQDLSKLDVTKLHPLYPEVISRQATINIGTIGHVAHGKSTVVKAISGVQTVRFKNELERNITIKLGYANAKIYKCEDERCPRPMCYKAYGSGKEDSPLCDVLGFDNTRMKLLRHVSFVDCPGHDILMATMLNGAAIMDGALLLIASNESCPQPQTSEHLAAVEIMRLQHIIILQNKIDLIQESVAINQHEAIQKFIQGTIADGAPVVPISAQLKYNIDVVCEYIVKKIPIPERNFVDPPNMIVIRSFDVNKPGAEVDDIKGGVAGGSILKGVLKVNQKIEVRPGIVVKDESGNIKCTPIFSRIVSLYAEQNELQFAVPGGLIGVGTTIDPTLTRADRLVGQVLGEVGELPDVFVELEVNFFLLRRLLGVRTKGTEKQGKVSKLAKGEVLMLNIGSMSTGARVLAVKNDLAKLQLTSPVCTSKGEKVALSRRVEKHWRLIGWGQIQAGLMLDIPQVSVEGS

SEQ ID NO: 17489 - protein, 466 aa, Lotus japonicus
MSRKGLMEQDLSKLDVAKLHPLSPEVISRQATINIGTIGHVAHGKSTVVKAISGVQTVRFKNELERNITIKLGYANAKIYKCEDERCPRPMSYKAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAINQHEAIQKFIQGTVAGGAPVVPISAQLKYNIDVVCEYIVKKIPIPERNFISPPNMIVIRSFDVNKPGYEVDEIKGGVAGGSILRGVLKFNQFIEVRPGIIVKDDSGNIRCTPIYSRIVSLYAEQNELQFAVPGGLIGVGTTMDPTLTRADRLVGQVLGEVGSLPEVFVELEVNFFLLRRLLGVRTKGSERQGKVTKLTKTEMLMLNIGSMSTGARVIAVKNDLAKLQLTSPVCTSKGEKIALSRRVEKHWRLIGWGQIQAGLTLDVPPAPLLN

SEQ ID NO: 17490 - protein, 466 aa, Allium cepa
MAKKSGLMEQDLSKLDVTKLTPLSPEVISRQATINIGTIGHVAHGKSTVVKAISGVQTVRFKNELERNITIKLGYANAKIYTCEDEKCPRPMCYKAYGSGKEDSPDCDVPGFEKAKMKLLRHVSFVDCPGHDILMATMLNGAAIMDGALLLIAGNESCPQPQTSEHLAAVEIMRLEHIIILQNKIDLIQESVAINQHESIQNFIKGTIADGAPVVPISAQLKYNIDVVCEYLVNKIPIPVRDFTSPPNMIVIRSFDVNKPGSEVDEIKGGVAGGSILRGVLKVNQLIEVRPGIVLKDESGNIKCTPIYSRIKSLFAEQNELQFAVPGGLIGVGTTMDPTLTRADRLVGQVLGEVGSLPDVFVELEVNFFLLRRLLGVRTKGAEKQGKVSKLTKGEILMLNIGSMSTGAKVIAVKNDLAKLQLTAPVCTSKGEKVALSRRVEKHWRLIGWGQIQAGSTLQIPPPPTF

SEQ ID NO: 17491 - protein, 466 aa, Allium cepa
MAKKTGLMEQDLSKLDVSKLTPLSPEVISRQATINIGTIGHVAHGKSTVVKAISGVQTVRFKNELERNITIKLGYANAKIYKCEDEKCPRPMCYKAYGSGKEDSPDCDVPGFDKTKMKLLRHVSFVDCPGHDILMATMLNGAAIMDGALLLIAGNESCPQPQTSEHLAAVEIMRLEHIIILQNKIDLIQESAAINQHESIQSFIKGTIADGAPVVPISAQLKYNIDVVCEYLVNKIPIPIRDFTSPPNMIVIRSFDVNKPGSEVDEIKGGVAGGSILRGVLKVNQLIEVRPGIVLKDESGNIKCTPIYSRIKSLFAEQNELQFAVPGGLIGVGTTMDPTLTRADRLVGQVLGEVGSLPDVFVELEVNFFLLRRLLGVRTKGAEKQGKVSKLTKAEILMLNIGSMSTGAKVIAVKNDLAKLQLTAPVCTSKGEKVALSRRVEKHWRLIGWGQIQAGSTLKIPPRPSF

SEQ ID NO: 17492 - protein, 466 aa, Allium cepa
MAKKTGLMEQDLSKLDESKLTPLSPEVISRQATINIGTIGHVAHGKSTVVKAISGVQTVRFKNELERNITIKLGYANAKIYKCEDEKCPRPMCYKAYGSGKEDSPDCDVPGFEKTKMKLLRHVSFVDCPGHDILMATMLNGAAIMDGALLLIAGNESCPQPQTSEHLAAVEIMRLEHIIILQNKIDLIQESAAINQHESIQSFIKGTIADGAPVVPISAQLKYNIDVVCEYLVNKIPIPIRDFTSPPNMIVIRSFDVNKPGSEVDEIKGGVAGGSILRGVLKVNQLIEVRPGIVLKDESGNIKCTPIYSRIKSLFAEQNELQFAVPGGLIGVGTTMDPTLTRADRLVGQVLGEVGSLPDVFVELEVNFFLLRRLLGVRTKGAEKQGKVSKLTKAEILMLNIGSMSTGAKVIAVKNDLAKLQLTAPVCTSKGEKVALSRRVEKHWRLIGWGQIQAGSTLKIPPRPSF

SEQ ID NO: 17493 - protein, 466 aa, Arachis hypogaea
MSRKGLMEQDLSKLDVKKLDPLSPEVISRQATINIGTIGHVAHGKSTVVKAISGVQTVRFKNELERNITIKLGYANAKIYKCEDERCPRPMCYKAYGSGKEDSPMCDVPGFENSRMKLLRHVSFVDCPGHDILMATMLNGAAIMDGALLLIAANESCPQPQTSEHLAAVEIMRLQHIIILQNKVDLIQENVAINQHEAITKFIAGTVADSAPVVPISAQLKYNIDVVCEYIVKKIPIPIRDFVSPPNMIVIRSFDVNKPGFEVDDIKGGVAGGSILRGVLKVNQFIEVRPGIVVKDESGNIKCTPIYSRIVSLYAEQNELQFAVPGGLIGVGTTMDPTLTRADRLVGQVLGEVGSLPDVFVELEVNFFLLRRLLGVRTKGSEKQGKVSKLAKGEMLMLNIGSMSTGARVVAVRNDLAKLQLTSPVCTSKGEKIALSRRVEKHWRLIGWGQIQAGITLNVPAAPQLS

SEQ ID NO: 17494 - protein, 464 aa, Spinacia oleracea
MARKGLMEQDLSKLDVAKLHPLSPEVISRQATINIGTIGHVAHGKSTVVKAISGVQTVRFKNELERNITIKLGYANAKIYKCDDERCPRPMSYKAYGSGKEDTPMCDVPGFENAKMKLLRHVSFVDCPGHDILMATMLNGAAIMDGALLLIAANESCPQPQTSEHLAAIEIMRLQHIIILQNKVDLIQENVAINQHEAIQKFVQGTVADGAPVVPISAQLKYNIDVVCEYIVKNIPIPERNFISPPNMIVIRSFDVNKPGYEVDEICGGVAGGSILKGVLRVNQNIEVRPGIVVKDDSGNIKCTPIYSRIVSLKAEENELQFAVPGGLIGVGTTMDPTLTRADRLVGQVLGEVGSLPDVFVELEVNFFLLRRLMGVRTKGTEKQGKVTKLTKAEILMLNIGSMSTGARVIAVKHDLAKLQLTSPVCTSKGEKIALSRRVEKHWRLIGWGQIQAGITLDIPPCPL

SEQ ID NO: 17495 - protein, 464 aa, Coffea canephora
MSRKGLMEQDLSKLDVTKLHPLSPEVISRQATINIGTIGHVAHGKSTVVEAISGVQTVRFKNELERNITIKLGYANAKIYKCEDDKCPRPMCYKAYGSGKEDSPMCDVPGFENCRMKLLRHVSFVDCPGHDILMATMFNGAAIMDGALLLIAANESCPQPQTSEHLAAVEIMRLQHIIILQNKVDLVQENIAINQHEAIQKFIQGTVADGAPVIPISAQLKYNIDVVAEYIVKKIPIPERNFISPPNMIVIRSFDVNKPGFEVDEIKGGVAGGSILKGVLKVNQYIEVRPGIVVKDENGNIKCTPIYSRIVSLFAEQNELQFAVPGGLIGVGTTMDPTLTRADRLVGQVLGEVGSLPEVFVELEVNFFLLRRLLGVRTKDTERQGRVSKLAKGEILMLNIGSMSTGARVVAVKNVFAKLQLTSPVCTSKGEKIALSRRIEKHWRLIGWGQIQAGITLDVPPCPI

SEQ ID NO: 17496 - protein, 464 aa, Flaveria ramosissima
MARKGLMEQDLSKLDVTTLHPLSPEVISRQATINIGTIGHVAHGKSTVVKAISGVQTVRFKNELERNITIKLGYANAKIYKCEDDRCPRPMCYKAYGSGKEDNPPCDVPGFENSKMKLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLRYNIDVVCEYIIKRIPIPERNFISPPNMIVIRSFDVNKPGSEVDEIRGGVAGGSILKGVLKVNQHIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTEKQGKVSKLSKAEILMLNIGSMSTGARVLAVKNDLANLQLTSPVCTSKGEKIALSRRVEKHWRLIGWGQIQAGLTLDIPPCPI

SEQ ID NO: 17497 - protein, 464 aa, Mimulus guttatus
MSRKGLMEQDLSKLDVTQLHPLSPEVISRQATINIGTIGHVAHGKSTVVKAISGVQTVRFKNELERNITIKLGYANAKIYKCEDDRCPRPMCYKAYGSGKEDSPACDVPGFENARMKLLRHVSFVDCPGHDILMATMLNGAAIMDGALLLIAANESCPQPQTSEHLAAVEIMRLQHIIILQNKVDLVQENVAINQHEAIQKFIQGTVADGAPVVPISAQLKYNIDVVCEYIIKRIPIPERNFISPPNMIVIRSFDVNKPGSEVDEIKGGVAGGSILKGVLKVNQFIEVRPGIVVKDETDNIKCTPIYSRIVSLYAEQNELQFAVPGGLIGVGTTMDPTLTRADRLVGQVLGEVGSLPEIYVELEVNFFLLRRLLGVRTKDSERQVKVSKLTKGEILMLNIGSMSTGARVVAVKNVFAKLQLTSPVCTSKGEKIALSRRIDRHWRLIGWGQIQAGITLEVPPCPI

SEQ ID NO: 17498 - protein, 464 aa, Nicotiana benthamiana
MSRKGLMDQDLSKLDVTKLHPLSPEVISRQATINIGTIGHVAHGKSTVVKAISGVQTVRFKNELERNITIKLGYANAKIYKCEEERCPRPMCYKAYGSGKDDSPMCDVPGFENCRMKLLRHVSFVDCPGHDILMATMLNGAAIMDGALLLIAANESCPQPQTSEHLAAVEIMRLQHIIILQNKVDLVQENVAINQHEAIQKFIQGTVADGAPVVPISAQLKYNIDVVAEYIVKKIPIPERNFISPPNMIVIRSFDVNKPGFEVDDIRGGVAGGSILKGVLKVNQLIEVRPGIVVKDESGNIKCTPIYSRIVSLFAEQNELQFAVPGGLIGVGTTMDPTLTRADRLVGQVLGEVGSLPEVFVELEVNFFLLRRLLGVRTKDSERQGKVSKLAKGEILMLNIGSMSTGARVVAVKNVFAKLQLTSPVCTSKGEKIALSRRIEKHWRLIGWGQIQAGITIDIPPCPI

SEQ ID NO: 17499 - protein, 464 aa, Capsicum annuum
MSRKGLMEQDLSKLDVTKLHPLSPEVISRQATINIGTIGHVAHGKSTVVKAISGVQTVRFKNELERNITIKLGYANAKIYKCEEDRCPRPMCYKAYGSGKEDSPMCDVPGFENCRMKLLRHVSFVDCPGHDILMATMLNGAAIMDGALLLIAANESCPQPQTSEHLAAVEIMRLQHIIILQNKVDLVQENVAINQHEAIQKFIQGTVADGAPVVPISAQLKYNIDVVAEYIVKKIPIPVRDFISPPNMIVIRSFDVNKPGFEVDDIRGGVAGGSILKGVLKVNQLIEVRPGITVKDESGNIKCTPIYSRIVSLFTEQNELQFAVPGGLIGVGTTMDPTLTRADRLVGQVLGEVGSLPDVFVELEVNFFLLRRLLGVRTKESEKQGKVSKLAKGEILMLNIGSMSTGARVVAVKNVFAKLQLTSPVCTSKGEKIALSRRIEKHWRLIGWGQIQAGITLDVPPCPI

SEQ ID NO: 17500 - protein, 464 aa, Solanum phureja
MSRKGLMEQDLSKLDVTKLHPLSPEVISRQATINIGTIGHVAHGKSTVVKAISGVQTVRFKNELERNITIKLGYANAKIYKCEEDRCPRPMCYKAYGSGKEDGPMCDVPGFETCRMKLLRHVSFVDCPGHDILMATMLNGAAIMDGALLLIAANESCPQPQTSEHLAAVEIMRLQHIIILQNKVDLVQENVAINQHEAIQKFIQGTVADGAPVVPISAQLKYNIDVVAEYIVKKIPIPERNFISPPNMIVIRSFDVNKPGFEVDDIRGGVAGGSILKGVLKVNQLIEVRPGITVKDESGNIKCTPIYSRIVSLFAEQNELQFAVPGGLIGVGTTMDPTLTRADRLVGQVLGEVGSLPEVFVELEVNFFLLRRLLGVRTKDTERQGKVSKLAKGEILMLNIGSMSTGARVVAVKNVFAKLQLTSPVCTSKGEKIALSRRIEKHWRLIGWGQIQAGITLDVPPCPI

SEQ ID NO: 17501 - protein, 464 aa, Solanum lycopersicum
MSRKGLMEQDLSKLDVTKLHPLSPEVISRQATINIGTIGHVAHGKSTVVKAISGVQTVRFKNELERNITIKLGYANAKIYKCEEDRCPRPMCYKAYGSAKEDSPMCDVPGFETCRMKLLRHVSFVDCPGHDILMATMLNGAAIMDGALLLIAANESCPQPQTSEHLAAVEIMRLQHIIILQNKVDLVQENVAINQHEAIQKFIQGTVADGAPVVPISAQLKYNIDVVAEYIVKKIPIPERNFISPPNMIVIRSFDVNKPGFEVDDIRGGVAGGSILKGVLKVNQLIEVRPGITVKDESGNIKCTPIYSRIVSLFAEQNELQFAVPGGLIGVGTTMDPTLTRADRLVGQVLGEVGSLPEVFVELEVNFFLLRRLLGVRTKDTERQGKVSKLAKGEILMLNIGSMSTGARVVAVKNVFAKLQLTSPVCTSKGEKIALSRRIEKHWRLIGWGQIQAGITLDVPPCPI

SEQ ID NO: 17502 - protein, 466 aa, Allium cepa
MAKKSGLMEQDLSKLDVAKLTPLSPEVISRQATINIGTIGHVAHGKSTVVKAISGVQTVRFKNELERNITIKLGYANAKIYKCEDEKCPRPMCYKAYGSGKEDSPDCDVPGFEKAKMKLLRHVSFVDCPGHDILMATMLNGAAIMDGALLLIAGNESCPQPQTSEHLAAVEIMRLEHIIILQNKIDLIQESVAINQHESIQNFIKGTIADGAPVVPISAQLKYNIDVVCEYLVNKIPIPVRDFTSPPNMIVIRSFDVNKPGSEVDEIKGGVAGGSILRGVLKVNQLIEVRPGIVLKDESGKIKCTPIYSRIKSLFAEQNELQFAVPGGLIGVGTTMDPTLTRADRLVGQVLGEVGSLPDVFVELEVNFFLLRRLLGVRTKGAEKQGKVSKLTKGEILMLNIGSMSTGAKVIAVKNDLAKLQLTAPVCTSKGEKVALSRRVEKHWRLIGWGQIQAGSTLQIPPSPTF

SEQ ID NO: 17503 - protein, 466 aa, Allium cepa
MAKKTGLMEQDLSKLDVSKLTPLSPEVISRQATINIGTIGHVAHGKSTVVKAISGVQTVRFKNELERNITIKLGYANAKIYKCEDEKCPRPMCYKAYGSGKEDTPDCDVPGFDKTKMKLLRHVSFVDCPGHDILMATMLNGAAIMDGALLLIAGNESCPQPQTSEHLAAVEIMRLEHIIILQNKIDLIQESAAINQHESIQSFIKGTIADGAPVVPISAQLKYNIDVVCEYLVNKIPIPIRDFTSPPNMIVIRSFDVNKPGSEVDEIKGGVAGGSILRGVLKVNQLIEVRPGIVLKDESGNIKCTPIYSRIKSLFAEQNELQFAVPGGLIGVGTTMDPTLTRADRLVGQVLGEVGSLPDVFVELEVNFFLLRRLLGVRTKGAEKQGKVSKLTKAEILMLNIGSMSTGAKVIAVKNDLAKLQLTAPVCTSKGEKVALSRRVEKHWRLIGWGQIQAGSTLKIPPRPSF

SEQ ID NO: 17504 - protein, 464 aa, Conyza canadensis
MAKKGLMEQDLSKLDVATLHPLSPEVISRQATINIGTIGHVAHGKSTVVKAISGVQTVRFKNELERNITIKLGYANAKIYKCEDDRCPRPMCYRAYGSGKEDSPQCEVPGFENSKMKLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGSEVDEIKGGVAGGSILKGVLKVNQNIEVRPGIVVKDESGNIKCTPIYTRIVSLYAEQNELQFAVPGGLIGVGTTMDPMLTRADRLVGQVLGEVGSLPDVYVELEVNFFLLRRLLGVKTKGTEKQGKVSKLAKAEILMLNIGSMSTGARVLAVKNDLAKLHLTSPVCTSKGEKIALSRRVEKHWRLIGWGQIQAGSTLEIPPCPI

SEQ ID NO: 17505 - protein, 464 aa, Nicotiana benthamiana
MSRKGLMEQDLSKLDVAQLHPLSPEVISRQATINIGTIGHVAHGKSTVVKAISGVQTVRFKNELERNITIKLGYANAKIYKCEDERCPRPMCYKAYGSGKEDSPMCDVPGFETCRMKLLRHVSFVDCPGHDILMATMLNGAAIMDGALLLIAANESCPQPQTSEHLAAVEIMRLQHIIILQNKVDLVQENVAINQHEAIQKFIQGTVADGAPVVPISAQLKYNIDVVAEYIVKKIPIPVRDFTSPPNMIVIRSFDVNKPGFEVDDIRGGVAGGSILKGVLKVNQLIEVRPGIVVKDESGNIKCTPIYSRIVSLFAEQNELQFAVPGGLIGVGTIMDPTLTRADRLVGQVLGEVGSLPEVFVELEVNFFLLRRLLGVRTKDSERQGKVSKLAKGEILMLNIGSMSTGARVVAVKNVFAKLQLTSPVCTSKGEKIALSRRIEKHWRLIGWGQIQAGITLDVPPCPV

SEQ ID NO: 17506 - protein, 464 aa, Pinus taeda
MSKKGLMEQDLNKLDVTKLHPLSPEVISRQATINIGTIGHVAHGKSTVVKAISGVQTVRFKNELERNITIKLGYANAKIYKCEDDRCPRPMAYKAYGSGKEDSPLCDVSGFENTRMKLLRHVSFVDCPGHDILMATMLNGAAIMDGALLLIAGNESCPQPQTSEHLAAVEIMRLKHIIILQNKIDLIQESVAMNQHEAIQKFIQGTIADGAPVVPISAQLKYNIDVVCEYIVNKIPIPERNFVDPPNMIVIRSFDVNKPGAEVDEIKGGVAGGSILKGVLKVNQKIEVRPGIVVKDESGSIKCTPIFSRIISLYAEQNELQFAVPGGLIGVGTTIDPTLTRADRLVGQVLGEVGALPDVFVELEVNFFLLRRLLGVRTKGTEKQGKVSKLAKGEVLMLNIGSMSTGARVLAVKNDLAKLQLTSPVCTSKGEKMALSRRVEKHWRLIGWGQIQAGAILEIPQGSI

SEQ ID NO: 17507 - protein, 467 aa, Trifolium pratense
MATRRGLMEQDLSKLDVTKLHPLSPEVISRQATINIGTIGHVAHGKSTVVKAISGVQTVRFKNELERNITIKLGYANAKIYKCEDERCPRPMSYKAYGSGKEDNPMCDVPGFENSKMKLLRHVSFVDCPGHDILMATMLNGAAIMDGALLLIAANESCPQPQTSEHLAAVEIMRLQHIIILQNKVDLIQENVAINQHEAIQKFIEGTVADGAPVVPISAQLKYNIDVVCEYIVKKIPIPERNFISPPNMIVIRSFDVNKPGFEVDDIKGGVAGGSILRGVLRVNQFIEVRPGIVVKDESGNIKCTPIYSRIVSLFAEQNELQFAVPGGLIGVGTTMDPTLTRADRLVGQVLGEVGSLPEVFVELEVNFFLLRRLLGVRTKGSERQGKVSKLVKAEMLMLNIGSMSTGARVIAVRNDLAKLQLTSPVCTSKGEKIALSRRVEKHWRLIGWGQIQAGITLQVPPTPILS

SEQ ID NO: 17508 - protein, 467 aa, Arachis hypogaea
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAMNQHDTIKKFIEGTVADSAPVVPISAQLKYNIDVVCEYIVKKIPIPERNFTSPPNMIVIRSFDVNKPGFEVDEIKGGVAGGSILRGVLRVNQFIEVRPGIVVKDESGNIRCTPIYSRIVSLFAEQNELQFAVPGGLIGVGTTMDPTLTRADRLVGQVLGEVGSLPEVFVELEVNFFLLRRLLGVRTKGSERQGKVSKLAKAEMLMLNIGSMSTGARVVAVKNDLAKLQLTSPVCTNKGEKIALSRRVEKHWRLIGWGQIQAGITLDVPAAPTELK

SEQ ID NO: 17509 - protein, 468 aa, Zostera marina
MSRKGLMEQDLTKLDVTQLHPLSPEVISRQATINIGTIGHVAHGKSTVVKAISGVQTVRFKNELERNITIKLGYANAKIYKCESDTCPRPMCYKSYGSGKEDSPLCDVPGFENVRMKLLRHVSFVDCPGHDILMATMLNGAAIMDGALLLIAGNESCPQPQTSEHLAAVEIMRLQHIIILQNKVDLIQESVAINQHETIQKFIQGTIADGAPVVPISAQLKYNIDVVCEYIVNKIPIPIRDFVKPPNMIVIRSFDVNKPGSEVDEIKGGVAGGSILRGVLKVNQKIEVRPGIVVKDENGNIKCTPIYSRIVSLFAEQNELQFAVPGGLIGVGTTMDPTLTRADRLVGQVLGEVGSLPDVYVELEVNFFLLRRLLGVRTKGTEKQGKVSKLAKGEILMLNIGSMSTGARVVAVRNDLAKLQLTAPVCTSKGEKIALSRRVEKHWRLIGWGQIQAGSVLDIPAPPLEILF

SEQ ID NO: 17510 - protein, 465 aa, Arabidopsis lyrata
MSRNKGLAEQDLKKLDVTVLHPLSPEVISRQATINIGTIGHVAHGKSTVVKAISGVQTVRFKNELERNITIKLGYANAKIYKCEDEKCPRPMCYKAYGSGKEDSPNCDVPGFENSKMKLLRHVSFVDCPGHDILMATMLNGAAIMDGALLLIAANETCPQPQTSEHLAAVEIMQLKHIIILQNKIDLIQENVAINQHEAIQKFIMNTVADAAPIVPVSAQLKYNIDVVCEYIVKKIPIPERNFVSPPNMIVIRSFDVNKPGYEVDEIKGGVAGGSILRGVLKVNQLIEIRPGIVTKDERGNSKCTPIYSRIISLYAEQNELQFAVPGGLIGVGTTMDPTLTRADRLVGQVLGEIGSLPDVFVELEVNFFLLRRLLGVRTKGSEKQGKVSKLTKGEILMLNIGSMSTGAKVVGVKVDLAKLQLTAPVCTSKGEKVALSRRVEKHWRLIGWGQIQAGTTIEVPPSPF

SEQ ID NO: 17511 - protein, 465 aa, Arabidopsis thaliana
MSRNKGLAEQDLKKLDVTVLHPLSPEVISRQATINIGTIGHVAHGKSTVVKAISGVQTVRFKNELERNITIKLGYANAKIYKCEDEKCPRPMCYKAYGSGKEDTPNCDVPGFENSKMKLLRHVSFVDCPGHDILMATMLNGAAIMDGALLLIAANETCPQPQTSEHLAAVEIMQLKHIIILQNKIDLIQENVAINQHEAIQKFIMNTVADAAPIVPVSAQLKYNIDVVCEYIVKKIPIPERNFVSPPNMIVIRSFDVNKPGYEVDEIKGGVAGGSILRGVLRVNQLIEIRPGIVTKDERGNSKCTPIYSRIISLYAEQNELQFAVPGGLIGVGTTMDPTLTRADRLVGQVLGEIGSLPDVFVELEVNFFLLRRLLGVRTKGSEKQGKVSKLTKGEILMLNIGSMSTGAKVVGVKVDLAKLQLTAPVCTSKGEKVALSRRVEKHWRLIGWGQIQAGTTIEVPPSPF

SEQ ID NO: 17512 - protein, 459 aa, Artemisia annua
AKKGLMEQDLSKLDVAKLHPLSPEVISRQATINIGTIGHVAHGKSTVVKAISGVQTVRFKNELERNITIKLGYANAKIYKCEDEKCPRPMCYKAYGSGKEDSPACDVPGFENSKMKLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGAEVEEIRGGVAGGSILKGVLKVNQNIEVRPGIVVKDESGNIKCTPIYSRIVSLFAEQNELQFAVPGGLIGVGTTMDPMLTRADRLVGQVLGEVGSLPDVYVELEVNFFLLRRLLGVKTKGTERQGKVSKLSKAEILMLNIGSMSTGARVLAVKNDLAKLQLTSPKGEKIALSRRVEKHWRLIGWGQIQAGLTLEIPPCPI

SEQ ID NO: 17513 - protein, 465 aa, Brassica napus
  Sequence also found in Organisms: Brassica oleracea
MSRNKGLAEQDLSKLDVTVLHPLSPEVISRQATINIGTIGHVAHGKSTVVKAISGVQTVRFKNELERNITIKLGYANAKIYKCEDEKCPRPMCYKAYGSGKEDTPNCDVPGFENAKMKLLRHVSFVDCPGHDILMATMLNGAAIMDGALLLIAANETCPQPQTSEHLAAVEIMQLKHIIILQNKIDLIQENVAINQHEAIQKFIMNTVADGAPIVPVSAQLKYNIDVVCEYIVKKIPIPKRNFVSPPNMIVIRSFDVNKPGFEVDDIKGGVAGGSILRGVLKVNQLIEIRPGIVVKDERGNPKCTPIYSRIISLYAEQNELQFAVPGGLIGVGTTMDPTLTRADRLVGQVLGEIGSLPDVFVELEVNFFLLRRLLGVRTKGSEKQGKVSKLTKGEILMLNIGSMSTGAKVVGVKNDLAKLQLTAPVCTSKGEKVALSRRVEKHWRLIGWGQIQAGTTIEVPPSPF

SEQ ID NO: 17514 - protein, 455 aa, Cirsium arvense
MSRKGLMEQDLSKLDVAQLHPLSPEVISRQATINIGTIGHVAHGKSTVVKAISGVQTVRFKNELERNITIKLGYANAKIYKCEDERCPRPMCYKAYGSGKEDSPLCDVPGFENSKMTLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGSEVDEIRGGVAGGSILKGVLKVNQNIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTERQGKVSKLAKGEILMLNIGSMSTGARVLAVKNDLAKLQLTSPVCTSKGEKIALSRRVEKHWRLIGWGQIQAGL

SEQ ID NO: 17515 - protein, 466 aa, Trifolium pratense
MSRKGLMEQDLSKLDVTKLHPLSLEVISRQATINIGTIGHVAHGKSTVVKAISGVQTVRFKNELERNITIKLGYANAKIYKCEDERCPRPMSYKAYGSGKEDNPMCDVPGFENSKMKLLRHVSFVDCPGHDILMATMLNGAAIMDGALLLIAANESCPQPQTSEHLAAVEIMRLQHIIILQNKVDLIQENVAINQHEAIQKFIEGTVADGAPVVPISAQLKYNIDVVCEYIVKKIPIPERNFISPPNMIVIRSFDVNKPGFEVDEIKGGVAGGSILRGVLKVNQFIEVRPGIVIKDESGNIRCTPIYSRIVSLFAEQNELQFAVPGGLIGVGTTMDPTLTRADRLVGQVLGEVGSLPEVFVELEVNFFLLRRLLGVRTKGSERQGKVSKLVKAEMLMLNIGSMSTGARVIAVRNDLAKLQLTSPVCTSKGEKIALSRRVEKHWRLIGWGQIQAGITLQVPPTPILS

SEQ ID NO: 17516 - protein, 466 aa, Trifolium pratense
MSRKGLMEQDLSKLDVAKLHPLSPEVISRQATINIGTIGHVAHGKSTVVKAISGVQTVRFKNELERNITIKLGYANAKIYKCEDERCPRPMSYKAYGSGKEDNPMCEVPGFENCKMKLLRHVSFVDCPGHDILMATMLNGAAIMDGALLLIAANESCPQPQTSEHLAAVEIMRLQHIIILQNKVDLIQENVAINQHEAIQKFIEGTVADGAPVVPISAQLKYNIDVVCEYIVKKIPIPERNFISPPNMIVIRSFDVNKPGFEVDEIKGGVAGGSILRGVLKVNQFIEVRPGIVVKDESGNIKCTPIYSRIVSLFAEQNELQFAVPGGLIGVGTTMDPTLTRADRLVGQVLGEVGSLPEVYVELEVNFFLLRRLLGVRTKGSERQGKVSKLVKAEMLMLNIGSMSTGARVIAVRNDLAKLQLTSPVCTSRGEKIALSRRVEKHWRLIGWGQIQAGITLEVPTAPILS

SEQ ID NO: 17517 - protein, 464 aa, Pinus pinaster
MSKKGLMEQDLNKLDVTKLHPLSPEVISRQATINIGTIGHVAHGKSTVVKAISGVQTVRFKNELERNITIKLGYANAKIYKCEDDRCPRPMAYKAYGSGKEDSPLCDVAGFETTRMKLLRHVSFVDCPGHDILMATMLNGAAIMDGALLLIAGNESCPQPQTSEHLAAVEIMRLKHIIILQNKIDLIQESVAMNQHEAIQKFIQGTIADGAPVVPISAQLKYNIDVVCEYIVNKIPIPERNFVDPPNMIVIRSFDVNKPGAEVDEIKGGVAGGSILKGVLKVNQKIEVRPGIVVKDESGSIKCTPIFSRIISLYAEQNELQFAVPGGLIGVGTTIDPTLTRADRLVGQVLGEVGALPDVFVELEVNFFLLRRLLGVRTKGTEKQGKVSKLAKGEVLMLNIGSMSTGARVLAVKNDLAKLQLTSPVCTSKGEKMALSRRVEKHWRLIGWGQIQAGAMLDIPPASE

SEQ ID NO: 17518 - protein, 464 aa, Nicotiana benthamiana
MSRKGLMEQDLSKLDVTKLHPLSPEVISRQATINIGTIGHVAHGKSTVVKAISGVQTVRFKNELERNITIKLGYANAKIYKCEEERCPRPMCYKAYGSGKEDSPMCDVAGFENCRMKLLRHVSFVDCPGHDILMATMLNGAAIMDGALLLIAANESCPQPQTSEHLAAVEIMRLQHIIILQNKVDLVQENVAINQHEAIQKFIQGTVADAAPVVPISAQLKYNIDVVAEYIVKKIPIPERNFISPPNMIVIRSFDVNKPGFEVDDIRGGVAGGSILKGVLKVNQLIEVRPGIVVKDESGNIKCTPIYSRIVSLFAEQNELQFAVPGGLIGVGTSMDPTLTRADRLVGQVLGEVGSLPEVFVELEVNFFLLRRLLGVRTKDSERQGKVSKLAKGEILMLNIGSMSTGARVVAVKNVFAKLQLTSPVCTSKGEKIALSRRIEKHWRLIGWGQIQAGITIDIPPCPI

SEQ ID NO: 17519 - protein, 464 aa, Pinus taeda
MSRKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPLCDVAGFENTRMKLLRHVSFVDCPGHDILMATMLNGAAIMDGALLLIAGNESCPQPQTSEHLAAVEIMRLKHIIILQNKIDLIQESVAINQHEAIQKFIQGTIADGAPVVPISAQLKYNIDVVCEYITNKIPIPERNFVDPPNMIVIRSFDVNKPGAEVDDIKGGVAGGSILKGVLKVNQKIEVRPGIVVKDEGGNIKCTPIFSRIISLYAEQNELQFAVPGGLIGVGTTIDPMLTRADRLVGQVLGEVGELPDVFVELEVNFFLLRRLLGVRTKGTEKQGKVSKLAKGEVLMLNIGSMSTGARVLAVKNDLAKLQLTSPVCTSKGEKMALSRRVEKHWRLIGWGQIQAGAMLDIPPASE

SEQ ID NO: 17520 - protein, 464 aa, Picea glauca
MSRKGLMEQDLSKLDVTKLNPLSPEVISRQATINIGTIGHVAHGKSTVVKAISGVQTVRFKNELERNITIKLGYANAKIYKCEDEHCPRPMCYKAYGSGKEDSPLCEVSGFENTRMKLLRHVSFVDCPGHDILMATMLNGAAIMDGALLLIAGNESCPQPQTSEHLAAVEIMRLKHIIILQNKIDLIQESVAINQHEAIQKFIQGTIADGAPVVPISAQLKYNIDVVCEYITNKIPIPERNFVDPPNMIVIRSFDVNKPGAEVDEIKGGVAGGSILKGVLKVNQKIEVRPGIVVKDESGNIKCTPIFSRIISLYAEQNELQFAVPGGLIGVGTTIDPTLTRADRLVGQVLGEIGELPDVFVELEVNFFLLRRLLGVRTKGTEKQGKVSKLAKGEVLMLNIGSMSTGARVLAVKNDLAKLQLTSPVCTSKGEKMALSRRVEKHWRLIGWGQIQAGAMLDIPPASE

SEQ ID NO: 17521 - protein, 464 aa, Picea glauca
MSRKGLMEQDLSKLDVTKLNPLSPEVISRQATINIGTIGHVAHGKSTVVKAISGVQTVRFKNELERNITIKLGYANAKIYKCEDEHCPRPMCYKAYGSGKEDSPLCEVSGFENTRMKLLRHVSFVDCPGHDILMATMLNGAAIMDGALLLIAGNESCPQPQTSEHLAAVEIMRLKHIIILQNKIDLIQESVAINQHEAIQKFIQGTIADGAPVVPISAQLKYNIDVVCEYITNKIPIPERNFVDPPNMIVIRSFDVNKPGAEVDEIKGGVAGGSILKGVLKVNQKIEVRPGIVVKDESGNIKCTPIFSRIISLYAEQNELQFAVPGGLIGVGTTIDPTLTRADRLVGQVLGEIGELPDVFVELEVNFFLLRRLLGVRTKGTEKQGKVSKLAKGEVLMLNIGSMSTGARVLAVKNDLAKLQLTSPVCTSKGEKMALSRRVEKHWRLIGWGQIQAGAMLEIPQGSI

SEQ ID NO: 17522 - protein, 465 aa, Eutrema halophilum
MSRSKGLAEQDLKKLDVTVLHPLSPEVISRQATINIGTIGHVAHGKSTVVKAISGVQTVRFKNELERNITIKLGYANAKIYKCEDEKCPRPMCYKAYGSGKEDNPNCDVPGFENSKMKLLRHVSFVDCPGHDILMATMLNGAAIMDGALLLIAANETCPQPQTSEHLAAVEIMQLKHIIILQNKIDLIQENVAINQHEAIQKFIMNTVADGAPIVPVSAQLKYNIDVVCEYIVKKIPIPKRNFVSPPNMIVIRSFDVNKPGFEVDEIKGGVAGGSILRGVLKVNQLIEIRPGIVVKDERGNPKCTPIYSRIISLYAEQNELQFAVPGGLIGVGTTMDPTLTRADRLVGQVLGEIGSLPDVFVELEVNFFLLRRLLGVRTKGSEKQGKVSKLTKGEILMLNIGSMSTGAKVVGVKNDLAKLQLTAPVCTSKGEKVALSRRVEKHWRLIGWGQIQAGTTTEVPPSPF

SEQ ID NO: 17523 - protein, 464 aa, Vinca minor
MSRKGLMEQDLSKLDVTQLHPLTPEVISRQATINIGTIGHVAHGKSTVVKAISGVQTVRFKNELERNITIKLGYANAKIYKCEDEKSPRPACYKAYGSGKEDSPLCDVPGFENSRMKLLRHVSFVDCPGHDILMATMLNGAAIMDGALLLIAANESCPQPQTSEHLAAVEIMRLQHIIILQNKVDLVQENVAINQNEAIQNFIKGTVADGAPVVPISAQLKYNIDVVCEYIVKKIPIPERNFISPPNMIVIRSFDVNKPGFEIDDIRGGVAGGSILKGVFKVNQYIEVRPGIVVKDEKGNIKCTPIYSRIVSLYAEQNELQFAVPGGLIGVGTTMDPTLTRADRLVGQVLGEVGSLPEVFVELEVNFFLLRRLLGVRTKETEKQGKVSKLAKGEILMLNIGSMSTGARVVAVKNVFAKLQLTSPVCTSKDEKIALSRRIEKHWRLIGWGQIQAGVTLDVPPCPI

SEQ ID NO: 17524 - protein, 451 aa, Vaccinium corymbosum
LDVTQLHPLSPEVISRQATINIGTIGHVAHGKSTVVKAISGVQTVRFKNELERNITIKLGYANAKIYKCEEERCPRPMCYKAYGSGKEDSPMCDVPGFENCRMKLLRHVSFVDCPGHDILMATMLNGAAIMDGALLLIAANESCPQPQTSEHLAAVEIMRLQHIIILQNKVDLIQENVAINQHEAIQKFIEGTVADGAPVIPVSAQLKYNIDVVCEYIVKKIPIPERNFISPPNMIVIRSFDVNKPGFEVDEIRGGVAGGSILKGVLKVNQFIEVRPGIVVKDESGNIKCTPIYSRIVSLYAEQNELQFAVPGGLIGVGTTMDPTLTRADRLVGQVLGEVGSLPEVFVELEVNFFLLRRLLGVRTKGTEKQGKVSKLAKAEILMLNIGSMSTGARVVAVRNDLAKLQLTSPVCTSRGEKIALSRRVEKHWRLIGWGQIQAGITLEVPPCPI

SEQ ID NO: 17525 - protein, 464 aa, Daucus carota
MARKGLMEQDLSKLDVTQLHPLSPEVISRQATINIGTIGHVAHGKSTVVKAISGVQTVRFKNELERNITIKLGYANAKIYKCEDESCPRPKCYKAYGSGKEDAPQCDVPGFENSKMKLLRHVSFVDCPGHDILMATMLNGAAIMDGALLLIAANESCPQPQTSEHLAAIEIMRLKHIIILQNKVDLIQENVATNQHDAIQKFIQGTVADSSPVIPVSAQLKYNIDVVCEYIVKKIPIPERNFISPPNMIVIRSFDVNKPGSEVDEIRGGVAGGSILKGVLKVNQYIEVRPGIVVKDETGSIKCTPIYSRIVSLFAEQNELQFAVPGGLIGVGTTMDPTLTRADRLVGQVLGEVGSLPEVYVELEVNFFLLRRLLGVRTKGTERQGKVSKLTKGEILMLNIGSMSTGARVLAVRNDLAKLQLTSPVCTSKGEKIALSRRVEKHWRLIGWGQIQAGITLDIPPYSL

SEQ ID NO: 17526 - protein, 452 aa, Centaurea maculosa
MSRKGLMEQDLSKLDVTQLHPLSPEVISRQATINIGTIGHVAHGKSTVVKAISGVQTVRFKNELERNITIKLGYANAKIYKCEDERCPRPMCYKAYGSGKEDSPLCDVPGFENAKMTLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGSEVDEIRGGVAGGSILKGVLKVNQNIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTERQGKVSKLAKGEILMLNIGSMSTGARVLAVKNDLAKLQLTSPVCTSKGEKIALSRRVEKHWRLIGWGQIQ

SEQ ID NO: 17527 - protein, 464 aa, Solanum tuberosum
MSRKGLMEQDLSKLDVTKLHPLSPEVISRQATINIGTIGHVAHGKSTVVKAISGVQTVRFKNELERNITIKLGYANAKIYKCEEDRCPRPMCYKAYGSGKEDGPMCDVPGFETCRMKLLRHVSFVDCPGHDILMATMLNGAAIMDGALLLIAANESCPQPQTSEHLAAVEIMRLQHIIILQNKVDLVQENVGIKQHEAIQKLIQGTVADGAPVVPISAQLKYNIDVVAEYIVKKIPIPERNFISPPNMIVIRSFDVNKPGFEVDDIRGGVAGGSILKGVLKVNQLIEVRPGITVKDESGNIKCTPIYSRIVSLFAEQNELQFAVPGGLIGVGTTMDPTLTRADRLVGQVLGEVGSLPEVFVELEVNFFLLRRLLGVRTKDTERQGKVSKLAKGEILMLNIGSMSTGARVVAVKNVFAKLQLTSPVCTSKGEKIALSRRIEKHWRLIGWGQIQAGITLDVPPCPI

SEQ ID NO: 17528 - protein, 464 aa, Primula obconica
MSKKGLMEQDLSKLDVAALHPLSPEVISRQATINIGTIGHVAHGKSTVVKAISGVQTVRFKNELERNITIKLGYANAKIYKCEDDRCPRPMCYKAYGSGKEDNPMCDVPGFESCRMKLLRHVSFVDCPGHDILMATMLNGAAIMDGALLLIAANETCPQPQTSEHLAAVEIMRLQHIIILQNKVDLIQENVALNQHEAIQKFIQKTVADGAPIVPVSAQLKYNIDVVCEYLVKKIPIPERNFISPPNMIVIRSFDVNKPGFEVDEVRGGVAGGSILKGVLKVNQFIEVRPGIVVKDERGNIKCTPIYSRIVSLFAEQNELQFAVPGGLIGVGTTMDPTLTRADRLVGHVLGEVGSLPDVFVELEVNFFLLRRLLGVRTKGEERQGRVSKLAKAEILMLNIGSMSTGARVIAVKNDLAKLQLTSPVCTSKGEKIALSRRVEKHWRLIGWGQIQAGKTLEVPPCPI

SEQ ID NO: 17529 - protein, 465 aa, Eutrema halophilum
MSRNKGLAEQDLKKLDVTVLHPLSPEVISRQATINIGTIGHVAHGKSTVVKAISGVQTVRFKNELERNITIKLGYANAKIYKCEDEKCPRPMCYKAYGSGKEDNPNCDVPGFENSKMKLLRHVSFVDCPGHDILMATMLNGAAIMDGALLLIAANETCPQPQTSEHLAAVEIMQLKHIIILQNKIDLIQENVAINQHEAIQKFIMNTVADGAPIVPVSAQLKYNIDVVCEYIVKKIPIPKRNFVSPPNMIVIRSFDVNKPGFEVDEIKGGVAGGSILRGVLKVNQLIEIRPGIVVKDERGNPKCTPIYSRIISLYAEQNELQFAVPGGLIGVGTTMDPTLTRADRLVGQVLGEIGSLPDVFVELEVNFFLLRRLLGVRTKGSEKQGKVSKLTKGEILMLNIGSMSTGAKVVGVKNDLAKLQLTAPVCTSRGEKVALSRRVEKHWRLIGWGQIQAGTTTEVPPSPF

SEQ ID NO: 17530 - protein, 465 aa, Eutrema parvulum
MSRNKGLAEQDLSKLDVTVLHPLSPEVISRQATINIGTIGHVAHGKSTVVKAISGVQTVRFKNELERNITIKLGYANAKIYKCEDEKCPRPVCYKAYGSGKEDNPHCDVPGFENSKMKLLRHVSFVDCPGHDILMATMLNGAAIMDGALLLIAANETCPQPQTSEHLAAVEIMQLKHIIILQNKIDLIQENVAINQHEAIQKFIMNTVADGAPIVPVSAQLKYNIDVVCEYIVKKIPIPKRNFVSPPNMIVIRSFDVNKPGFEVDEIKGGVAGGSILRGVLKVNQLIEIRPGIVVKDERGNPKCTPIYSRIISLYAEQNELQFAVPGGLIGVGTTMDPTLTRADRLVGQVLGEIDSLPDVFVELEVNFFLLRRLLGVRTKGSEKQGKVSKLAKGEILMLNIGSMSTGAKVVGVKNDLAKLQLTAPVCTSKGEKVALSRRVEKHWRLIGWGQIQAGTTIEVPPSPF

SEQ ID NO: 17531 - protein, 465 aa, Brassica juncea
MSRNKGLAEQDLSKLDVTVLHPLSPEVISRQATINIGTIGHVAHGKSTVVKAISGVQTVRFKNELERNITIKLGYANAKIYKCEDEKCPRPMCYKAYGSGKEDTPNCDVPGFENAKMKLLRHVSFVDCPGHDILMATMLNGAAIMDGALLLIAANETCPQPQTSEHLAAVEIMQLKHIIILQNKIDLIQENVAINQHEAIQKFIMNTVADGAPIVPVSAQLKYNIDVVCEYIVKKIPIPKRNFVSPPNMIVIRSFDVNKPGFEVDEIKGGVAGGSILRGVLKVNQLIEIRPGIVVKDERGNPKCTPIYSRIISLYAEQNELQYAVPGGLIGVGTTMDPTLTRADRLVGQVLGEIGSLPDVFVELEVNFFLLRRLLGVRIKGSEKQGKVTKLTKGEILMLNIGSMSTGAKVVGVKNDLAKLQLTAPVCTSKGEKVALSRRVEKHWRLIGWGQIQAGTTIEVPPSPF

SEQ ID NO: 17532 - protein, 465 aa, Brassica rapa
MSRNKGLAEQDLSKLDVTVLHPLSPEVISRQATINIGTIGHVAHGKSTVVKAISGVQTVRFKNELERNITIKLGYANAKIYKCEDEKCPRPMCYKAYGSGKEDNPLCDVPGFENSKMKLLRHVSFVDCPGHDILMATMLNGAAIMDGALLLIAANESCPQPQTSEHLAAVEIMQLKHIIILQNKIDLIQENVAINQHEAIQKFIMNTVADGAPIVPVSAQLKYNIDVVCEYIVKKIPIPKRNFISPPNMIVIRSFDVNKPGFEVDEIKGGVAGGSILRGVLKVNQLIEIRPGIVVKDERGNPKCTPIYSRIISLYAEQNELQYAVPGGLIGVGTTMDPTLTRADRLVGQVLGEIGSLPDVFVELEVNFFLLRRLLGVRIKGSEKQGKVTKLTKGEVLMLNIGSMSTGAKVVGVKNDLAKLQLTAPVCTSKGEKVALSRRVEKHWRLIGWGQIQAGTTIEVPPSPF

SEQ ID NO: 17533 - protein, 465 aa, Chrysanthemum coronarium
MANKKGLMEQDLKKLDVAKLHPLSPEVISRQATINIGTIGHVAHGKSTVVKAISGVQTVRFKNELERNITIKLGYANAKIYKCEDERCPRPMCYKAYGSGKEDSPACDVPGFENSKMTLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIIKRIPIPERNFISPPNMIVIRSFDVNKPGAEVEEIRGGVAGGSILKGVLKVNQNIEVRPGIVVKDESGNIKCTPIYSRIVSLFAEQNELQFAVPGGLIGVGTTMDPMLTRADRLVGQVLGEVGSLPDVYVELEVNFFLLRRLLGVKTKGAERQGKVAKLAKAEILMLNIGSMSTGARVLAVKNDLAKLQLTSPVCTSKGEKIALSRRVEKHWRLIGWGQIQAGLTLEIPPCPI

SEQ ID NO: 17534 - protein, 466 aa, Panax ginseng
MARKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDAPLCDMPGFENARMNLLRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIVKRIPIPERNFISPPNMIVIRSFDVNKPGFEVDEIRGGVAGGSILKGVLKVNQYIEVRPGIVVKDESGNIKCTPIYSRIVSLYAEQNELQFAVPGGLIGVGTTMDPTLTRADRLVGQVLGEVGSLPEVYVELEVNFFLLRRLLGVRTKGTERQGKVSKLAKGEILMLNIGSMSTGARVLAVRNDLAKLQLTSPVCTSKGEKIALSRRVEKHWRLIGWGQIQAGILVIRNIDWIFK

SEQ ID NO: 17535 - protein, 458 aa, Podocarpus macrophillus
MEQDLSKLDVTKLHPLSPEVISRQATINIGTIGHVAHGKSTVVKAISGVQTVRFKNELERNITIKLGYANAKIYKCEDERCPRPMCYKAYGSGKEDSPLCDVPGFENTRMKLLRHVSFVDCPGHDILMATMLNGAAIMDGALLLIASNESCPQPQTSEHLAAVEIMRLQHIIILQNKIDLIQESVALNQQEAIQKFIQGTIADGAPVVPISAQLKYNIDVVCEYIVNKIPIPERNFVDPPNMIVIRSFDVNKPGAEVDEIKGGVAGGSILKGVLKVNQKIEVRPGIVVKDESGNIKCTPIFSRIISLYAEQNELQFAVPGGLIGVGTTIDPTLTRADRLVGQVLGEVGQLPNVFVELEVNFFLLRRLLGVRTKGTEKQGKVSKLAKAEVLMLNIGSMSTGAKVLAVKNDLAKLQLTSPVCTSKGEKVALSRRVEKHWRLIGWGQIQAGLMLDIPQGSI

SEQ ID NO: 17536 - protein, 470 aa, Ambrosia trifida
VIIIIIWARKGLMEQDLSKLDVSTLHPLSPEVISRQATINIGTIGHVAHGKSTVVKAISGVQTVRFKNELERNITIKLGYANAKIYKCEDERCPRPMCYKAYGSGKEDCPPCDVPGFENSKMKLMRHVSFVDCPGHDILMATMLNGAAIMDGALLLIAANESCPQPQTSEHLAAVEIMRLQHIIILQNKVDLIAEHVAINQHEAIQKFIQGTVADGAPVVPVSAQLRYNIDVVCEYIIKRIPIPERNFISPPNMIVIRSFDVNKPGSEVDEIRGGVAGGSILKGVLKVNQNIEVRPGIVVKDESGNIKCTPIYSRIVSLYAEQNELQYAVPGGLIGVGTTMDPMLTRADRLVGQVLGEVGSLPDVYVELEVNFFLLRRLLGVKTKGTEKQGKVSKLSKAEILMLNIGSMSTGARVLAVKNDLAKLQLTSPVCTSKGEKIALSRRVEKHWRLIGWGQIQAGLTLEIPPCPI

SEQ ID NO: 17537 - protein, 471 aa, Lupinus angustifolius
MSRKGLMEQDLKKLDVTKLHPLSPEVISRQATINIGTIGHVAHGKSTVVKAISGVQTVRFKNELERNITIKLGYANAKIYKCEDERCPRPMSYKAYGSGKEDTPVCDVPGFENSKMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFISPPNMIVIRSFDVNKPGFEVDDIKGGVAGGSILRGVLKVNQFIEVRPGIVVKDENGNIKCTPIYSRIVSLFAEQNELQFAVPGGLIGVGTTMDPTLTRADRLVGQVLGAVGSLPEVFVELEVNFFLLRRLLGVRTKGTERQGKVSKLAKGEMLMLNIGSMSTGARVVAVKNDLAKLQLTSPVCTSKGEKIALSRRVEKHWRLIGWGQIQAGITLDVPSAPFSAEDIIE

SEQ ID NO: 17538 - protein, 465 aa, Brassica oleracea
MSRNKGLAEQDLSKLDVTVLHPLSPEVISRQATINIGTIGHVAHGKSTVVKAISGVQTVRFKNELERNITIKLGYANAKIYKCEDDKCPRPMCYKAYGSGKEDNPLCDVPGFENSKMKLLRHVSFVDCPGHDILMATMLNGAAIMDGALLLIAANESCPQPQTSEHLAAVEIMQLKHIIILQNKIDLIQENVAINQHEAIQKFIMNTVADGAPILPVSAQLKYNIDVVCEYIVKKIPIPKRNFISPPNMIVIRSFDVNKPGFEVDEIKGGVAGGSILRGVLKVNQLIEIRPGIVVKDERGNPKCTPIYSRIISLYAEQNELQYAVPGGLIGVGTTMDPTLTRADRLVGQVLGEIGSLPDVFVELEVNFFLLRRLLGVRIKGSEKQGKVTKLTKGEILMLNIGSMSTGAKVVGVKNDLAKLQLTAPVCTSKGEKVALSRRVEKHWRLIGWGQIQAGTTIEVPPSPF

SEQ ID NO: 17539 - protein, 465 aa, Brassica napus
  Sequence also found in Organisms: Brassica rapa
MARNKGLAEQDLSKLDVTVLHPLSPEVISRQATINIGTIGHVAHGKSTVVKAISGVQTVRFKNELERNITIKLGYANAKIYKCEDDKCPRPMCYKAYGSGKEDTPNCDVPGFENAKMKLLRHVSFVDCPGHDILMATMLNGAAIMDGALLLIAANETCPQPQTSEHLAAVEIMQLKHIIILQNKIDLIQENVAINQHEAIQKFIMNTVADGAPIVPVSAQLKYNIDVVCEYIVKKIPIPKRNFVSPPNMIVIRSFDVNKPGFEVDDIKGGVAGGSILRGVLKVNQLIEIRPGIVVKDERGNPKCTPIYSRIISLYAEQNELQFAVPGGLIGVGTTMDPTLTRADRLVGQVLGEIGSLPDVFVELEVNFFLLRRLLGVRTKGSEKQGKVSKLTKGEILMLNIGSMSTGAKVVGVKNDLAKLQLTAPVCTSKGEKVALSRRVEKHWRLIGWGQIQAGTTIEVPPSPF

SEQ ID NO: 17540 - protein, 466 aa, Medicago truncatula
MSRKGLMEQDLSKLDVTKLNPLSPEVISRQATINIGTIGHVAHGKSTVVKAISGVQTVRFKNELERNITIKLGYANAKLYKCEDERCPRPMSYKAYGSGKEDNPMCDVAGFENCKMKLLRHVSFVDCPGHDILMATMLNGAAIMDGALLLIAANESCPQPQTSEHLAAVEIMRLQHIIILQNKVDLIQENVAINQHEAIQRFIEGTVADGAPVVPISAQLKYNIDAVCEYIVKKIPIPERNFVSPPNMIVIRSFDVNKPGFEVDEIKGGVAGGSILRGVLKVNQFIEVRPGIVVKDEDGNMRCTPIYSRIVSLYAEQNELQFAVPGGLIGVGTTMDPTLTRADRLVGHVLGEVGSLPEVFVELEVNFFLLRRLLGVRTKGSEKQGKVAKLTKSEILMLNIGSMSTGAKVTAVKNDLAKLQLTSPVCTSKGEKIALSRRVEKHWRLIGWGQIQAGITLEVPPTPILN

SEQ ID NO: 17541 - protein, 463 aa, Populus trichocarpa
MARKGLMEQDLSKLDVTKLHPLSPEVISRQATINIGTIGHVAHGKSTVVKAISGVQTVRFKNELERNITIKLGYANAKIYKCEDERCPRPKCYKAYGSGKEDNPVCDVDPKHCRMNLLRHVSFVDCPGHDILMATMLNGAAIMDGALLLIAANESCPQPQTSEHLAAVEIMRLQHIIILQNKVDLIQENAAINQHEAIQKFIQGTVADGAPVVPISAQLKYNIDVVCEYIIKKIPIPERNFTSPPNMIVIRSFDVNKPGYEVDEIRGGVAGGSIFRGVLKVNQFIEIRPGIIVKDDAGNMKCTPIYTRIVSLYAEQNELQFAVPGGLIGVGTTMDPTLTRADRLVGQVLGDVGSLPEIFGELEVNFFLLRRLIGVRTKGSEKQGKVSKLTKGEILMLNIGSMSSGARVIAVKNDLAKLQLTSPVCTSKGEKIALSRRVEKHWRLIGWGMIQAGTTIEVPPCPL

SEQ ID NO: 17542 - protein, 464 aa, Picea glauca
MSKKGLMEQDLNKLDVTKLNPLSPEVISRQATINIGTIGHVAHGKSTVVKAISGVQTVRFKNELERNITIKLGYANAKIYKCEDDRCPRPMSYKAYGSGKEDSPLCDVTGFDNTRMKLLRHVSFVDCPGHDILMATMLNGAAIMDGALLLIAGNESCPQPQTSEHLAAVEIMRLKHIIILQNKIDLIQESVAINQHEAIQKFIQGTIADGAPVVPISAQLKYNIDVVCEYIVNKIPIPERNFVDPPNMIVIRSFDVNKPGAEVDEIKGGVAGGSILKGVLKVNQKIEVRPGIVVKDENGNIKCTPIFSRIISLYAEQNELQFAVPGGLIGVGTTIDPTLTRADRLVGQVLGEVGELPDIFVELEVNFFLLRRLLGVRTKGTEKQGKVSKLAKGEVLMLNIGSMSTGARVLAVKNDLAKLQLTSPVCTSKGEKMALSRRVEKHWRLIGWGQIQAGAMLEIPQGSI

SEQ ID NO: 17543 - protein, 460 aa, Vinca minor
RKGLTEQDLSKLDVTQLHPLSPEVISRQATINIGTIGHVAHGKSTVVKAISGVQTVRFKNELERNITIKLGYANAKIYKCEDEKSPRPACYKAYGSGKEDSPLCDVPGFENSRMKLLRHVSFVDCPGHDILMATMLNGAAIMDGALLLIAANESCPQPQTSEHLAAVEIMRLQHIIILQNKVDLVQENVAINQNEAIQNFIKGTVADGAPVVPISAQLKYNIDVVCEYIVKKIPIPERNFISPPNMIVIRSFDVNKPGFEIDDIRGGVAGGSILKGVLKVNQHIEVRPGIVVKDEKGNIKCTPIYSRIVSLYAEQNELQFAVPGGLIGVGTTMDPTLTRADRLVGQVLGEVGSLPEVFVELEVNFFLLRRLLGVRTKDTEKQGKVSKLAKGEILMLNIGSMSTGARVVAVKNVFAKLQLTSPVCTSKNEKIALSRRIEKHWRLIGWGAIQAGVTLDVPPC

SEQ ID NO: 17544 - protein, 465 aa, Brassica napus
  Sequence also found in Organisms: Brassica oleracea
MARNKGLAEQDLSKLDVAVLHPLSPEVISRQATINIGTIGHVAHGKSTVVKAISGVQTVRFKNELERNITIKLGYANAKIYKCEDDKCPRPMCYKAYGSGKEDSPNCDVPGFENAKMKLLRHVSFVDCPGHDILMATMLNGAAIMDGALLLIAANETCPQPQTSEHLAAVEIMQLKHIIILQNKIDLIQENVAINQHEAIQKFIMNTVADGAPIVPVSAQLKYNIDVVCEYIVKKIPIPKRNFVSPPNMIVIRSFDVNKPGFEVDDIKGGVAGGSILRGVLKVNQLIEIRPGIVVKDERGNPKCTPIYSRIISLYAEQNELQYAVPGGLIGVGTTMDPTLTRADRLVGQVLGEIGSLPDVFVELEVNFFLLRRLLGVRTKGSEKQGKVSKLTKGEILMLNIGSMSTGAKVVGVKNDLAKLQLTAPVCTSKGEKVALSRRVEKHWRLIGWGQIQAGTTIEVPPSPF

SEQ ID NO: 17545 - protein, 465 aa, Brassica napus
MSRNKGLAVQDLSKLDVTVLHPLSPEVISRQATINIGTIGHVAHGKSTVVKAISGVQTVRFKNELERNITIKLGYANAKIFKCEDDKCPRPMCYKAYGSGKEDNPLCDVPGFENSKMKLLRHVSFVDCPGHDILMATMLNGAAIMDGALLLIAANESCPQPQTSEHLAAVEIMQLKHIIILQNKIDLIQENVAINQHEAIQKFIMNTVADGAPILPVSAQLKYNIDVVCEYIVKKIPIPKRNFISPPNMIVIRSFDVNKPGFEVDEIKGGVAGGSILRGVLKVNQLIEIRPGIVVKDERGNPKCTPIYSRIISLYAEQNELQYAVPGGLIGVGTTMDPTLTRADRLVGQVLGEIGSLPDVFVELEVNFFLLRRLLGVRIKGSEKQGKVTKLTKGEILMLNIGSMSTGAKVVGVKNDLAKLQLTAPVCTSKGEKVALSRRVEKHWRLIGWGQIQAGTTIEVPPSPF

SEQ ID NO: 17546 - protein, 466 aa, Trigonella foenum-graecum
MSRKGLMEQDLSKLDVTKLHPLSPEVISRQATINIGTIGHVAHGKSTVVKAISGVQTVRFKNELERNITIKLGYANAKIYKCEDERCPRPMSYKAYGSGKEDNPMCDVVGFENCKMKLLRHVSFVDCPGHDILMATMLNGAAIMDGALLLIAANESCPQPQTSEHLAAVEIMRLQHIIILQNKVDLIQENVAINQHEAIQKFIEGTVADGAPVVPISAQLKYNIDAVCEYLVKKIPIPERNFISPPNMIVIRSFDVNKPGFEVDEIKGGVAGGSILRGVLKVNQFIEVRPGIVVKDEGGNMRCTPIYSRIVSLYAEQNELQFAVPGGLIGVGTTMDPTLTRADRLVGHVLGEVGSLPEVFVELEVNFFLLRRLLGVRTKGSERQGKVAKLAKAEMLMLNIGSMSTGARVIAVKNDLAKLQLTSPVCTSKGEKIALSRRVEKHWRLIGWGQIQAGITLDVPPAPILN

SEQ ID NO: 17547 - protein, 465 aa, Vinca minor
MSRKGLMEQDLSKLDVTQLHPLSPEVISRQATINIGTIGHVAHGKSTVVKAISGVQTVRFKNELERNITIKLGYANAKIYKCEDEKCPRPARYKAYGSGKEDSPLCDVPGFENSRMKLLRHVSFVDCPGHDILMATMLNGAAIMDGALLLIAANESCPQPQTSEHLAAVEIMRLQHIIILQNKVDLVQENVAINQNEAIQNFIKGTVADGAPVVPISGQLKYNIDVVCEYLVKKVPIPERNFISPPNMIVIRSFDVNKPGFEIDDIRGGVAGGSILKGVLKVNQNIEVRPGIVVKDENGNIKCTPIYSRIVSLYAEQNELQFAVPGGLIGVGTTMDPTLTRADRLVGQVLGEIGSLPEVFVELEVNFFLLRRLIGVRTKDTEKQGKVAKLAKGEILMLNIGSMSTGARVVAVKNVFAKLQLTSPVCTSKDEKIALSRRIEKHWRLIGWGQIQAGVTLDVPPCPII

SEQ ID NO: 17548 - protein, 464 aa, Abies balsamea
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDAVGFENARMKLLRHVSFVDCPGHDILMATMLNGAAIMDGALLLIAGNESCPQPQTSEHLAAVEIMRLKHIIILQNKIDLIQESVAINQHEAIQKFIQGTIADGAPVVPISAQLKYNIDVVCEYIINKIPIPERNFVDPPNMIVIRSFDVNKPGAEVDEIKGGVAGGSILKGVLKVDQKIEVRPGIVVKDESGNIKCIPIFSRIISLYAEQNELQFAVPGGLIGVGTTIDPTLTRADKLVGQVLGEVGELPDVFVELEVNFFLLRRLLGVRTKGTEKQGKVTKLAKGEVLMLNIGSMSTGARVLAVKNDLAKLQLTSPVCTSKGEKMALSRRVEKHWRLIGWGQIQAGAMLDIPPASE

SEQ ID NO: 17549 - protein, 464 aa, Ocimum basilicum
MSRKGLMEQDLSKLDVTKLNPLSPEVISRQATINIGTIGHVAHGKSTVVKAISGVQTVRFKNELERNITIKLGYANAKIYKCEEDRCPRPMCYKAYGSGKEDSPMCDVPGFENSRMKLLRHVSFVDCPGHDILMATMLNGAAIMDGALLLIAANESCPQPQTSEHLAAVEIMRLQHIIILQNKVDLVQENVAINQHEAIQKFIEGTVAGGAPVVPISAQLKYNIDVVCEYIVKKIPIPVRDFTSAPNMIVIRSFDVNKPGSEVDEIKGGVAGGSILKGVLKVNQHIEVRPGIVVKDENDNIKCTPIYSRIVSLFAEQNELQFAVPGGLIGVGTTMDPTLTRADRLVGQVLGEVGSLPEVYVELEVNFFLLRRLLGVRTKDTERQGKVTKLAKGEMLMLNIGSMSTGARVIAVKNVFAKLQLTSPVCTSKGEKIALSRRIDRHWRLIGWGQIQAGITLDVPSCPI

SEQ ID NO: 17550 - protein, 469 aa, Triphysaria pusilla
MAARKGLMEQDLSKLDVTKLHPLSPEVISRQATINIGTIGHVAHGKSTVVKAISGVQTVRFKNELERNITIKLGYANAKIYKCEDDKCPRPMCYKAYGSGKEDSPMCDVPGFESCRMKLLRHVSFVDCPGHDILMATMLNGAAIMDGALLLIAANESCPQPQTSEHLAAVEIMRLKHIIILQNKVDLVQENVAINQHEAIQKFIQGTVADNAPVVPISAQLKYNIDVVAEYITKKIPIPERNFISPPNMIVIRSFDVNKPGSEVDEIKGGVAGGSILQGVLRVNQFIEVRPGIVVKDENDNQKCTPIYSRIVSLYAEQNELQFAVPGGLIGVGTTMDPTLTRADRLVGQVLGEVGSLPEVYIELEVNFFLLRRLLGVRTKDSERQGKVSKLAKGEILMLNIGSMSTGARVVAVKNVFAKLHLTAPVCTSKGEKIALSRRIDRHWRLIGWGAIQAGITLEVPPCPVEVTQ

SEQ ID NO: 17551 - protein, 469 aa, Triphysaria pusilla
MAARKGLMEQDLSKLDVTKLHPLSPEVISRQATINIGTIGHVAHGKSTVVKAISGVQTVRFKNELERNITIKLGYANAKIYKCEDDKCPRPMCYKAYGSGKEDSPMCDVPGFESCRMKLLRHVSFVDCPGHDILMATMLNGAAIMDGALLLIAANESCPQPQTSEHLAAVEIMRLNHIIILQNKVDLVQENVAINQHEAIQKFIQGTVADNAPVVPISAQLKYNIDVVAEYITKKIPIPERNFISPPNMIVIRSFDVNKPGSEVDEIKGGVAGGSILQGVLRVNQYIEVRPGIVVKDENDNQKCTPIYSRIVSLYAEQNELQFAVPGGLIGVGTTMDPTLTRADRLVGQVLGEVGSLPEVYIELEVNFFLLRRLLGVRTKDSERQGKVSKLAKGEILMLNIGSMSTGARVVAVKNVFAKLHLTAPVCTSKGEKIALSRRIDRHWRLIGWGAIQAGITLEVPPCPVEVTQ

SEQ ID NO: 17552 - protein, 465 aa, Brassica rapa
MARNKGLAEQDLSKLDVAVLHPLSPEVISRQATINIGTIGHVAHGKSTVVKAISGVQTVRFKNELERNITIKLGYANAKIYKCEDDKCPRPMCYKAYGSGKEDSPNCDVPGFENAKMKLLRHVSFVDCPGHDILMATMLNGAAIMDGALLLIAANETCPQPQTSEHLAAVEIMQLKHIIILQNKIDLIQENVAINQHEAIQKFIMNTVADGAPIVPVSAQLKYNIDVVCEYIVKKIPIPKRNFVSPPNMIVIRSFDVNKPGFEVDDIKGGVAGGSILRGVLKVNQLIEIRPGIVVKDERGNPKCTPIYSRIISRYAEQNALQYAVPGGLIGVGTTMDPTLTRADRLVGQVLGEIGSLPDVFVELEVNFFLLRRLLGVRTKGSEKQGKVSKLTKGEILMLNIGSMSTGAKVVGVKNDLAKLQLTAPVCTSKGEKVALSRRVEKHWRLIGWGQIQAGTTIEVPPSPF

SEQ ID NO: 17553 - protein, 458 aa, Abies balsamea
MEQDLNKLDATKLHPLSPEVISRQATINIGTIGHVAHGKSTVVKAISGVQTVRFKNELERNITIKLGYANAKIYKCDDERCPRPMSYKAYGSGKEDSPLCDVAGFENTRMKLLRHVSFVDCPGHDILMATMLNGAAIMDGALLLIAGNESCPQPQTSEHLAAVEIMRLKHIIILQNKIDLIQESVAINQHEAIQKFIQGTIADGAPVVPISAQLKYNIDVVCEYIVNKIPIPERDFVAPANMIVIRSFDVNKPGAEVDEIKGGVAGGSILRGVLKVNQKIEVRPGIVVKDESGNIKCTPIFSRIISLCAEQNELQFAVPGGLIGVGTTIDPTLTRADRLVGQVLGEVGELPDIFVELEVNFFLLRRLLGVRTKGTEKQGKVSKLAKGEVLMLNIGSMSTGARVLAVKNDLAKLQLTSPVCTSKGEKMALSRRVEKHWRLIGWGQIQAGAMLEIPQESI

SEQ ID NO: 17554 - protein, 463 aa, Pteridium aquilinum
MARRGLMEQDLSKLDVTKLTPLSPEVISRQATINIGTIGHVAHGKSTVVKAISGVQTVRFKNELERNITIKLGYANAKIYVCEDEKCPRPMCYKAYGSGKEDTPLCDVPGFENARMKLLRHVSFVDCPGHDILMATMLNGAAIMDGALLLIAGNESCPQPQTSEHLAAVEIMRLKHIIILQNKIDLVQESVALNQHEAIQKFIEGTIAGGAPVVPISAQLKYNIDVVCEYIVNKIPIPERNFTDPPNMIIIRSFDVNKPGAEVDEIKGGVAGGSILKGVLRVGQKIEVRPGIVVKDENNNIKCTPIFSRIISLYAEQNELQFAVPGGLIGVGTTVDPTLTRADRLVGQVLGECGVLPEVYLELEVNFFLLRRLLGVKIKGAEKQGRVTKLTKGEVLMLNIGSMSTGARVVAVKNDVAKLQLMSPVCTSKGEKVALSRRVEKHWRLIGWGQIQAGHTLDLPPVA

SEQ ID NO: 17555 - protein, 449 aa, Panax ginseng
MQRRKLFMRMMKDLSKLDVTKLHPLSPEVISRQATINIGTIGHVAHGKSTVVKAISGVQTVRFKNELERNITIKLGYANAKIYKCEDERCPRPMCYKAYGSGKEDAPVCDVPGFENSRMKLLRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLKYNIDVVCEYIVKRIPIPERNFISPPNMIVIRSFDVNKPGFEVDEIRGGVAGGSILKGVLRVNQYIEVRPGIVVKDESGNIKCTPIYSRIVSLYAEQNELQFAVPGGLIGVGTTMDPTLTRADRLVGQVLGEVGSLPEVYVELEVNFFLLRRLLGVRTKGTERQGKVSKLAKGEILMLNIGSMSTGARVLAVKNDLAKLQLTSPVCTSKGEKIALSRRVEKHWRLI

SEQ ID NO: 17556 - protein, 463 aa, Cyclamen graecum
MSRKGLMEQDLSKLDVTTLHPLSPEVISRQATINIGTIGHVAHGKSTVVKAISGVQTVRFKNELERNITIKLGYANAKIFKCEDDRCPRPMCYKSYGSGKEDCPMCDVPGFENSRMKLLRHVSFVDCPGHDILMATMLNGAAIMDGALLLIAANESCPQPQTSEHLAAVEIMRLKHIIILQNKVDLIQENVAINQHEAIKKFIEGTVADKAPVVPVSAQLKYNIDVVCEYIVKKIPIPERDFISPPNMIVIRSFDVNKPGFEVDDIRGGVAGGSILKGVLKVNQLIEVRPGIVVKDESGNIKCTPIYSRIISLYAEQNELQFAVPGGLIGVGTTMDPTLTRADRLVGHVLGEVGSLPEVFVELEVNFFLLRRLLGVRTKGTERQGRVTKLARAEILMLNIGSMSTGARVVAVRNDLAKLQLTSPVCTSRGEKIALSRRVEKHWRLIGWGQIQAGITLDIPPFE

SEQ ID NO: 17557 - protein, 464 aa, Plantago ovata
MARKGLMEQDLSKLDVAQLHPLSPEVISRQATINIGTIGHVAHGKSTVVKAISGVQTVRFKNELERNITIKLGYANAKIYKCEDDRCPRPMCYKAYGSGKEDSPMCDVPGFENSRMKLLRHVSFVDCPGHDILMATMLNGAAIMDGALLLIAANETCPQPQTSEHLAAVEIMRLQNIIILQNKVDLVQENVAINQHEAIQKFIEGTVADSAPVVPISAQLKYNIDVVCEYIVKRIPIPKREFILPPNMIVIRSFDVNKPGFEVDDVKGGVAGGSILKGVLKVNQKIEVRPGIVVKDESGNIKCTPIYSRIVSLYAEQNELQYAVPGGLIGVGTTMDPTLTRADRLVGQVLGEVGSLPEVYVELEVNFFLLRRLLGVRTKESEKQGRVSKLGKGEILMLNIGSMSTGARVIAVKNVFAKLQLTSPVCTSIGEKVALSRRIEKHWRLIGWGQIQAGKTLDIPPCPI

SEQ ID NO: 17558 - protein, 465 aa, Lupinus angustifolius
MEQDLKKLDVTKLHPLSPEVISRQATINIGTIGHVAHGKSTVVKAISGVQTVRFKNELERNITIKLGYANAKIYKCEDERCPRPMSYKAYGSGKEDAPMCDAPGFENSKMKLLRHVSFVDCPGHDILMATMLNGAAIMDGALLLIAANESCPQPQTSEHLAAVEIMRLQHIIILQNKVDLIQENVAINQHEAIQKFIQGTVADGAPVVPISAQLKYNIDVVCEYIVKKIPIPERNFISPPNMIVIRSFDVNKPGFEVDDIKGGVAGGSILRGVLKVNQFIEVRPGIVVKDENGNIKCTPIYSRIVSLFAEQNELQYAVPGGLIGVGTTMDPTLTRADRLVGQVLGSVGSLPEVFVELEVNFFLLRRLLGVRTKGTERQGKVSKLAKGEMLMLNIGSMSTGARVVAVKNDLAKLQLTSPVCTSKGEKIALSRRVEKHWRLIGWGQIQAGITLDVPSAPFSAEDIKE

SEQ ID NO: 17559 - protein, 463 aa, Physcomitrella patens
MAKRGLMEQDLSKLDVTTLHPLSPEVISRQATINIGTIGHVAHGKSTVVKAISGVQTVRFKNELERNITIKLGYANAKIYKCEDERCPRPMSYKAYGSAKEDNPLCDVPGYESARMKLLRHVSFVDCPGHDILMATMLNGAAIMDGALLLIASNESCPQPQTSEHLAAVEIMRLKHIIILQNKIDLIQESVAINQHESIQKFIQGTIADGAPVVPISAQLKYNVDVVCEYIVNKIPIPERNFVAPPNMIVIRSFDVNKPGAEVDEIKGGVAGGSILRGVLRVGQRIEVRPGITTKDESGGIKCTPIFSRITSLFAEKNELQFAVPGGLIGVGTTIDPTLTRADRLVGQVLGEVGELPDVFVELEVNFFLLRRLLGVRTKGSEKQGKVSKLTKSEVLMLNIGSMSTGARVIAVKNDLAKLQLTTPVCTSKGEKVALSRRVEKHWRLIGWGQIQAGVVIDIPQTA

SEQ ID NO: 17560 - protein, 463 aa, Ceratodon purpureus
MAKRGLMEQDLSKLDVTTLHPLSPEVISRQATINIGTIGHVAHGKSTVVKAISGVQTVRFKNELERNITIKLGYANAKIYKCEDERCPRPMSFKAYGSGKEDSPLCDVPGFETARMKLLRHVSFVDCPGHDILMATMLNGAAIMDGALLLIASNESCPQPQTSEHLAAVEIMRLKHIIILQNKIDLIQESVAINQHESIQKFIQGTIADGAPVVPISAQLKYNVDVVCEYIVNKIPIPVRDFVAPPNMIVIRSFDVNKPGAEVDDIKGGVAGGSILRGVLRVGQKIEVRPGITTKDENGGVKCTPIFSRIVSLFTEANELQFAVPGGLIGVGTTIDPTLTRADRLVGQVLGEVGELPDVFVELEVNFFLLRRLLGVRTKGSEKQGKVSKLTKSEVLMLNIGSMSTGARVIAVKNDLAKLQLTTPVCTSKGEKVALSRRVEKHWRLIGWGQIQAGVVIDIPQAA

SEQ ID NO: 17561 - protein, 475 aa, Festuca arundinacea
MARRGLMEQDLSKLDVTKLHPLSPEVISRQATINIGTIGHVAHGKSTVVKAISGVQTVRFKNELERNITIKLGYANAKIYKCEDDRCPRPVCYKAYGSGKEDTPACDVPGFENTRMKLLRHVSFVDCPGHDILMATMLNGAAIMDGALLLIAANESCPQPQTSEHLAAVEIMRLQHLIILQNKIDLIQESAAMNQHEAIQKFIQGTIAEGAPVVPISAQLKYNIDVICEYIVKKIPIPERNFTSPPNMIVIRSFDVNKPGSEVDEIRGGVAGGSILRGVLRVNQNIEVRPGIVMKDESGNIKCTPIYSRIVSLYAEQNELQFAVPRGLIGVGTTMDPTLTRADRLVGQVLGEIGSPPDVFVELEINFFLLRRLLGVRTKGTEKAGKVSKLTKGEILMLNIGSMSTGARVVAVKNDLAKLQRRSRPHLPAVKHTPRNLREKRDEMWKGRELLGTIFLKWRRNMSLEVFVVAGYDPG

SEQ ID NO: 17562 - protein, 477 aa, Solanum lycopersicum
MSRKGLMEQDLSKLDVTKLHPLSPEVIARQATINIGTIGHVAHGKSTVVKAISGVQTVRFKNELERNITIKLGYANAKIYKCEEERCPRPACYKAYGSGKEDNPMCDVPGFENCKMKLLRHVSFVDCPGHDILMATMLNGAAIMDGALLLIAANESCPQPQTSEHLAAVEIMRLQHIIILQNKVDLVQENVAINQHEAIQKFIQGTVADGAPVVPISAQLKYNIDVVCEYIVKKIPIPERNFISPPNMIVIRSFDVNKPGFEVDDIRGGVAGGSILKASFSISAINDMMQGVLKVNQLIEIRPGIVVKDESGNIKCTPIYSRIVSLFAEQNELQFAVPGGLIGVGTTMDPTLTRADRLVGQVLGEVGSLPEVYVELEVNFFLLRRLLGVRTKDSERQGRVSKLAKGEILMLNIGSMSTGARVVAIKNVFAKLQLTSPVCTSKGEKIALSRRIEKHWRLIGWGEIQAGITLDVPSSPL

SEQ ID NO: 17563 - protein, 464 aa, Orobanche aegyptiaca
MSRKGLMEQDLSKLDVTQLHPLSPEVISRQATINIGTIGHVAHGKSTVVKAISGVQTVRFKNELERNITIKLGYANAKIYKCENEKCPRPMCYKAYGSGKEDSPMCDVPGFEHCRMRLLRHVSFVDCPGHDILMATMLNGAAIMDGALLLIAANESCPQPQTSEHLAAIEIMRLKHIIILQNKVDLVQENVAVNQHEAIQRFIQGTVAGGAPVIPISAQLKYNIDVVAEYIIKKIPVPERNFISPPNMIVIRSFDVNKPGSEVDEIRGGVAGGSILKGVLKVNQLIEVRPGIVVKDENDDIRCTPIYSRIVSLYAEQNELQFAVPGGLIGVGTTMDPTLTRADRLVGQVLGEVGSLPEVYVELEVNFFLLRRLLGVRARDTERQGRVSKLTKAEILMLNIGSMSTGARVIGVKNVFAKLQLTSPVCTGIGEKIALSRRIDRHWRLIGWGEIRAGTTLDIPPRPI

SEQ ID NO: 17564 - protein, 479 aa, Ananas comosus
MSRKGLMEQDLSKLDVTKLHPLSPEVISRQATINIGTIGHVAHGKSTVVKAISGVQTVRFKNELERNITIKLGYANAKIYKCEDERCPRPMCYKAYGSGKEDSPLCDVPGFENTRMKLLRHVSFVDCPGHDILMATMLNGAAIMDGALLLIAGNESCPQPQTSEHLAAVEIMRLQHIIILQNKIDLIQESAAINQHEAIQKFIQGTIADGAPVVPISAQLKYNIDVVCEYIVKKIPIPERNFTSPPNMIVIRSFDVNKPGSEVDEIKGGVAGGSILRGVLKVNQFIEVRPGIVIKDESGNIKCTPIYSRIVSLYAEQNELQFAVPGGLIGVGTTMDPTLTRADRLVGQVLGEVGSLPDVFVELEVNFFLLRRLLGVRTKGTEKQGKVSKLAKGEILMLNIGSMSTGARVVAVKNDLAKLQLTAPVCTSKGEKWHSADESRSIGGLSAGARSRLVSLLKSPLAQSDNLLPFPINESLPAN

SEQ ID NO: 17565 - protein, 433 aa, Elaeis guineensis
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENTRMKLLRHVSFVDCPGHDILMATMLNGAAIMDGALLLIAGNESCPQPQTSEHLAAVEIMRLQHIIILQNKIDLIQESVAINQHEAIQKFIQGTIADGAPVVPVSAQLKYNIDVVCEYLVNKIPIPERDFTSPPNMIVIRSFDVNKPGSEVDEIKGGVAGGSILRGVLKVNEPIEVRPGIVVKDENGNIKCTPIYSRIVSLYAEQNELQFAVPGGLIGVGTTMDPTLTRADRLVGQVLGQVGSLPDVFVELEVNFFLLRRLLGVRTKGTEKQGKVSKLAKGEILMLNIGSMSTGARVIAVKNDLAKLQLTAPVCTSKKGEG

SEQ ID NO: 17566 - protein, 437 aa, Flaveria ramosissima
MARKGLMEQDLSKLDVTTLHPLSPEVISRQATINIGTIGHVAHGKSTVVKAISGVQTVRFKNELERNITIKLGYANAKIYKCEDDRCPRPMCYKAYGSGKEDNPPCDVPGFENSKMKLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLRYNIDVVCEYIIKRIPIPERNFISPPNMIVIRSFDVNKPGSEVDEIRGGVAGGSILKGVLKVNQHIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTEKQGKVSKLSKAEILMLNIGSMSTGARVLAVKNDLAKLQLTSPVCTSKGEKIALSR

SEQ ID NO: 17567 - protein, 438 aa, Sequoia sempervirens
MSRRGLMEQDLAKLDVAKLHPLSPEVISRQATINIGTIGHVAHGKSTVVRAISGVQTVRFKNELERNITIKLGYANAKIYKCEDDRCPRPMCYKAYGSGKEDSPFCDVPGFENARMKLLRHVSFVDCPGHDILMATMLNGAAIMDGALLLIASNESCPQPQTSEHLAAVEIMRLQHIIILQNKIDLIQESVANNQHEAIQKFIQGTIADGAPVVPISAQLKYNIDVVCEYITNKIPIPERNFVAPPNMIVIRSFDVNKPGAEVDEIKGGVAGGSILRGVLKVNQKIEVRPGIVVKDESGNIKCTPIFSRIISLYAEQNELQFAVPGGLIGVGTTIDPTLTRADRLVGQVLGEVGELPDVFVELEVNFFLLRRLLGVRTKGTEKQGKVSKLAKGEVLMLNIGSMSTGARVLAVKNDLAKLQLTSPVCTSKGEKWHLADE

SEQ ID NO: 17568 - protein, 437 aa, Taraxacum officinale
MSRKGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPQCDVPGFENSKMTLMRHVSFVDCPGHDILMATMLNGAAIMDGALLLIAANESCPQPQTSEHLAAVEIMRLQHIIILQNKVDLIQENVAINQHESIQKFIQGTVADGAPVIPVSAQLKYNIDVVCENIIKRIPIPERNFISPPNMIVIRSFDVNKPGSEVDEIRGGVAGGSILKGVLKVNQFIEVRPGIVVKDESGNIKCTPIYSRIVSLYAEQNELQFDVPGGLIGVGTTMDPMLTRADRLVGQVLGEVGSLPDVYVELEVNFFLLRRLLGVKTRGTERQGKVSKLSKAEILMLNIGSMSTGARVLAVKNDLAKLQLTSPVCTSKGEKIALSR

SEQ ID NO: 17569 - protein, 483 aa, Selaginella moellendorffii
VLWFGHFGQAAQARQGTMSSSRRALTEQDLSKLDAAKLTPQSPEVISRQATINIGTIGHVAHGKSTVVKAISGVQTVRFKNELERNITIKLGYANAKIYMCEDERCPRPKCYKAYGSGKEDSPFCDVPGFENCRMVLKRHVSFVDCPGHDILMATMLNGAAIMDGALLLIASNESCPQPQTSEHLAAVEIMRLKHIIILQNKIDLIQESVALNQYDAIKKFIQGTVADNAPVVPVSAQLKYNVDVVCEYIVKKIPIPERDFISPPNMIVIRSFDVNKPGAEVDEIKGGVAGGSILRGVLKLGQKVEVRPGIVAKDDKGNIKCTPIFSRIVSLFAEQNELQFAVPGGLIGVGTTIDPTLTRADRLVGQVLGEVGALPDVFVELEVNFFLLRRLLGVRTKGSEKQEKVSKLAKGEMLMLNIGSMSTGARVLAVKNDLAKLQLTSPVCTSKGEKVALSRRVEKHWRLIGWGQIQAGMTIDIPAVSV

SEQ ID NO: 17570 - protein, 408 aa, Setaria italica
MEQDLSKLDVTKLHPLSPEVISRQATINIGTIGHVAHGKSTVMKAISGVQTVRFKNEPEHNITIKLGYANAKIYKCEDDRCPQPMAYGRGKEDSPLCDVPGFENTRMKLPRHVSFVDCPGHDILMATMLNGAAIMDGALLLIAANESCPQPQTFEHLAANKIDLIQESAAMNQHEAIQKFIQGTIAEGAPVVPISAQLEYNIDVICEYIVKKIPIPERNFTSPPNMIVIRSFDQSNASLQGVLRVNQKIEVRPGIVMKDENGNIKCTPIYSRIVSLYAEQNELQFAVPGGLIGVGTTMDPTLTRADRLVGQVLGEVGSLPDVYVELEAGKVSKLTKGEILMLNIGSMSTGARVLAVKNDLAKLQLTAPVCMSRGEKVALSRHVEKHWRLIGWGQIQAGMTLEVPPCPL

SEQ ID NO: 17571 - protein, 464 aa, Eutrema halophilum
MSRNKGLAEQDLSKLDVSLLHPLSPEVISRQPTINIGTIGHVAHGKSTVVKAISGVQTVRFKNELERNITIKLGYANAKIYKCENDKCPRPMCYKSYGSGKEDNPICEFDNSKMKLLRHVSFVDCPGHDILMATMLNGAAIMDGALLLIAANETCPQPQTAEHLASVDMMHLKHIIILQNKVDLIQETAAVKQHEAIQKFIMNTNAEGAPIVPVSAQLKYNIDVLCEYIVKKIPIPKRDFVSPPKMIVIRSFDVNKPGYQVDDIKGGVAGGSILRGVLKVNQFIEIRPGIVGKDELGNPKCSPIYSRITSLFAEQNELQFAVPGGLIGVGTTMDPTLTRADRLVGQVLGEMGSLPEVYVELEVSFQLLTRLIGVRTKETEKQIKVSKLSKGEVLMVNIGSMSTGAKVLGVKKDMMKVQLTVPVCTTIGEKVALSRRVERHWRLIGRGQIEAGITILVPPPPPCL

SEQ ID NO: 17572 - protein, 472 aa, Arabidopsis lyrata
MVQQSVLISRNKGLAEQDLSKLDVTKLHPLSPEVISRQATINIGTIGHVAHGKSTIVKAISGVQTVRFKNELERNITIKLGYANAKIYKCEDDKCPRPMCYKSYGSGKEDNPNCDVPGFEKCKMKLLRHVSFVDCPGHDILMATMLNGAAIMDGALLLIAANETCPQPQTAEHLASVDMMRLKHIIILQNKIDLINEKAATEQHEAIQKFITNTNAEDAPIVPVSAQLKYNIDVVSEYIVKKIPIPVRDFVSPPKMIVIRSFDVNKPGSAGHEMKGGVAGGSILQGVLKVNQLIEIRPGITGKDELGNSKCTPIYSRITSLYAEQNELQFAVPGGLIGVGTTMDPTLTRADRLVGQVLGEMGTLPDVFVELEVSFQLLTRLIGVRTKEKEKQMKVSKLTKEEILMVNIGSMSTGAKVIGVKKDMVKLQLTSPVCTTIGEKVALSRRVDRHWRLIGKGQILAGTTIDVPPPPF

SEQ ID NO: 17573 - protein, 466 aa, Arabidopsis lyrata
MGWSKGLAEQDLSKLDVNELHPLSPEVISRQATINIGTIGHVAHGKSTVVKAISGVQTVRFKNELERNITIKLGYANAKIYQCEDNKCPRPMCYKSYGSGKEDNPNCHVPGFENCKMKLLRHVSFVDCPGHDILMATMLNGAAIMDGALLLIAANEVCPQPQTAEHLASVDMMHLKHIIILQNKIDLIQEKAAIEQHTAIQRFITNTNAEGAPIVPVSAQLKYNIDAVCEYIVKKIPIPKRDFVSPPKMIIIRSFDVNKPGYEVADMKGGVAGGSIFRGVLKVNQLIEIRPGIVSKDELGNPRCSPIYSRITSLYAEQNELQFAVPGGLIGVGTTMDPTLTRADRLVGQVLGEMGSLPDVYVELEVSFQLLTRLIGVRTKEKEKQMKVAKLSKGEILMVNIGSMSAGAKVLGVKKDMMKVQLTVPVCTNIGEKVALSRRVDRHWRLIGRGQIEAGTTVPVPPPPSF

SEQ ID NO: 17574 - protein, 415 aa, Flaveria ramosissima
MARKGLMEQDLSKLDVATLHPLSPEVISRQATINIGTIGHVAHGKSTVVKAISGVQTVRFKNELERNITIKLGYANAKIYKCEDDRCPRPMCYKAYGSGKEDNPPCDVPGFENSKMKLMRHVSFVDCPGHDILMATMLNGAAIMDGALLLIAANESCPQPQTSEHLAAVEIMRLQHIIILQNKVDLIQENVAINQHEAIQKFIQGTVADGAPVIPVSAQLRYNIDVVCEYIIKRIPIPERNFISPPNMIVIRSFDVNKPGSEVDEIRGGVAGGSILKGVLKVNQHIEVRPGIVVKDESGNIKCTPIYSRIVSLYAEQNELQFAVPGGLIGVGTTMDPMLTRADRLVGQVLGEVGSLPDVYVELEVNFFLLRRLLGVKTKGTEKQGKVSKLSKAEILMLNIGSMSTGARVLAVKTI

SEQ ID NO: 17575 - protein, 471 aa, Arabidopsis thaliana
MVQSVLISRNKGLAEQDLTKLDVTKLHPLFPEVISRQATINIGTIGHVAHGKSTIVKAISGVQTVRFKNELERNITIKLGYANAKIYKCEDDKCPRPMCYKSYGSGKEDNPTCDVPGFENCKMTLRRHVSCVDCPGHDILMATMLNGAAIVDGALLLIAANESCPQPQTAEHLASVDMMRLKHIIILQNKIDLINEKAATEQHEAIQKFITNTNAEDAPIVPVSAQLKYNIDVVSEYIVKKIPIPVRDFVSPPKMIVIRSFDVNKPGSAGHEMKGGVAGGSILQGVLKVNQLIEIRPGITGKDEHGNSKCTPIYSRITSLYAEQNELQFAVPGGLIGVGTTMDPTLTRADRLVGQVLGEMGTLPDVFVELEVSYQLLTRLIGVRTKEKEKQMKVSKLTKEEILMVNIGSMSTGAKVIGVKKDMVKLQLTSPVCTTIGEKVALSRRVDRHWRLIGKGQIMAGTTIDVPPPPF

SEQ ID NO: 17576 - protein, 430 aa, Brachypodium distachyon
MAALSRAASAIRRRGALHLLPGGAPTRAMASLFGHVEPAPKDPILGVTEAFLADPSPDKVNVGVGAYRDDNGKPVVLDCVREAERRIAGNLNMEYLPMGGSIKMIEESLKLAYGEESEFIKDKRIAAVQALSGTGACRLFADFQKRFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPDLKSLWLKEVKGMADRIIGMRKALRENLEKLGSPLSWEHVTNQIGMFCYSGMTPEQVDRLTNEYHIYMTRNGRISMAGVTTGNVAYLANAIHDVTKSN

SEQ ID NO: 17577 - protein, 429 aa, Echinochloa colona
MAALSRAASSAIRRRPALPRLLAARAMASSLFGHVEPAAKDPILGVTEAFLADPSPEKVNVGVGAYRDDNGQPVVLSCVREAERRIAGNLNMEYLPMGGSIKMIEESLKLAYGEDSEFIKDKRIAAVQALSGTGACRLFADFQKRFLPDSQIYIPTPTWSNHHNIWRDAQVPQKTFTYYHPESRGLDFAGLMNDIKNAPDGSFFLLHACAHNPTGVDPTEEQWREISHQFKVKKHFPFFDMAYQGFASGDPERDAKAIRIFLEDGHQIGCAQSYAKNMGLYGQRAGCLSILCEDEMQAVSVKSQLQQIARPMYSNPPVHGALVVSIILNDPELKSLWLKEVKGMADRIIGMRKALKENLEKLGSPLSWDHITNQIGMFCYSGMTPEQVDRLTNEYHIYMTRNGRISMAGVTTGNVAYLANAIHEVTKPN

SEQ ID NO: 17578 - protein, 426 aa, Avena sativa
MAMSRAAAAISQRRSGPLLPPSRSMSSLFGHVEPAAKDPILGVTEAFLADPSPDKVNVGVGAYRDDNGKPVVLDCVREAERRIAGNLNMEYLPMGGSIKMIEESLKLAYGEDSEFIKDKRIAAVQALSGTGACRLFADFQKHFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPELKSLWLTEVKGMADRIIGMRKALRENLESLGSPLSWEHVTNQIGMFCYSGMTPEQVDRLTNEYHIYMTRNGRISMAGVTTGNVVYLANAIHDVTKSN

SEQ ID NO: 17579 - protein, 430 aa, Avena sativa
MALHRAASAIRRRGALPLPLLAGAPARAMASLFGHVEPAPKDPILGVTEAFLADPSPDKVNVGVGAYRDENGKPVVLDCVREAERRIAGNLNMEYLPMGGSIKMIEESLKLAYGEDSEFIKDKRIAAVQALSGTGACRLFADFQKRFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPELKSLWLTEVKGMADRIIGMRKALRENLESLGSPLSWEHVTNQIGMFCYSGMTPEQVDRLTNEYHIYMTRNGRISMAGVTTGNVVYLANAIHDVTKSN

SEQ ID NO: 17580 - protein, 426 aa, Secale cereale
MALYRRAASAIRRRGAGPLPLLPARAMASLFGHVEPAPKDPILGVTEAFLADPSPDKVNVGVGAYRDDNGKPVVLDCVREAERRIAGNLNMEYLPMGGSIHMIEESLKLAYGEDSEFIKDKRIAAVQALSGTGACRLFADFQKRFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILSDPELKNLWLGEVKGMADRIIGMRKALRENLENLGSPLSWEHVTNQIGMFCYSGMTPEQVDRLTSEYHIYMTRNGRISMAGVTTGNVAYLANAIHDVTK

SEQ ID NO: 17581 - protein, 430 aa, Sorghum bicolor
MAMLSRAASSAARRPALLPPSLLAARAMASSLFGHVEPAPKDPILGVTEAFLADPSPDKVNVGVGAYRDDNGQPVVLSCVREAERRIAGNLNMEYLPMGGSIKMIEESLKLAYGEDSGFIKDKRIAAVQALSGTGACRLFADFQKRFLPDSQIYIPTPTWSNHHNIWRDAHVPQKTFTYYHPESRGLDFSGLMNDIKNAPDGSFFLLHACAHNPTGVDPTEEQWREISHQFKVKKHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPELKSLWLKEVKGMADRIIGMRKALKENLIKLGSPLSWDHITNQIGMFCYSGMTPEQVDRLTNEYHIYMTRNGRISMAGVTTGNVAYLANAIHEVTKPN

SEQ ID NO: 17582 - protein, 430 aa, Saccharum officinarum
MATLSRAASSAARRPALLPPRLLAARAMASSLFGHVEPAPKDPILGVTEAFLADPSPDKVNVGVGAYRDDNGQPVVLSCVREAERRIAGNLNMEYLPMGGSIKMIEESLKLAYGEDSGFIKDKRIAAVQALSGTGACRLFADFQKRFLPDSQIYIPTPTWSNHHNIWRDAQVPQKTFTYYHPESRGLDFSGLMNDIKNAPDGSFFLLHACAHNPTGVDPTEEQWREISHQFRVKKHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPELKSLWLKEVKGMADRIIGMRKALKENLEKLGSPLSWDHITNQIGMFCYSGMTPEQVDRLTNEYHIYMTRNGRISMAGVTTGNVAYLANAIHEVTKPN

SEQ ID NO: 17583 - protein, 428 aa, Setaria italica
MAALSRAASSAIRRPLPRLQLQARAMASSLFGHVEPAPKDPILGVTEAFLADPSPDKVNVGVGAYRDDNGQPVVLDCVREAERRIAGNLNMEYLPMGGSIKMIEESLKLAYGEDSEFIKDKRIAAVQALSGTGACRLFADFQKRFLPDSQIYIPTPTWSNHHNIWRDAQVPQKTFTYYHPESRGLDFSGLMNDIKNAPDGSFFLLHACAHNPTGVDPTEEQWREISHQFKVKKHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPELKSLWLKEVKGMADRIIGMRKALKENLENLGSPLSWEHITNQIGMFCYSGMTPEQVDRLTDEYHIYMTRNGRISMAGVTTGNVSYLANAIHEVTKAN

SEQ ID NO: 17584 - protein, 429 aa, Festuca arundinacea
MALHRAASAIRRRGPLPMPLLPGSAPARAMASLFGHVEPAPKDPILGVTEAFLADPSPDKVNVGVGAYRDDNGKPVVLDCVRQAESRIAGNLNMEYLPMGGSIKMIEESLKLAYGEESEFIKDKRIAAVQALSGTGACRLFADFQKRFLPDSQIYIPTPTWSNHHNIWRDAQVPQRTYSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSVLCEDELQAVAVKSQLQQIARPMYSNPPVHGALVVSIILNDPELKSLWLKEVKGMADRIIGMRKALRENLENLGSPLSWEHVTNQIGMFCYSGMTPEQVDRLTNEYHIYMTRNGRISMAGVTTGNVAYLANAIHDVTK

SEQ ID NO: 17585 - protein, 430 aa, Zea mays
MAMLSRAASSAARRPLLPPPRLLAVRAMASSLFGHVEPAPKDPILGVTEAFLADPSSDKVNVGVGAYRDDNGQPVVLSCVREAERRIAGNLNMEYLPMGGSVKMIEESLKLAYGEDSDFIKDKRIAAVQALSGTGACRLFADFQKRFLPDSQIYIPTPTWSNHHNIWRDAQVPQKTFTYYHPESRGLDFSGLMNEIKNAPDGSFFLLHACAHNPTGVDPTEEQWREISHQFKVKKHFPFFDMAYQGFASGDPERDAKAIRIFLEDGHQIGCAQSYAKNMGLYGQRAGCLSILCEDEMQAVAVKSQLQQIARPMYSNPPVHGALVVSIILSDPELKSLWLKEVKGMADRIIGMRKALKENLEKLGSPLSWDHITNQIGMFCYSGMTPEQVDRLTNEYHIYMTRNGRISMAGVTTGNVGYLANAIHEVTKPN

SEQ ID NO: 17586 - protein, 426 aa, Secale cereale
RVPPPGLRDPRRGAGALPLLPARAMASLFGHVEPAPKDPILGVTEAFLADPSPDKVNVGVGAYRDDNGKPVVLDCVREAERRIAGNLNMEYLPMGGSIHMIEESLKLAYGEDSEFIKDKRIAAVQALSGTGACRLFADFQKRFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILSDPELKNLWLGEVKGMADRIIGMRKALRENLEKLGSPLSWEHVTNQIGMFCYSGMTPEQVDRLTSEYHIYMTRNGRISMAGVTTGNVSYLANAIHDVTKSN

SEQ ID NO: 17587 - protein, 424 aa, Hordeum vulgare
RRAASAIRRRGAPSTPLPLLPARAMASLLGHVEPAPKDPILGVTEAFLADPSPDKVNVGVGAYRDDDGRPVVLDCVREAERRIAGNLNMEYLPMGGSIHMIEESLKLAYGEDSEFIKDKRIAAVQALSGTGACRLFADFQKRFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPELKNLWLGEVKGMADRIIGMRKALRENLEKLGSPLSWEHVTNQIGMFCYSGMTPEQVDRLTSEYHIYMTRNGRISMAGVTTGNVSYLANAIHDVTK

SEQ ID NO: 17588 - protein, 428 aa, Pennisetum glaucum
MAGLYRAATSAIRRPLPRLQLQARTMASSLFGHVEPAPKDPILGVTEAFLADPSPEKVNVGVGAYRDDNGQPVVLDCVREAERRIAGNLNMEYLPMGGSIKMIEESLKLAYGEDSEFIKDKRIAAVQALSGTGACRLFADFQKRFLPDSQIYIPTPTWSNHHNIWRDAQVPQKTFTYYHPESRGLDFSGLMNDIKNAPDGSFFLLHACAHNPTGVDPTEEQWREISHQFKVKKHFPFFDMAYQGFASGDPERDVKAIRIFLEDGHQIGCAQSYAKNMGLYGQRAGCLSILCEDEMQAVAVKSQLQQIARPMYSNPPVHGALVVSIILNDPELKSLWLKEVKGMADRIIGMRKALKENLEKLGSPLSWEHITNQIGMFCYSGITPEQVDRLTNEYHIYMTRNGRISMAGVTTGNVPYLANAIHEVTKPN

SEQ ID NO: 17589 - protein, 426 aa, Avena sativa
MAMSLAAAAIRQRRSGPLLPPSRSMASLFGHVEPAAKDPILGVTEAFLADPSPDKVNVGVGAYRDDNGKPVVLECVREAERRIAGNANMEYLPMGGSVKMIQESLKLAYGEDSEFIKDKRIAAVQALSGTGACRLFADFQKRFLPDSQIYIPTPTWSNHHNIWRDAQVPQRTFAYYHPESKGLDFAGLMDDIKKAPDGSFFLLHACAHNPTGVDPSEEQWREISHQFKLKNHFPFFDMAYQGFASGDPERDAKAIRIFLEDGHQIGCAQSYAKNMGLYGQRAGCLSILCDDEMQAVAVKSQLQQIARPMYSNPPLHGALVVSTILGDPALKTLWLKEVKGMADRIIGMRKALKESLEKLGSPLSWEHITNQIGMFCYSGMTPEQVDRLTKEFHIYMTRNGRISMAGVTTGNVAYLANAIHEVTKQN

SEQ ID NO: 17590 - protein, 426 aa, Triticum aestivum
MAMSRAAAAVGQRRCGPLLPAARSMASWFGHVEPAAKDPILGVSEAFLADPSPDKVNVGVGAYRDDDGKPVVLECVREAERRIAGSTNMEYLPMGGSVKMIEESLKLAYGEDSEFIKDKRIAAVQALSGTGACRLFADFQKRFLPDSQIYIPTPTWSNHHNIWRDAQVPQRTFAYYHPESRGLDFAGLMDDIKNAPEGSFFLLHACAHNPTGVDPSEEQWREISHQFKVKNHFPFFDMAYQGFASGDPERDAKAIRIFLEDGHQIGCAQSYAKNMGLYGQRAGCLSILCDDEIQAVAVKSQLQQIARPMYSNPPLHGALIVSTILGDPALKSLWLKEVKGMADRIIGMRKALKESLEKLGSPLSWEHITNQIGMFCYSGMTPEQVDRLTNEFHIYMTRNGRISMAGVTTGNVAYLANAIHEVTKPI

SEQ ID NO: 17591 - protein, 427 aa, Avena sativa
MAMSRAAAAIRRQHPSGPLLPPSRSMASLFGHVEPAAKDPILGVTEAFLADPSPDKVNVGVGAYRDDNGKPVVLECVREAERRIAGNANMEYLPMGGSVKMIQESLKLAYGEDSEFIKDKRIAAVQALSGTGACRLFADFQKRFLPDSQIYIPTPTWSNHHNIWRDAQVPQRTFAYYHPESKGLDFAGLMDDIKKAPDGSFFLLHACAHNPTGVDPSEEQWREISHQFKLKNHFPFFDMAYQGFASGDPERDAKAIRIFLEDGHQIGCAQSYAKNMGLYGQRAGCLSILCDDEMQAVAVKSQLQQIARPMYSNPPLHGALVVSTILGDPALKTLWLKEVKGMADRIIGMRKALKESLEKLGSPLSWEHITNQIGMFCYSGMTPEQVDRLTKEFHIYMTRNGRISMAGVTTGNVAYLANAIHEVTKQN

SEQ ID NO: 17592 - protein, 427 aa, Avena sativa
MAMSRAAAAIRRQRPSGPLLPPSRSMASLFGHVEPAAKDPILGVTEAFLADPSPDKVNVGVGAYRDDNGKPVVLECVREAERRIAGNANMEYLPMGGSVKMIQESLKLAYGEDSEFIKDKRIAAVQALSGTGACRLFADFQKRFLPDSQIYIPTPTWSNHHNIWRDAQVPQRTFAYYHPESKGLDFVGLMDDIKKAPDGSFFLLHACAHNPTGVDPSEEQWREISHQFKLKNHFPFFDMAYQGFASGDPERDAKAIRIFLEDGHQIGCAQSYAKNMGLYGQRAGCLSILCDDEMQAVAVKSQLQQIARPMYSNPPLHGALVVSTILGDPALKTLWLKEVKGMADRIIGMRKALKESLEKLGSPLSWEHITNQIGMFCYSGMTPEQVDRLTKEFHIYMTRNGRISMAGVTTGNVAYLANAIHEVTKQN

SEQ ID NO: 17593 - protein, 426 aa, Secale cereale
MAMSRAAAAVGQRRCGPLLPAARSMASWFGHVEPAAKDPILGVTEAFLADPSPDKVNVGVGAYRDDGGKPVVLECVREAERRIAGSTNMEYLPMGGSVKMIEESLKLAYGEDSEFIKDKRIAAVQALSGTGACRLFADFQKRFLPDSQIYIPTPTWSNHHNIWRDAQVPQKTFAYYHPESRGLDFAGLMDDIKNAPEGSFFLLHACAHNPTGVDPSEEQWREISHQFKVKNHFPFFDMAYQGFASGDPERDAKAIRIFLEDGHQIGCAQSYAKNMGLYGQRAGCLSILCDDEIQAVAVKSQLQQIARPMYSNPPLHGALIVSTILGDPALKELWLKEVKGMADRIIGMRQALKESLEKLGSPLSWEHITNQIGMFCYSGMTPEQVDRLTNEFHIYMTRNGRISMAGVTTGNVAYLANAIHEVTKTN

SEQ ID NO: 17594 - protein, 410 aa, Hordeum vulgare
MPLPLLPARAMASLFGHVEPAPKDPILGVTEAFLADPSPDKVNVGVGAYRDDDGRPVVLDCVREAERRIAGNLNMEYLPMGGSIHMIEESLKLAYGEDSEFIKDKRIAAVQALSGTGACRLFADFQKRFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDGNAIRIFLEDGHQIGCAQSYAKNMGLYGQRAGCLSILCEDEMQAVAVKSQLQQIARPMYSNPPVHGALVVSIILNDPELKNLWLGEVKGMADRIIGMRKALRENLEKLGSPLSWEHVTNQIGMFCYSGMTPEQVDRLTSEYHIYMTRNGRISMAGVTTGNVSYLANAIHDVTK

SEQ ID NO: 17595 - protein, 429 aa, Setaria italica
MAMTRAAAAANGRHRRWGPAAAATTRAMASWFGHVEPAAKDPILGVTEAFLADPSPDKVNVGVGAYRDDNGRPVVLECVREAERRIAGSMNMEYLPMGGSVKMIEESLKLAYGEDSEFIKDKRIAAVQALSGTGACRLFADFQKRFLPDTQIYIPTPTWANHHNIWRDAHVPQRTFTYYHPESRGLDFSGLMDDIKNAPDGSFFLLHACAHNPTGVDPSEEQWREISQQFKVKKHFPFFDMAYQGFASGDPERDAKAIRIFLEDGHQIGCAQSYAKNMGLYGQRAGCLSILCDDEMQAVAVKSQLQQLARPMYSNPPLHGALIVSTILSDPELKTLWLKEVKGMADRIIGMRKSLKENLERLGSPLSWEHVTNQIGMFCYSGMTPEQVDRLTSEFHIYMTRNGRISMAGVTTGNVAYLANAIHEVTKPN

SEQ ID NO: 17596 - protein, 426 aa, Avena sativa
MAMSRAAAAISQRRSGPLLPPSRSMSSLFGHVEPSAKDPILGVTEAFLADPSPDKVNVGVGAYRDDNGKPVVLECVREAERRIAGNANMEYLPMGGSVKMIQESLRLAYGEDSEFIKDKRIAAVQALSGTGACRLFADFQKRFLPDSQIYIPTPTWSNHHNIWRDAQVPQRTFAYYHLESKGLDFVGLMDDIKKAPDGSFFLLHACAHNPTGVDPSEEQWREISHQFKLKNHFPFFDMAYQGFASGDPERDAKAIRIFLEDGHQIGCAQSYAKNMGLYGQRAGCLSILCDDEMQAVAVKSQLQQIARPMYSNPPLHGALVVSTILGDPALKTLWLKEVKGMADRIIGMRKALKESLEKLGSPLSWEHITNQIGMFCYSGMTPEQVDRLTKEFHIYMTRNGRISMAGVTTGNVAYLANAIHEVTKQN

SEQ ID NO: 17597 - protein, 429 aa, Musa acuminata
MAAISREILKRRGILRSPVMATIGTRSMASWFGHVEPAAKDPILGVTEAFLADPSPDKVNVGVGAYRDDNGKPVVLECVREAERRIAGNLNMEYLPMGGSIKMIEESLKLAYGEDSELIKEKRIAAVQALSGTGACRLFADFQKRFLPDTQIYIPIPTWANHHNIWRDACVPQRTFRYYHPETKGLDFASMMDDIKNAPNGSFFLLHACAHNPTGVDPSEEQWREISYQFKVKNHFPFFDMAYQGFASGDPNRDAKAIRIFLEDGHLIGCAQSYAKNMGLYGQRVGCLSILCEDELQAVAVKSQLQQLARPMYSNPPVHGALVVSIILGDPELKSLWLKEVKGMADRIIGMRKALRENLEKLGSPLSWEHITNQIGMFCYSGMTPEQVDRLTDEFHIYMTRNGRISMAGVTTGNVGYLANAIHEVTKSS

SEQ ID NO: 17598 - protein, 398 aa, Triticum aestivum
SLFGHVEPAPKDPILGVTEAFLADPSPDKVNVGVGAYRDDSGKPVVLDCVREAERRIAGNLNMEYLPMGGSIHMIEESLKLAYGEDSEFIKDKRIAAVQALSGTGACRLFADFQKRFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILSDPELKNVWLGEVKGMADRIIGMRKALRENLEKLGSPLSWEHVTNQIGMFCYSGMTPEQVDRLTSEYHIYMTRNGRISMAGVTTGNVAYLANAIHDVTK

SEQ ID NO: 17599 - protein, 430 aa, Brachypodium distachyon
MAMPRATAAICRQRRAGASYLQLPVARSMASWFGHVETAAKDPILGVTEAFLADPSPDKVNVGVGAYRDDNGKPVVLQCVREAERRIAGNMNMEYLPMGGSVNMIEESLRLAYGEDSEFIKDKRIAAVQTLSGTGACRLFADFQKRFLPDSHIYIPTPTWANHHNIWRDAQVPQRTFAYYHPESRGLDFAGLMNDIKNAPDGSFFLLHACAHNPTGVDPSEEQWREISYQFKVKNHFPFFDMAYQGFASGDPERDAKAIRIFLGNGHQIGCAQSYAKNMGLYGQRAGCLSILCDDEMQAVAVKSQLQQIARPMYSNPPVHGAVIVSTILGDPALKSLWLKEVKVMADRIIGMRNSLKESLEKLGSPLSWEHITNQIGMFCYSGMTPEQVDRLTNEFHIYMTRNGRISMAGVTTGNVTYLANAIHEVTKSN

SEQ ID NO: 17600 - protein, 391 aa, Avena sativa
AKDPILGVTEAFLADPSPDKVNVGVGAYRDDNGKPVVLDCVREAERRIAGNLNMEYLPMGGSIKMIEESLKLAYGEDSEFIKDKRIAAVQALSGTGACRLFADFQKHFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPELKSLWLTEVKGMADRIIGMRKALRGNLESLGSPLSWEHVTNQIGMFCYSGMTLEQVDRLTNEYHIYMTRNGRISMAGVTTGNVAYLANAIHDVTKSN

SEQ ID NO: 17601 - protein, 390 aa, Avena sativa
KDPILGVTEAFLADPSPDKVNVGVGAYRDDNGKPVVLDCVREAERRIAGNLNMEYLPMGGSIKMIEESLKLAYGEDSEFIKDKRIAAVQALSGTGACRLFADFQKHFLPDSQIYIPTPTWSNHHNIWRDAQVPQRTFSYYHPESRGLDFAGLMDDIKNAPNGSFFLLHACAHNPTGVDPTEEQWREISYQFKLKNHFPFFDMAYQGFASGDPERDAKAIRIFLEDGHQIGCAQSYAKNMGLYGQRAGCLSILCEDEMQAVAVKSQLQQIARPMYSNPPVHGALVVSIILNDPELKSLWLTEVKGMADRIIGMRKALRGNLESLGSPLSWEHVTNQIGMFCYSGMTLEQVDRLTNEYHIYMTRNGRISMAGVTTGNVAYLANAIHDVTKSN

SEQ ID NO: 17602 - protein, 427 aa, Ananas comosus
MALGAAISRAIPRRALSSAATSARSASSWWGHVEPAPKDPILGVTEAFLADPSPDKVNVGVGAYRDDNGKPVVLECVREAERRIAGTQNMEYLPMGGSVKMIEETLKLAYGEDSEFIKDKRIAAVQALSGTGACRLFADFQKRFLPDSQIYIPIPTWANHHNIWRDARVPQRTLRYYHPESKGLDFASMMDDIRNAPNGSFFLLHACAHNPTGVDPSEEQWREISYQFKVKNHFPFFDMAYQGFASGDPERDAKAIRIFLEDGHPIGCAQSYAKNMGLYGQRIGCLSILCEDEMQAVAVKSQLQQLARPMYSNPPVHGALIVSTILGDTELKNLWLKEVKGMADRIIGMRKALRENLEKLGSPLSWEHITNQIGMFCYSGLTPEQVDRLTSEFHIYMTRNGRISMAGVTTGNIGYLANAIHEVTTSS

SEQ ID NO: 17603 - protein, 426 aa, Cocos nucifera
MASRAAIYRGTMWRGRSWAVGARSMSSWWSNVEPAPKDPILGVTEAYLADPSPDKVNVGVGAYRDDNGKPVVLECVREAERRIAGNLNMEYLPMGGSNKMIEESLKLAYGEDSEFIKDRRIAAVQSLSGTGACRLFADFQKRFLPDSQIYIPVPTWANHHNIWRDARVPQQTFHYYHPESRGLDFAALMEDIKNAPNGSFFLLHACAHNPTGVDPSEEQWREISHLFRVKNHFPFFDMAYQGFASGDPERDAKAIRIFLEDGHLIGCAQSYAKNMGLYGQRVGCLSILCEDEMQAVAVKSQLQQIARPMYSNPPVHGSLIVLIILSDPDLKSLWLKEVKVMADRIIGMRKALRENLEKLGSPLSWEHITNQIGMFCYSGMTPEQVDRLTNEFHIYMTRNGRISMAGVTTGNVTYLANAIHEVTKST

SEQ ID NO: 17604 - protein, 427 aa, Amorphophallus konjac
MASRAALRGRGSGFSAAAVASGARSMSSWWGSVEPAAKDPILGVTEAFLADPSPGKVNVGVGAYRDDNGKPVVLECVREAERRIAGSHNMEYLPMGGSVRMIEETLKLAYGENSEFIKDKKIAAIQALSGTGACRVFADFQRRFQPNSQIYIPVPTWANHHNIWRDAHVPQRTFHYYHPESRGLDFAALMDDVKNAPNGSFFLLHACAHNPTGVDPTEEQWREISYQFKVKNHFAFFDMAYQGFASGDPERDAKAIRIFLEDGHLIGCAQSYAKNMGLYGQRVGCLSILCEDELQAVSVKSQLQQIARPMYSNPPVHGALIVSTILGDPELKNLWLKEVKGMADRIIGMRTALRENLEKLGSPLSWEHVTNQIGMFCYSGLTPVQVDRLTNEYHIYMTRNGRISLAGVTTGNVGYLANAIHEVTKSS

SEQ ID NO: 17605 - protein, 424 aa, Cannabis sativa
MAFRTAISNNVISPVRTSVAGARSISSWWQHVDPAPKDPILGVTEAFLADPSPDKVNVGVGAYRDDNGKPVVLDCVREAERRIAGNLNMEYLPMGGSMKMVEETLKLAYGENSEFIKDKRIAAVQSLSGTGACRIFADFQKRFHPDSQIYIPIPTWSNHHNIWRDAQVPERTFHYYHPESKGLDFAGLMDDIKNAPNGSFFLLHACAHNPTGVDPTEEQWREISYQFKVKGHFPFFDMAYQGFASGDPERDAKSIRIFLEDGHLLGLAQSYAKNMGLYGQRVGCLSLLCDDEKQAVAVKSQLQQLARPMYSNPPVHGALVVSIILDDPDLKKLWLKEVKGMADRIIGMRTALRENLEKLGSPLSWEHITNQIGMFCYSGMTPEQVDRLTNEYHIYMTRNGRISMAGVTTGNVGYLANAIHEVTK

SEQ ID NO: 17606 - protein, 426 aa, Elaeis guineensis
MASRAAIYQGMMWRGRSWAVGARSMSSWWSNVEPAPKDPILGVTEAYLADPSPDKVNVGVGAYRDDNGKPVVLECVREAERTIAGNLNMEYLPMGGSNKMIEESLKLAYGEDSEFIKDRRIAAVQSLSGTGACRLFADFQKRFLPDSQIYIPVPTWANHHNIWRDARVPQQTFHYYHPDTRGLDFASLMEDIKKAPNGSFFLLHACAHNPTGVDPSEEQWREISHLFKVKNHFPFFDMAYQGFASGDPERDAKAIRIFLEDGHLIGCAQSYAKNMGLYGQRVGCLSILCEDEMQAVAVKSQLQQIARPMYSNPPVHGALIVSIILSDPDLKSLWLKEVKVMADRIIGMRKALRENLEKLGSPLSWEHVTNQIGMFCYSGMTPEQVDRLTNEFHIYMTRNGRISMAGVTTGNVTYLANAIHEVTKSA

SEQ ID NO: 17607 - protein, 401 aa, Avena sativa
ASWFGHVERPPTDPILGVTEAFLADPSPDKVNVGVGAYRDDDGKPVVLECVREAERRVPGSTNMEYLPMGGSVKMIEESLKLAYGEDSEFIKDKRIAAVQALSGTGACRLFADFQKRFLPDSQIYIPTPTWSNHHNIWRDAQVPQRTFAYYHPESKGLDFVGLMDDIKKAPDGSFFLLHACAHNPTGVDPSEEQWREISHQFKLKNHFPFFDMAYQGFASGDPERDAKAIRIFLEDGHQIGCAQSYAKNMGLYGQRAGCLSILCDDEMQAVAVKSQLQQIARPMYSNPPLHGALVVSTILGDPALKTLWLKEVKGMADRIIGMRKALKESLEKLGSPLSWEHITNQIGMFCYSGMTPEQVDRLTKEFHIYMTRNGRISMAGVTTGNVAYLANAIHEVTKQN

SEQ ID NO: 17608 - protein, 424 aa, Aristolochia fimbriata
MAARTAICRGIFRQGSSTGCRSMSSWWRSVEPAPKDPILGVTEAFLADPSPDKVNVGVGAYRDDNGKPVVLECVREAERRIAGNLNMEYLPMGGSIKMVEETLKLAYGENSDLIKEKRIASVQALSGTGACRLFADFQKRFLPDSQIYIPVPTWANHHNIWRDAHVPQRTFHYYHPETKGLDFASLMDDVKNAPNGSFFLLHACAHNPTGVDPSEEQWREISYQFKVKNHFPFFDMAYQGFASGDPERDAKAIRIFLEDGHLIGCAQSYAKNMGLYGQRVGCLSVVCEDEKQAVAVKSQLQQLARPMYSNPPVHGALIVSIILNDPDLKKLWLKEVKGMADRIIGMRTALRENLEKLGSSLSWQHITDQIGMFCYSGMTPEQVDRLTKEYHIYMTRNGRISMAGVTTGNVGYLANAIHEVTKSS

SEQ ID NO: 17609 - protein, 428 aa, Phalaenopsis aphrodite
MASSMCQGIIRNRRRAAALGRFMSTASWWGHVEPAAKDPILGVTEAFLADASPDKVNVGVGAYRDNNGKPVVLECVREAEKRIAGNLNMEYLPMGGSIKMIEESLKLAYGDDSELIKEKRIAAVQTLSGTGACRLFADFQKRFLPDSQIYIPIPTWANHHNIWRDAHVPQRTFHYYHPETKGLDFAAMLDDIKNAPNGSFFLLHACAHNPTGVDPSEDQWREISHLFKIKNHFPFFDMAYQGFASGDPERDAKAIRIFLEDGHMIGCAQSFAKNMGLYGQRVGCLSILCEDDIQAVAVKSQLQQIARPMYSNPPIHGALVVSIILSDAELKSLWLKEVKGMADRIIGMRSALRENIENLGSNLSWEHITNQIGMFCYSGLTPEQVDRLTNDFHIYMTRNGRISMAGVTTGNLGYLAAAIHEVTKASSS

SEQ ID NO: 17610 - protein, 424 aa, Cirsium arvense
MALRSAITRRSILISSTSSSRSMSSWWKSVEPAPKDPILGVTEAFLADPNPDKVNVGVGAYRDDNGKPVVLDCVREAERRIAGNLNMEYLPMGGSNKMVEETLKLAYGEDSDLIKDKRIAAVQALSGTGACRLFADFQKRFSPDSQIYIPVPTWSNHHNIWRDANVPQRTFHYYHPESKGLDFASLMDDVKNAPNGSFFLLHACAHNPTGVDPTEEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSTILGDPELKQLWLKEVKGMADRIIGMRTALKENIEKLGSPLSWEHITKQIGMFCYSGMTPEQVDRLTNEYHIYMTRNGRISMAGVTTGNVEYLAKAIHEVTKGA

SEQ ID NO: 17611 - protein, 425 aa, Rosmarinus officinalis
MAHLVRAGSSGRLAKSGLLGAARSMSTAWWRHVEPAAKDPILGVTEAFLADPSPEKVNVGVGAYRDDNGKPVVLECVREAERRIAGNLNMEYLPMGGSMNMVEETLKLAYGENSDLIKDRRIAAVQALSGTGACRLFADFQKRFSPNSQIYIPVPTWSNHHNIWRDAHVPQRTFHYYHPESKGLDFAGLMDDVKNAPNGSFFLLHACAHNPTGVDPTEEQWKEISYQFKVKGHLAFFDMAYQGFASGDPERDAKSIRIFLEDGHLIGCAQSYAKNMGLYGQRVGCLSLVCEDEKQAVAVKSQLQQIARPMYSNPPLHGALIVSTILGDPDLKKLWLKEVKGMADRIIGMRTALRENLEKLGSPLSWEHITKQIGMFCYSGMTPEQVDRLTNEFHIYMTRNGRISMAGVTTGNVGYLANAIHEVTK

SEQ ID NO: 17612 - protein, 426 aa, Eucalyptus grandis
MAAAVRAGVSGRILGRGSAVGARSMSSWWRSVEPAPKDPILGVTEAFLADPSPDKVNVGVGAYRDDNGKPVVLECVREAERRIAGNQNMEYLPMGGSVKMVEETLKLAYGEDSEFIKDKRIAAVQALSGTGACRLFADFQKRFSPDSQIYIPVPTWANHHNIWRDAHVPQRTYHYYHPESKGLDFAALMDDVKNAPNGSFFLLHACAHNPTGVDPSEDQWREISYQIKVKGHFPFFDMAYQGFASGDPERDAKAIRIFLEDGHAIGIAQSYAKNMGLYGQRVGCLSVLCEDEKQAIAVKSQLQQLARPMYSNPPVHGALVVSTILGDPELKSLWLKEVKVMADRIIGMRTALRENLEKLGSPLSWKHITEQIGMFCYSGMTPEQVDQLTKEYHIYLTRNGRISMAGVTTGNVGYLANAINEVTKSS

SEQ ID NO: 17613 - protein, 426 aa, Humulus lupulus
MAFRTAISNKVISPARSSVTGARSMSSWWQNVDPAPKDPILGVTEAFLADPSPDKVNVGVGAYRDDNGKPVVLDCVREAERRIAGNLNMEYLPMGGSIKMVEETLKLAYGENSQFIKDKRIAAVQSLSGTGACRIFADFQKRFHPDSQIYIPIPTWSNHHNIWRDAQVPQRTFHYYHPESKGLDFAGLMDDIKNAPNGSFFLLHACAHNPTGVDPTEEQWREISYQFKVKGHFPFFDMAYQGFASGDPEKDAKSIRIFLEDGHLLGLAQSYAKNMGLYGQRVGCLSLLCDDEKQAVAVKSQLQQLARPMYSNPPVHGALVVSIILDDPDLKKLWLKEVQGMADRIIGMRTALRENLEKLGSTLSWEHITNQIGMFCYSGMTPEQVDRLTNEFHIYMTRNGRISMAGVTTGNVGCLANAIHEVTKSK

SEQ ID NO: 17614 - protein, 428 aa, Allium cepa
MASTAAISSKILKKGGVFGKYGARAMSSSWWSSVEPASKDPILGVTEAFLADPSPDKVNVGVGAYRDDNGKPVVLDCVREAERRVAGNLNMEYLPMGGSMHMVQESLKLAYGEDSEFIKDKRIAAVQSLSGTGACRLFADFQKRFLPDSQIYIPIPTWSNHHNIWRDAHVPQKTFHYYHPETKGLDFAALIEDVKNAPNGSFFLLHACAHNPTGVDPSEEQWREISHQFKIKNHFPFFDMAYQGFASGDPERDAKAIRIFLEDGHMIGCAQSYAKNMGLYGQRVGCLSILCENELQAVAVKSQLQQIARPMYSNPPVHGALITSIILSDPELKSLWLKEVKGMADRIIGMRASLRMNLEKLGSPLSWEHVTNQIGMFCYSGMTPEQVDRLTDEYHIYMTRNGRISMAGVTSKNVEYLANAIHEVTKSG

SEQ ID NO: 17615 - protein, 427 aa, Zostera marina
MASRTAISCGIARRLSSGYGFATRSMSSWWTDVEPAAKDPILGVTEAFLADTHPDKVNVGVGAYRDDDGKPVVLECVREAERRIAGSENMEYLPMGGSVKMVDETLKLAYGENSEFIKEKRIAAVQALSGTGACRLFAEFQKRFQPDSQIYIPIPTWSNHHNIWRDAQVPQRTFHYYHAETRGLDFASLMDDVKNAPNGSFFMLHACAHNPTGVDPTEEQWREISYQFKVKNHFAFFDMAYQGFASGDPERDAKAIRIFLEDGHLIGCAQSYAKNMGLYGQRVGCLSILCEDELQAVAVKSQLQQIARPMYSNPPVHGALVVSTILSDPTLKNLWLKEVKGMADRIIGMRTKLRENLENLGSPLPWEHVTKQIGMFCYSGMTPEQVDRLTNEYHIYMTRNGRISMAGVTTGNVGYLAKAIHEVTKSS

SEQ ID NO: 17616 - protein, 427 aa, Sesamum indicum
MAQLLRSGCSGRVLCSGAVGAARSMSTAWWRHVEPAAKDPILGVTEAFLADPSPNKVNVGVGAYRDDNGKPVVLECVREAERRIAGNLNMEYLPMGGSVNMVEETLKLAYGENSDLLKDKRIAAVQALSGTGACRLFADFQKRFSPDSQIYIPVPTWANHHNIWRDAHVPQRTFHYYHPQSRGLDFASMMDDIKNAPNGSFFLLHACAHNPTGVDPSEEQWREISHQFKVKGHFAFFDMAYQGFASGDPERDAKSIRIFLEDGHLIGCAQSYAKNMGLYGQRVGCLSVVCEDEKQAVAVKSQLQQLARPMYSNPPVHGALIVSTILGDPDLKKLWLKEVKGMADRIIGMRTALRENLEKLGSPLSWEHVTKQIGMFCYSGMTPEQVDRLTKEYHIYMTRNGRISMAGVTTGNVGYLANAIHEVTKSG

SEQ ID NO: 17617 - protein, 424 aa, Triphysaria pusilla
MAHLLRAGYSGHLSKSGAARSISTSLWRHVEPAPKDPILGVTEAFLADLSPHKVNVGVGAYRDDNGKPVVLDCVREAERRIAGNLNMEYLPMGGSVKMVGETLKLAYGENSDLIKDKRIAAVQALSGTGACRLFADFQKRFSPDSQIYIPAPTWSNHHNIWRDAHVPEKTFSYYHPETRGLDFASLMNDIKNAPNGSFFLLHACAHNPTGVDPTEEQWKEISHQFKVKGHFAFFDMAYQGFASGDPERDAKSIRIFLEDGHQIGCAQSYAKNMGLYGQRVGCLSVVCEDEKQAVAVKSQLQQIARPMYSNPPVHGALVVSIILSDPELKSLWLKEVKGMAGRIIGMRTALRENLEKLGSPLSWEHVTKQIGMFCYSGMTPEQVDRLTKEFHIYMTRNGRISMAGVTTGNVGYLANAIHEVTKSA

SEQ ID NO: 17618 - protein, 424 aa, Cleome gynandra
MAMANAASSASKGRSTAGVGLRSMSSWWRSVEPAPKDPILGVTEAFLADPSPDKVNVGVGAYRDDNGKPVVLECVREAERRIAGGSYMEYLPMGGSVKMVEETLKLAYGENSEFIKDKRIAAVQALSGTGACRLFADFQKRFCPESQIYIPVPTWSNHHNIWRDAQVPQKTYHYYHPETRGLDFSALMDDVKNAPNGSFFLLHACAHNPTGVDPTEEQWKEISQLFKAKGHFAFFDMAYQGFASGDPERDAKSIRIFLEDGHQIGIAQSYAKNMGLYGQRVGCLSVLCEDEKQAVTVKSQLQQLARPMYSNPPLHGALIVSTILGDPELKSLWLKEVKGMADRIIGMRTALRENLEKLGSPLSWEHITKQIGMFCFSGLTPEQVDRLTNEYHIYMTRNGRISMAGVTTGNVGYLANAIHEVSKS

SEQ ID NO: 17619 - protein, 424 aa, Triphysaria pusilla
MAHLFRAGYSGHLSKSGAARSISTSLWRHVEPAPKDPILGVTEAFLADPSPHKVNVGVGAYRDDNGKPVVLDCVREAERRIAGNLNMEYLPMGGSVKMVEETLKLAYGENSDLIKDKRIAAVQALSGTGACRLFADFQKRFSPDSQIYIPAPTWSNHHNIWRDAHVPEKTFSYYHPETRGLDFTSLMNDIKNAPNGSFFLLHACAHNPTGVDPTEEQWKEISHQFKVKGHFAFFDMAYQGFASGDPERDAKSIRIFLEDGHQIGCAQSYAKNMGLYGQRVGCLSVVCEDEKQAIAVKSQLQQIARPMYSNPPVHGALVVSIILSDPDLKSLWLKEVKGMAGRIIGMRTALRENLEKLGSPLSWEHVTKQIGMFCYSGMTPEQVDRLTKEFHIYMTRNGRISMAGVTTGNVGYLANAIHEVTKSS

SEQ ID NO: 17620 - protein, 463 aa, Oryza sativa
MHTRSRRLGFPPLNPSHLLLTPHLPPLSSDRARMAMSRAAAAAAGTPVARRRLMGAVAARSMASWFGHVEPAAKDPILGVTEAFLADPSPDKVNVGVGAYRDDSGKPVVLECVREAERRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPMYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTK

SEQ ID NO: 17621 - protein, 423 aa, Centaurea maculosa
MALRSAITRRILISSTSSSRSMSSWWKSVEPAPKDPILGVTEAFLADPNPDKVNVGVGAYRDDNGKPVVLDCVREAERRIAGNLNMEYLPMGGSNKMVEETLKLAYGEDSDLIKDKRIAAVQALSGTGACRLFADFQKRFSPDSQIYIPVPTWSNHHNIWRDANVPQRTFHYYHPESKGLDFASLMDDVKNAPNGSFFLLHACAHNPTGVDPTEEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSTILGDPELKQLWLKEVKGMAERIIGMRTALKENIEKLGSPLSWEHITKQIGMFCYSGMTPEQVDRLTNEYHIYMTRNGRISMAGVTTGNVEYLAKAIHEVTKGA

SEQ ID NO: 17622 - protein, 428 aa, Cucumis melo
MALQATISRKVLNQKSLRCFGIGARFISSWWKSVEPAPKDPILGVTEAFLADPSPNKVNVGVGAYRDDNGKPVVLECVREAERRIAGNLNMEYLPMGGSIKMVEETLKLAYGENSDLIKDKRIAAIQSLSGTGACRIFADFQKRFLPESQIYIPVPTWANHHNIWRDAQVPQRTYHYYHPESKGLDFSALMDDIKNAPNGSFFLLHACAHNPTGVDPTEEQWREISYQFKVKGHFAFFDMAYQGFASGDPERDAKSIRIFLEDGHHIGIAQSYAKNMGLYGQRVGCLSVVCEDENQAVAVKSQLQQLARPMYSNPPIHGALVVSIILGDPDLKKLWLKEVKVMADRIIGMRTALRESLEKLGSPLSWEHITKQIGMFCYSGLTPEQVDRLTSEYHIYMTRNGRISMAGVTTGNVSYLANAIHEVTKSV

SEQ ID NO: 17623 - protein, 420 aa, Malus domestica
MALSRKLVQQRSSVFGSRSMSWWRSVEPAPKDPILGVTEAFLADPSPDKVNVGVGAYRDDNGKPVVLQCVREAERRIAGNLNMEYLPMGGSVKMVEETLKLAYGENSEHIKDKRIAAVQALSGTGACRLFADFQKRFRPESQIYIPVPTWANHHNIWRDAHVPQKTFHYYHPETKGLDFAGLVDDIKNAPNGSFFLLHACAHNPTGVDPSEEQWKEISKLIKEKGHFPFFDMAYQGFASGDPERDAKAIRIFLEDGHLIGIAQSYAKNMGLYGQRVGCLSVLCEDEKQAVAVKSQLQMLARPMYSNPPVHGALVVSTILGDQELKTLWLKEVKGMADRIIGMRTALRENLEKVGSPLSWEHVTNQIGMFCYSGMTPEQVDRLTNEFHIYMTRNGRISMAGVTTGNVGYLANAIHEVTKST

SEQ ID NO: 17624 - protein, 428 aa, Cucumis sativus
MALQATISRKLLNQNNLRCFGIGARSISSWWKSVEPAPKDPILGVTEAFLADPSPNKVNVGVGAYRDDNGKPVVLDCVREAERRIAGNLNMEYLPMGGSIKMVEETLKLAYGENSDLIKDKKIASIQSLSGTGACRIFADFQKRFLPESQIYIPVPTWANHHNIWRDAQVPQRTYHYYHPESKGLDFSALMDDIKNAPNGSFFLLHACAHNPTGVDPTEEQWREISYQFKVKGHFAFFDMAYQGFASGDPEKDAKSIRIFLEDGHHIGIAQSYAKNMGLYGQRVGCLSVVCEDEKQAVAVKSQLQQLARPMYSNPPIHGALVVSIILGDPDLKKLWLKEVKVMADRIIGMRTALRENLEKLGSPLSWEHITKQIGMFCYSGLTPEQVDRLTNEYHIYMTRNGRISMAGVTTGNVPYLANAIHEVTKSI

SEQ ID NO: 17625 - protein, 425 aa, Flaveria ramosissima
MALRTAITTRITSSSSILNGSRFMSSWWRNVEPAPKDPILGVTEAYLADPSPDKVNVGVGAYRDDNGKPVVLDCVREAERRIAGNLNMEYLPMGGSNKMVEETLKLAYGEDSDLIKDKRIAAIQALSGTGACRIFADFQKRFSPDSQIYIPVPTWSNHHNIWRDANVPQRTFHYYHPESKGLDFASLMDDVKNAPNGSFFLLHACAHNPTGVDPTAEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSTILGDPDLKQLWLKEVKGMADRIIGMRTSLRENIEKLGSPLSWEHITNQIGMFCYSGMTPEQVDRLTKEFHIYMTRNGRISMAGVTSGNVEYLAKAIHEVTKAA

SEQ ID NO: 17626 - protein, 424 aa, Nicotiana benthamiana
MAIRAAISGRSLKLSSSVGARSLSSLWRNVEPAPKDPILGVTEAFLADPTPHKVNVGVGAYRDDNGKPVVLECVREAERRIAGSFNMEYLPMGGSVNMIEESLKLAYGENSDLIKDKRIAAIQALSGTGACRIFADFQRRFCPDSQIYIPVPTWSNHHNIWKDAHVPQKTYHYYHPETKGLDFAALMDDIKNAPNGSFFLLHACAHNPTGVDPTEEQWREISHQFKVKGHFAFFDMAYQGFASGNPEKDAKSIRIFLEDGHPIGCAQSYAKNMGLYGQRVGCLSVVCEDEKQAVAVKSQLQQLARPMYSNPPVHGALVVATILGDPNLKKIWLGEVKGMADRIIGMRTALRENLEKLGSPLSWEHITNQIGMFCYSGMTPEQVDRLTKEYHIYMTRNGRISMAGVTTGNVGYLANAIHEVTKSA

SEQ ID NO: 17627 - protein, 424 aa, Quercus alba
MAFRAVMSRRVTNRSSDIGARWMSTWWGNVEPAAKDPILGVTEAFLADPSPSKVNVGVGAYRDDNGKPVVLECVREAERRIAGHSNMEYLPMGGSVKMVEETLKLAYGENSEFIKDKRIAAVQSLSGTGACRLFADFQKRFRPDSQIYIPVPTWANHHNIWRDAQVPQRTFHYYHPETRGLDFASLMDDIKNAPNGSFFLLHACAHNPTGVDPTEEQWREMSYQFKAKGHFAFFDMAYQGFASGDPERDAKSIRIFLEDGHLIGIAQSYAKNMGLYGQRVGCLSVLCQDEKQAVAVKSQLQQLARPMYSNPPLHGALVVSTILGDPDLKNLWLKEVKVMADRIIGMRTALRENLEKLGSPLSWEHITNQIGMFCYSGLTPEQVDRLTSEFHIYLTRNGRISMAGVTTGNVGYLANAINEVSKSA

SEQ ID NO: 17628 - protein, 424 aa, Manihot esculenta
MAFKTAMACRLINRKSVIGARSMSSWWRSVDPAPKDPILGVTEAFLADPSPDKVNVGVGAYRDDNGKPVVLECVREAERRIAGKLNMEYLPMGGSVKMVEETLKLAYGENSEFIKDKRIAAVQSLSGTGACRLFADFQKRFSPDSQIYIPVPTWANHHNIWRDAQVPQRTYHYYHPESRGLNFAAMMDDVKNAPNGSFFLLHACAHNPTGVDPTEEEWREISHLFKDKNHFAFFDMAYQGFASGDPERDAKSIRIFLEDGHHIGIAQSYAKNMGLYGQRVGCLSVLCEDEKQAVAVKSQLQQLARPMYSNPPVHGALIVSTILGDPDLKKLWLKEVKVMADRIISMRTALRENLEKLGSPLSWKHVTKQIGMFCYSGMTPEQVDRLTKEYHIYMTRNGRISMAGVTTHNVGYLANAIHEVTKSA

SEQ ID NO: 17629 - protein, 423 aa, Vitis vinifera
MAFRTGISRRMMIRSGFGLRSMSSWWGSVEPAAKDPILGVTEAFLADPSPDKVNVGVGAYRDDNGKPVVLECVREAERRIAGKLNMEYLPMGGSVNMVEETLKLAYGENSEFIKDKRIAAVQALSGTGACRLFADFQKRFRPDSQIYIPVPTWANHHNIWRDAQVPQRTFHYYHPETKGLDFASLMDDVKNAPNGSFFLLHACAHNPTGVDPSEEQWKEISYQFKVKGHFAFFDMAYQGFASGDPERDAKSIKIFLEDGHLIGIAQSYAKNMGLYGQRVGCLSLLCEDEKQAVAVKSQLQQIARPMYSNPPVQGALIVSTILGDPELKKLWLKEVKVMADRIIGMRTALRENLEKLGSPLSWEHITNQIGMFCYSGLTPEQVDRMTNEFHIYMTRNGRISMAGITTGNVSYLANAIHEVSKSA

SEQ ID NO: 17630 - protein, 424 aa, Tabernaemontana elegans
MANRTRISGRIIKSGAVFGARSMSSWWGMVEPAPKDPILGVTEAFLADPSPTKVNVGVGAYRDDNGKPVVLNCVREAERRIAGNMNMEYLSMGGSVKMVEETLKLAYGENSDLIKDKRIAAVQALSGTGACRLFADFQKRFCPDSQIYIPVPTWSNHHNIWRDAHVPQNTFHYYHPGTKGLDFATMMDDIKNAPNGSFFLLHACAHNPTGVDPSEEQWREISQQFKVKGHFAFFDMAYQGFASGDPERDAKSIRIFLDDGHLIGCAQSYAKNMGLYGQRIGCLSVVCEDEKQAVAVKSQLQQLARPMYSNPPVHGALIVSIILSDPDLKKLWLKEVKGMADRIIGMRTALRENLEKLGSPLSWEHITNQIGMFCFSGLTPEQVDQLTNEYHIYMTRNGRISMAGVTTGNVGYLANAIHEVTKSG

SEQ ID NO: 17631 - protein, 424 aa, Amsonia hubrichtii
MALRTRISCRIIRSGAVFGTRSMSSGWRNVEPAPKDPILGVTEAFLADPSPNKVNVGVGAYRDDNGKPVVLECVREAEGRISGNLNMEYLPMGGSIRMVEETLKLAYGENSDLIKDKRIAAVQALSGTGACRLFADFQKRFCPDSQIYIPVPTWANHHNIWRDAHVPQNTFHYYHPVTKGLDFASMMDDIKNAPNGSFFLLHACAHNPTGVDPSEEQWKEISQQFKAKGHFAFFDMAYQGFASGDPGRDAKSIRIFLEDGHLIGCAQSYAKNMGLYGQRVGCLSVVCEDEKQAAAVKSQLQQLARPMYSNPPVHGALIVSIILSDPDLKKVWLNEVKGMADRIIGMRTALRENLEKLGSPLSWEHITNQIGMFCFSSLTPEQVDRLTNEYHIYMTRNGRISMAGVTTGNVGYLANAIHEVTKSG

SEQ ID NO: 17632 - protein, 424 aa, Castanea mollissima
MAFRAVMSRRGTNRSSDIGARWMSTWWGNVEPAAKDPILGVTEAFLADPSPSKVNVGVGAYRDDNGKPVVLECVREAERRIAGHSNMEYLPMGGSVKMVEETLKLAYGENSEFIKDKRIAAVQSLSGTGACRLFADFQKRFRPDSQIYIPVPTWANHHNIWRDAQVPQRTFHYYLPETRGLDFASLMDDIKNAPNGSFFLLHACAHNPTGVDPTEEQWREMSYQFKAKGHFAFFDMAYQGFASGDPERDAKSIRIFLEDGHLIGIAQSYAKNMGLYGQRVGCLSVLCEDEKQAVAVKSQLQQLARPMYSNPPLHGALIVSTILGDPELKNLWLKEVKVMADRIIGMRTALRENLEKLGSPLSWEHITNQIGMFCYSGLTPEQVDRLTSEFHIYLTRNGRISMAGITTGNVGYLANAINEVSKSA

SEQ ID NO: 17633 - protein, 425 aa, Echinacea purpurea
MAIRAVITRRIISSIPVQHGSRSISSWWKNVEPAPKDPILGVTEAFLADPSPDKVNVGVGAYRDDNGKPVVLDCVREAERRVAGNLNMEYLPMGGSNKMVEETLKLAYGEDSDLIKDKRIAAIQALSGTGACRIFADFQKRFSPDSQIYIPVPTWSNHHNIWRDANVPQRTFHYYHPESKGLDFASLMDDVKNAPNGSFFLLHACAHNPTGVDPTIEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSIILSDPELKQLWLKEVKGMADRIIGVRTSLRENIEKLGSPLSWEHITNQIGMFCYSGMTPEQVDRLTKEFHIYMTRNGRISMAGVTSGNVEYLAKAIHEVTKSS

SEQ ID NO: 17634 - protein, 425 aa, Solanum tuberosum
  Sequence also found in Organisms: Solanum phureja
MAIRAAISGSHLKLSSSSLGARSLSSWWRNVEPAPKDPILGVTEAFLADPSPDKVNVGVGAYRDDNGKPVVLECVREAERRIAGGFNMEYLPMGGSVNMIQESLKLAYGENSDLIKDKRIAAIQALSGTGACRIFADFQKRFCPDSQIYIPVPTWSNHHNIWRDAHVPERTYHYYHAESKGLDFAAMMDDIKNAPKGSFFLLHACAHNPTGVDPTEEQWREISHQFKVKGHFALFDMAYQGFASGYPEKDAKAIRIFLEDGHPIACAQSYAKNMGLYGQRVGCLSVVCEDEKQAVAVKSQLQQLARPMYSNPPVHGALVVSTILGDPNLKNLWLGEVKGMADRIIGMRTALRENLEKLGSPLSWEHITNQIGMFCYSGMTPEQVDRLTKEYHIYMTRNGRISMAGVTTGNVGYLANAIHEVTKSA

SEQ ID NO: 17635 - protein, 423 aa, Fragaria vesca
MALSSKLFRRSSSSTTALAARSMSWWRTVQPAPKDPILGVTEAFLADPSPHKVNVGVGAYRDDNGKPVVLECVREAERRIAGNLNMEYLPMGGSVKMVEETLKLAYGETSECLKDKRIAAVQSLSGTGACRLFADFQKRFRPDSHIYIPVPTWSNHHNIWRDAQVPERTYHYYHPETKGLDFAGLIDDIKNAPSGSFFLLHACAHNPTGVDPSEEQWKEISYQMKGKGHFPFFDMAYQGFASGDPENDAKAIRIFLEDGHLIGISQSYAKNMGLYGQRVGCLSLLCEDEKQAVAVKSQLQQLARPMYSNPPVHGPLIVSTILGDPDLKNLWLREVEGMADRIIGMRTALRENLEKLGSPLSWEHITNQIGMFCYSGMTPEQVDRLTNEFHIYMTRNGRISMAGITTGNVGYLANAIHEVTKSA

SEQ ID NO: 17636 - protein, 424 aa, Amborella trichopoda
MAGKMVFSCTICRKSAGNDLRFMSSWWNHVEPAPKDPILGVTEAFLADTSPNKVNVGVGAYRDDKGKPVVLECVRQAERRISGNEKMEYLPMGGSVKMVEETLKLAYGENSDLIKDKRIAGVQALSGTGACRLFADFQKRFRPESQIYIPTPTWANHLNIWRDAQVPQRTFHYYHPESRGLDFAALMDDVKNAPNGSFFLLHACAHNPTGVDPSEEQWKEISYQFKAKNHFAFFDMAYQGFASGDPERDARAIRIFLEDGHMIGCAQSYAKNMGLYGQRVGCLSIVCEDEKQAVAVKSQLQQIARPMYSNPPVHGALLVSTILSDPDLKKLWLKEVKVMADRIIGMRTALRESLEKLGSPLSWEHITNQIGMFCYSGMSPEQVDRLTQEFHIYMTRNGRISMAGVTTGNVGYLANAIHEVTKST

SEQ ID NO: 17637 - protein, 425 aa, Cirsium arvense
MALRTAITKRILSSSSAVHGSRSMSSWWKNVEPAPKDPILGVTEAFLADPNPDKVNVGVGAYRDDNGKPVVLDCVREAERRIAGNMNMEYLPMGGSNKMVEETLKLAYGDDSDLIKDKRIAAVQALSGTGACRLFSDFQKRFSPDSQIYIPVPTWSNHHNIWRDANVPQRTFHYYHPESKGLDFASLMDDVKNAPNGSFFLLHACAHNPTGVDPTVEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALVVSTILGDPELKQLWLKEVKGMADRIIGMRTALKENIEKLGSPLSWEHVTKQIGMFCYSGMTPEQVDRLTNEFHIYMTRNGRISMAGVTTGNVEYLAKAIHEVTKSA

SEQ ID NO: 17638 - protein, 425 aa, Echinacea purpurea
MAIRATVTRRIISSIPVQHGSRSISSWWKNVEPAPKDPILGVTEAFLADPSPDKVNVGVGAYRDDNGKPVVLDCVREAERRVAGNLDMEYLPMGGSNKMVEETLKLAYGEDSDLIKDKRIAAIQALSGTGACRIFADFQKRFSPDSQIYIPVPTWSNHHNIWRDANVPQRTFHYYHPESKGLDFASLMDDVKNAPNGSFFLLHACAHNPTGVDPTIEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSIILSDPELKQLWLKEVKGMADRIIGMRTSLRENIEKLGSPLSWEHITNQIGMFCYSGMTPEQVDRLTKEFHIYMTRNGRISMAGVTSGNVEYLAKAIHEVTKSS

SEQ ID NO: 17639 - protein, 423 aa, Ambrosia trifida
MAIRAALTKRIITRSLHGSRSMSSWWKNVEPAPKDPILGVTEAFLADPSPDKVNVGVGAYRDDNGQPVVLDCVREAERRVAGNLNMEYLPMGGSNNMVEETLKLAYGEDSDLIKDKRIAAIQALSGTGACRIFADFQKRFSPDSQIYIPVPTWSNHHNIWRDANVPQRTFHYYHPESKGLDFASLMDDVKNAPNGSFFLLHACAHNPTGVDPTVEQWKEISYQFKVKGHFAFFDMAYQGFASGDPERDAKSIRIFLEDGHLIGCSQSYAKNMGLYGQRVGCLSVVCEDEKQAVAVKSQLQQLARPMYSNPPVHGALIVSIILGDPDLKQLWLKEVKGMADRIIGMRTSLRENIEKLGSPLSWEHITNQIGMFCYSGMTPEQVDRLTKEFHIYMTRNGRISMAGVTSGNVEYLAKAIHEVTKAA

SEQ ID NO: 17640 - protein, 424 aa, Aquilegia formosa
MAARTTIYNKILQKSCNFGTRSMSSWWTHVEPAPKDPILGVTEAFLADTNPEKVNVGVGAYRDDNGKPVVLECVRESERRIAGNQNMEYLPMGGSVKMVDETLKLAYGENSDFIKEKRIAAVQALSGTGACRLFADFQKRFRPESQIYIPVPTWSNHHNIWRDALVPQRTFHYYHPETKGLDFASLMDDIKNAPNGSFFLLHACAHNPTGVDPTEEQWKEISYQMKSKGHFPFFDMAYQGFASGDPERDAKSIRIFLEDGHLIGCAQSYAKNMGLYGQRVGCLSVLCDDEKQAVAVKSQLQQIARPMYSNPPVHGALIVSTILSSPDLKELWLKEVKVMADRIIGMRTALKENLEKLGSPLSWEHITEQIGMFCYSGMTPEQVDRLRSEYHIYMTRNGRISMAGVTTGNVGYLANAINEVTKSA

SEQ ID NO: 17641 - protein, 424 aa, Theobroma cacao
MAIRRAMSGGLMGRTAVLGERSMSSWWRSVEPAPKDPILGVTEAFLADPNPDKVNVGVGAYRDDNGKPVVLECVREAERRIAGYLNMEYLPMGGSVKMVEETLKLAYGENSELIKDRRIAAVQALSGTGACRLFADFQKRFRPDSQIYIPVPTWANHHNIWRDAQVPQKTYHYYHPESRGLDFATMMDDIKNAPNGSFFLLHACAHNPTGVDPTEEQWREISHQFKVKGHFAFFDMAYQGFASGDPEKDAKSIRIFLEDGHYIGIAQSYAKNMGLYGQRVGCLSMLCKDEKQAVAVKSQLQQLARPTYSNPPLHGALIVSTILGDPDLKKLWLKEVKVMADRIIGMRTALRGNLEKLGSPLSWQHITNQIGMFCYSGLTPEQVDRLTNEFHIYMTRNGRISMAGVTTGNVEYLANAIHEVTKSA

SEQ ID NO: 17642 - protein, 424 aa, Citrus clementina
MAMRSLISERVSCRSSVLGARWMSSWWRNVEPAPKDPILGVTEAFLADPSPDKVNVGVGAYRDDNGKPVVLECVREAERRIAGTANMEYLPMGGSVKMVEETLKLAYGDNSEFIKDKRIAAVQSLSGTGACRLFADFQKRFHPDSQIYIPVPTWSNHHNIWRDAHVTQRTFHYYHPGTKGLDFAALMDDIKNAPNGSFFLLHACAHNPTGVDPSEEQWKEISYQIKAKGHFPFFDMAYQGFASGDPERDAKAIRIFLKDGHLLGLAQSYAKNMGLYGQRVGCLSVLCEDEKQAVAVKSQLQQLARPMYSNPPVHGALIVSTILGDAELKKLWLKEVQGMADRIIGMRTALRENLEELGSPLSWKHITNQIGMFCYSGLTPEQVDRLTNEYHIYMTRNGRISMAGVTTGNVGYLANAVHEVTKST

SEQ ID NO: 17643 - protein, 424 aa, Panax ginseng
MALPTAISKRFLSPSSAYGARSMSSWWRSVEPSPKDPILGVTEAFLADPSPDKVNVGVGAYRDDNGKPVVLECVREAERRIAGNLNMEYLPMGGSLKMVDETLKLAYGENSDLIKDKQIAAVQALSGTGACRLFADFQKRFCPDSQIYIPVPTWSNHHNIWRDARVPQRTFHYYHPETKGLDFASLMDDVKNAPNGSFFLLHACAHNPTGVDPTEEQWKEISYQFKVKGHFAFFDMAYQGFASGDPEKDAKSIRIFLEDGHLIGCSQSYAKNMGLYGQRVGCLSVVCEDEKQAVAVKSQLQQLARPMYSNPPVHGALIISTILGDPDLKKLWLKEVKDMADRIIGMRTTLRENLEKLDSPLSWEHITNQIGMFCYSGMTPEQVDRLTNEFHIYMTRNGRISMAGITTGNVGYLANAIHEVTKSN

SEQ ID NO: 17644 - protein, 428 aa, Mimulus guttatus
MAHLIRVGCSGRLSKYSSVVGATRSMSTAWWRHVEPAPKDPILGVSEAFLADPSPHKVNVGVGAYRDDNGKPVVLNCVREAERRIGGNLNMEYLPMGGSVKMVEETLKLAYGDNSDLIKDKRIAAVQALSGTGACRLFADFQKRFSPDSHVYIPVPTWSNHHNIWRDANVPQRTFHYYHPETKGLDFASMMDDIKNAPNGSFFLLHACAHNPTGVDPTEEQWKEISYQFKVKGHFAFFDMAYQGFASGDPERDAKSIRIFLEDGHQIGCSQSYAKNMGLYGQRVGCLSVVCEDEKQAVAVKSQLQQLARPMYSNPPVHGALIVSTILGDPELKNLWLKEVKGMADRIIGMRTALRENLENLGSPLSWEHVTKQIGMFCYSGMTPEQVDRLTNEFHIYMTRNGRISMAGVTTGNVGYLAKAIHEVTKSS

SEQ ID NO: 17645 - protein, 425 aa, Flaveria ramosissima
MALRAAITKRITSSSSILHGSRFMSSWWRNVEPAPKDPILGVTEAYLADPSPDKVNVGVGAYRDDNGKPVVLECVREAERRIAGNLNMEYLPMGGSNKMVEETLKLAYGEDSDLIKDKRIAAIQALSGTGACRIFADFQKRFSPDSQIYIPVPTWSNHHNIWRDANVPQRTFHYYHPESKGLDFASLMDDVKNAPNGSFFLLHACAHNPTGVDPTVEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSTILGDPDLKQLWLKEVKGMADRIIGMRTSLRENIEKLGSPLSWEHITNQIGMFCYSGMTPEQVDRLTKEFHIYMTRNGRISMAGVTSGNVEYLAKAIHEVTKAA

SEQ ID NO: 17646 - protein, 425 aa, Flaveria ramosissima
MALRAAITKRITSSSSILHGSRFMSSWWRNVEPAPKDPILGVTEAYLADPSPDKVNVGVGAYRDDNGKPVVLECVREAERRIAGNLNMEYLPMGGSNKMVEETLKLAYGEDSDLIKDKRIAAIQALSGTGACRIFADFQKRFSPDSQIYIPVPTWSNHHNIWRDANVPQRTFHYYHPESKGLDFASLMDDVKNAPNGSFFLLHACAHNPTGVDPTVEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSTILGDPGLKQLWLKEVKGMADRIIGMRTSLRENIEKLGSPLSWEHITNQIGMFCYSGMTPEQVDRLTKEFHIYMTRNGRISMAGVTSGNVEYLAKAIHEVTKAA

SEQ ID NO: 17647 - protein, 425 aa, Flaveria ramosissima
MALRAAITTRITSSSSILNGSRFMSSWWRNVEPAPKDPILGVTEAFLADPSPDKVNVGVGAYRDDNGKPVVLECVREAERRIAGNLNMEYLPMGGSNKMVEETLKLAYGEDSDLIKDKRIAAIQALSGTGACRIFADFQKRFSPDSQIYIPVPTWSNHHNIWRDANVPQRTFHYYHPESKGLDFASLMDDVKNAPNGSFFLLHACAHNPTGVDPTVEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSTILGDPDLKQLWLKEVKGMADRIIGMRTSLRENIEKLGSPLSWEHITNQIGMFCYSGMTPEQVDRLTKEFHIYMTRNGRISMAGVTSGNVEYLAKAIHEVTKAA

SEQ ID NO: 17648 - protein, 378 aa, Lolium multiflorum
FLADPSPEKVNVGVGAYRDDNGKPVVLECVREAERRIAGSTNMEYLPMGGSVKMIDESLKLAYGEDSEFIKDKRIAAVQTLSGTGACRLFADFQKRFLPDSQIYIPTPTWANHHNIWRDAQVPQRTFGYYYPDTKGLDFAGLMNDIKNAPDGSFFLLHACAHNPTGVDPSEEQWREISHQFKLKNHFPFFDMAYQGFASGDPERDAKAIRIFLEDGHQIGCAQSYAKNMGLYGQRAGCLSILCDDEMQAVAVKSQLQQIARPMYSNPPVHGALVVSIILNDPELKSLWLREVKGMADRIIGMRKALRENLENLGSPLSWEHVTNQIGMFCYSGMTPEQVDRLTNEYHIYMTRNGRISMAGVTTGNVAYLANAIHDVTK

SEQ ID NO: 17649 - protein, 428 aa, Populus trichocarpa
MAGFGKAMACRQHVRIRLGTRFMSSSSSSWWQSVEPAPKDPILGVTEAFLADPSPDKVNVGVGAYRDDNGKPVVLQCVREAERRIAGNLNMEYLPMGGSVNMVEETLKLAYGENSEFIKDKRIAAVQSLSGTGACRLFADFQKRFRPDSQIYIPVPTWANHHNIWRDAQVPQRTYHYYHPESKGLDFSALMDDIKNAPNGSFFLLHACAHNPTGVDPSEEQWREISHQFKVKGHFAFFDMAYQGFASGDPDRDAKSIRIFLQDGHHIGISQSYAKNMGLYGQRVGCLSVLCEDEKQAVAVKSQLQQLARPMYSNPPVHGALVVSTILGDPELKKLWLKEVKVMADRIIGMRSALRENLEKLGSPLSWKHITDQIGMFCYSGMTPEQVDRLTKEFHIYMTRNGRISMAGITTGNVGYLANAINEVTSSA

SEQ ID NO: 17650 - protein, 425 aa, Papaver somniferum
MASRTMISRGIVVHQTRSLGARFMSSWWNHVEPAPKDPILGVTEAFLTDPSPHKVNVGVGAYRDDNGKPVVLECVREAERIIAGNKNMEYLPMGGSMHMVEETLKLAYGENSDLIKDKKIAAIQALSGTGACRVFADFQKRFKPDSHIYIPVPTWSNHHNIWRDAQVPQQTFRYYHPETKGLDFASLMEDLKNAPSGSFFLLHACAHNPTGVDPTEEQWKEISQQMKVKGHFPFFDMAYQGFASGDPERDAKAIRIFLEDGHLIGCAQSYAKNMGLYGQRVGCLSLVCDDDKQAIAVKSQLQQIARPMYSNPPVHGALVVSTILSDPNLKNLWLKEVKGMADRIIGMRTALRENLENLGSPLSWEHITNQIGMFCYSGMTPQQVDRLTSEYHIYMTRNGRISMAGVTTGNVGYLANAIHEVTKSS

SEQ ID NO: 17651 - protein, 425 aa, Solanum lycopersicum
MAIRAAISGRHLKLSSSSFGARSLSSWWRNVEPAPKDPILGVTEAFLADPSPDKVNVGVGAYRDDNGKPVVLECVREAERRIAGGFNMEYLPMGGSVNMIQESLKLAYGENSDLIKDKRIAAIQALSGTGACRIFADFQKRFCPDSQIYIPVPTWSNHHNIWRDAHVPEKTYHYYHAESKGLDFAAMMDDIKNAPKGSFFLLHACAHNPTGVDPTEEQWREISHQFKVKGHFALFDMAYQGFASGYPEKDAKAIRIFLEDGHPIACAQSYAKNMGLYGQRVGCLSVVCEDEKQAVAVKSQLQQLARPMYSNPPLHGALVVSTILGDPNLKTLWLGEVKGMADRIIGMRTALRENLEKLGSPLSWEHITNQIGMFCYSGMTPEQVDRLTKEYHIYMTRNGRISMAGVTTGNVGYLANAIHEVTKSA

SEQ ID NO: 17652 - protein, 425 aa, Flaveria ramosissima
MALRTAITKRITSSSSILHGSRFMSSWWRNVEPAPKDPILGVTEAYLADPSPDKVNVGVGAYRDDNGKPVVLDCVREAERRIAGNLNMEYLPMGGSNKMVEETLKLAYGEDSDLIKDKRIAAIQALSGTGACRIFADFQKRFSPDSQIYIPVPTWSNHHNIWRDANVPQRTFHYYHPESKGLDFASLMDDVKNAPNGSFFLLHACAHNPTGVDPTAEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSTILGDPDLKQLWLKEVKGMADRIIGMRTSLRENIEKLGSPLSWEHITNQIGMFCYSGMTPEQVDRLTKEFHIYMTRNGRISMAGVTSGNVEYLAKAIHEVTKAA

SEQ ID NO: 17653 - protein, 424 aa, Cichorium intybus
MALRTAITRRILSSSSAVHGSRSMSSWWKNVEPAPKDPILGVTEAFLADPSPDKVNVGVGAYRDDHGKPVVLECVREAERRIAGSMNMEYLPMGGSNKMVDETLKLAYGENSDLIKDKRIAAVQALSGTGACRLFADFQKRFSPDSHIYIPVPTWSNHHNIWRDANVPQRTFHYYHPETKGLDFASLMDDVKNAPKGSFFLLHACAHNPTGVDPTVEQWKEMSYQFKVKGHFAFFDMAYQGFASGDPERDVQSIRIFLEDGHLIGCSQSYAKNMGLYGQRVGCLSLVCEDEKQAVAVKSQLQQIARPMYSNPPVHGALIVSTVLGDPDLKQLWLKEVKGMADRIIGMRSALRENIEKLGSPLSWEHITNQIGMFCYSGMTPEQVDRLTNEFHIYMTRNGRISMAGVTTGNVEYLAKAIHEVTKT

SEQ ID NO: 17654 - protein, 424 aa, Cichorium intybus
MALRTAITRRILSSSSAVHGSRSMSSWWKNVEPAPKDPILGVTEAFLADPSPDKVNVGVGAYRDDHGKPVVLECVREAERRIAGSMNMEYLPMGGSNKMVDETLKLAYGENSDLIKDKRIAAVQALSGTGACRLFADFQKRFSPDSHIYIPVPTWSNHHNIWRDANVPQRTFHYYHPETKGLDFASLMDDVKNAPKGSFFLLHACAHNPTGVDPTVEQWKEISYQFKVKGHFAFFDMAYQGFASGDPERDVQSIRIFLEDGHLIGCSQSYAKNMGLYGQRVGCLSLVCEDEKQAVAVKSQLQQIARPMYSNPPVHGALIVSTVLGDPDLKQLWLKEVKGMADRIIGMRSALRENIEKLGSPLSWEHITNQIGMFCYSGMTPEQVDRLTNEFHIYMTRNGRISMAGVTTGNVEYLAKAIHEVTRT

SEQ ID NO: 17655 - protein, 432 aa, Conyza canadensis
MALRAALGSRKMRQHGGCGWWPSSITTRSMSSSWWKHVEPAPKDPILGVTEAFLADPSPHKVNVGVGAYRDDNGKPVVLDCVRDAERRIAGNLNMEYLPMGGSNKMVDETLKLAYGDDSDLIKDKRIAAIQALSGTGACRIFADFQKRFSPDSQIYIPVPTWSNHHNIWRDANVPQRTFHYYHPESKGLDFASLMDDVKNAPNGSFFLLHACAHNPTGVDPTVEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSTILSEPDLKQLWLKEVKGMAERIIGMRSSLRENIEKLGSPLSWEHITNQIGMFCYSGMTPEQVDRLTKEFHIYMTRNGRISMAGVTSGNVEYLAKAIHEVTKAG

SEQ ID NO: 17656 - protein, 423 aa, Daucus carota
MALRSVISRRVTKMSWCGTRSVSTWWRNVEPAPKDPILGVTEAFLADPSPDKVNVGVGAYRDDNGKPVVLECVREAERRIAGNLNMEYLPMGGSVDMIDKTLKLAYGENSDLIKGKRIAAVQALSGTGACRVFAEFQKRFSPDSQIYIPVPTWSNHHNIWRDAHVPQRTFHYYHPETKGLDFASLMDDVKNAPSGSFFLLHACAHNPTGVDPTEEQWKEISYQFKVKGHFAFFDMAYQGFASGDPEKDAKSIRIFLEDGHLIGCSQSYAKNMGLYGQRVGCLSLVCEDEKQAVAVKSQLQQIGRPMYSNPPVHGALLVSTILGEPDLKELWLKEVKGMADRIIGMRTSLRENLENLGSPLSWEHITNQIGMFCYSGMTPEQVDRLTNDFHIYMTRNGRISMAGVTTGNVGYLANAIHEVTKPT

SEQ ID NO: 17657 - protein, 422 aa, Gossypium hirsutum
MAIRRAMSGRIMDRTAVVGARYMSSWWRSVQPAPKDPILGVTEAFLADQSPDKVNVGVGAYRDDNGKPVVLECVREAERRIAGNLNMEYLPMGGSVKMVEETLKLAYGENSELIKEKRIAAVQALSGTGACRLFADFQKRFCPDSQIYIPVPTWANHHNIWRDAQVPQKTYHYYHPESKGLDFAAMIDDIKNAPNGSFFLLHACAHNPTGVDPSEEQWREISHHIKAKGHFAFFDMAYQGFASGDPEKDAKAIRIFLEDGHHIGIAQSYAKNMGLYGQRVGCLSVLCEDEKQAVAVKSQLQQLARPMYSNPPVHGALIVSTILSDPDLKKQWLKEVKVMADRIIGMRTALRGNLEKLGSPLSWQHITNQIGMFCYSGLTPEQVDRLTNEFHIYMTRNGRISMAGVTTGNVEYLANAIHEVTK

SEQ ID NO: 17658 - protein, 422 aa, Gossypium hirsutum
  Sequence also found in Organisms: Gossypium raimondii
MAIRRAMSGRIMDRTAVVGARYMSSWWRSVQPAPKDPILGVTEAFLADQSPDKVNVGVGAYRDDNGKPVVLECVREAERRIAGNLNMEYLPMGGSVKMVEETLKLAYGENSELIKEKRIAAVQALSGTGACRLFADFQKRFCPDSQIYIPVPTWANHHNIWRDAQVPQKTYHYYHPESKGLDFAAMIDDIKNAPNGSFFLLHACAHNPTGVDPSEEQWREISHHIKAKGHFAFFDMAYQGFASGDPEKDAKAIRIFLEDGHHIGIAQSYAKNMGLYGQRVGCLSVLCEDEKQAVAVKSQLQQLARPMYSNPPVHGALIVSTILSDPDLKKQWLKEVKVMADRIIGMRTALRGNLEKLGSPLSWQHITNQIGMFCYSGLTPEQVDRLTNEFHIYMTRNGRISMAGVTTGNVKYLANAIHEVTK

SEQ ID NO: 17659 - protein, 424 aa, Euonymus alatus
MAFRSALAGQIVRRSSVVGARSMSSWWTSVEPAPKDPILGVTEAYLADSNPSKVNVGVGAYRDDNGKPVVLECVREAERRIAGKLDMEYLPMGGSIKMVEETLKLAYGENSEFIKDKRIAALQSLSGTGACRIFADFQKRFLPDSQIYIPVPTWANHHNIWRDAQVPQRTFHYYHPETKGLDFAALMDDIKNAPNGSFFLLHACAHNPTGVDPSEDQWREISYQFKVKGHFAFFDMAYQGFASGDPERDAKSIRIFLEDGHLIGLAQSFAKNMGLYGQRVGCLSVLCEDEKQAIAVKSQLQQLARPMYSNPPSHGALIVSTVLGDPDLKKLWLKEVKVMADRIIGMRKALRENLEKLGSPLSWEHITNQIGMFCYSGMTPEQVDKLTNEYHIYLTRNGRISMAGVTTGNVGYLANAIHEVTKSA

SEQ ID NO: 17660 - protein, 424 aa, Euphorbia peplus
MAFGHAITCRLSVEGMMIGARSMSSWWGSVEPAAKDPILGVTEAFLSDPSPDKVNVGVGAYRDDNGKPVVLDCVREAERRIAGTSNMEYLPMGGSVKMVEETLKLAYGEDSQFIKDKRIAAIQSLSGTGACRIFADFQKRFRPDSQIYIPVPTWANHHNIWRDAQVPQKTYHYYHAESRGLDFSALMDDVKNAPNGSFFLLHACAHNPTGVDPTEEQWREISKLFKVKNHFAFFDMAYQGFASGDPERDAKSIRIFLEDGHHIGIAQSYAKNMGLYGQRVGCLSVLCEDDKQAVSVKSQLQQLARPMYSNPPVHGALIVSTILGDPELKKLWLREVKGMADRIISMRSSLRENLENLGSPLPWKHITNQIGMFCYSGLTPEQVDRLTKEFHIYMTRNGRISMAGVTSGNVGYLANAIHEVTKSS

SEQ ID NO: 17661 - protein, 425 aa, Arachis hypogaea
MAVRNSLSGQLLRRSSVVAGARFMSSWFRSIEPAPKDPILGVTEAFLADQSPNKVNVGVGAYRDDNGKPVVLECVREAERRIAGSQFMEYLPIGGSIKMVEESLKLAYGENSEFIKDKRIGAVQALSGTGACRLFAAFQHRFHPNSQIYIPVPTWANHHNIWRDAGVPMKTFRYYHPETRGLDFSGLMEDIKNAPDGSFFLLHACAHNPTGVDPSEEQWREISSLIKIKGHFPFFDMAYQGFASGDPERDAKAIRIFLEDGHLIGLAQSYAKNMGLYGQRVGCLSVLCEDEKQAVAVKSQLQLLARPMYSNPPVHGALIVSTVLGDPELKNLWLKEVKVMADRIIGMRATLRENLEKLGSPLPWQHITNQIGMFCYSGLTPEQVDRMTNEFHIYMTRNGRISMAGLNTGNVGYVANAIHEVTKSA

SEQ ID NO: 17662 - protein, 422 aa, Helianthus annuus
AIRAVLTRRPITSSTLASRSISSWWKNVEPAPKDPILGVTEAFLADTSPHKVNVGVGAYRDDNGKPVVLECVREAERRVAGNLNMEYLPMGGCNNMVEETLKLAYGEDSDLIKDKRIAAIQALSGTGACRIFADFQKRFSPDSQIYIPVPTWSNHHNIWRDANVPQRTFHYYHPESKGLDFASLMDDVKNAPNGSFFLLHACAHNPTGVDPTVEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSTILSDPDLKQLWLKEVKGMADRIIGMRTSLRENIEKLGSPLSWEHITNQIGMFCYSGMTPEQVDRLTKEFHIYMTRNGRISMAGVTSGNVEYLAKAIHEVTKAA

SEQ ID NO: 17663 - protein, 429 aa, Brassica napus
  Sequence also found in Organisms: Brassica oleracea
MAMMATAIRNSASRGTMMSRQISGLRSMSSWWKNVEPAPKDPILGVTEAFLADPSPDKVNVGVGAYRDDNGKPVVLECVREAERRIAGTSFMEYLPMGGSVKMVDETLKLAYGDNSEFIKDKRIAAVQSLSGTGACRLFADFQKRFRPDSQIYIPVPTWSNHHNIWRDAQVTQKTYHYYHPETKGLDFSGLMDDVKNAPQGSFFLLHACAHNPTGVDPTEEQWREISQLFKAKNHFAFFDMAYQGFASGDPARDAKSIRIFLEDGHHIGISQSYAKNMGLYGQRVGCLSVLCEDEKQAVTVKSQLQQLARPMYSNPPLHGAQIVSTILGDPALKGLWLKEVKVMADRIIGMRTALRESLEKLGSPLSWEHVTKQIGMFCYSGMTPEQVDRLTSEYHIYMTRNGRISMAGVTTGNVGYLANAIHEVTKSS

SEQ ID NO: 17664 - protein, 424 aa, Ambrosia trifida
MALRTAITSSRRIIITSQGSRSISSWWKHVEPAPKDPILGVTEAFLADPHPDKVNVGVGAYRDDNGKPVVLDCVREAERRVAGNLNMEYLPMGGSNKMVEETLKLAYGDDSDLIKDKRIAAIQALSGTGACRIFADFQKRFSPDSHIYIPVPTWSNHHNIWRDANVPQRTFHYYHPESKGLDFASLMDDVKNAPNGSFFLLHACAHNPTGVDPTVEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSIILGDPDLKQLWLKEVKGMADRIIGMRTSLRENIEKLGSPLSWEHITNQIGMFCYSGMTPEQVDRLTKEFHIYMTRNGRISMAGVTSGNVEYLAKAIHEVTKAA

SEQ ID NO: 17665 - protein, 424 aa, Rosmarinus officinalis
MALRTRISGRIFTSGAVFGARSMSSWWRNVEPAPKDPILGVTEAFLADPNPNKVNVGVGAYRDDNGKPVVLECVREAEQRIAGNLNMEYLPMGGSIKMVEETLKLAYGQNSGLIKDKKIAAVQALSGTGACRLFADFQKRFCPDSQVYIPVPTWANHHNIWRDAHVPQNTFHYYHPGTKGLDFASMMDDIKNAPNGSFFLLHACAHNPTGVDPSEEQWREISQLFKVKGHFAFFDMAYQGFASGDPERDAKSIRIFLEDGHQIGCAQSYAKNMGLYGQRVGCLSVVCEDEKQSVAVKSQLQQLARPMYSNPPVHGGLIVSIILSDPDLKKLWLKEVKGMADRIIGMRTALRENLEKLGSPLSWNHITNQIGMFCYSGLSPEQVDRLTNDYHIYMTRNGRISMAGVTTGNVGYLATAIHEVTKSG

SEQ ID NO: 17666 - protein, 424 aa, Brassica napus
MAIRNSASRGTMMSRQISGLRSMSSWWKNVEPAPKDPILGVTEAFLADPSPDKVNVGVGAYRDDNGKPVVLECVREAERRIAGTSFMEYLPMGGSVKMVDETLKLAYGDNSEFIKDKRIAAVQSLSGTGACRLFADFQKRFRPDSQIYIPVPTWSNHHNIWRDAQVTQKTYHYYHPETKGLDFSGLMDDVKNAPEGSFFLLHACAHNPTGVDPTEEQWREISQLFKAKNHFAFFDMAYQGFASGDPARDAKSIRIFLEDGHHIGISQSYAKNMGLYGQRVGCLSVLCEDEKQAVTVKSQLQQLARPMYSNPPLHGAQIVSTILGDPALKGLWLKEVKVMADRIIGMRTALRESLEKLGSPLSWEHVTKQIGMFCYSGMTPEQVDRLTSEYHIYMTRNGRISMAGVTTGNVGYLANAIHEVTKSS

SEQ ID NO: 17667 - protein, 422 aa, Chrysanthemum coronarium
MSMLKSSSTTIYGSSRLMSTTSSWWKNVEPAPKDPILGVTEAFLADPTPHKVNVGVGAYRDDNGKPVVLDCVREAERRIAGNLNMEYLPMGGSNKMVDETLKLAYGENSDLIKDKRIAAIQALSGTGACRIFADFQKRFSPDSQIYIPVPTWSNHHNIWRDANVPQRTYHYYHPETKGLDFASLMDDVKNAPNGSFFMLHACAHNPTGVDPTIEQWKEISYQFKVKGHFAFFDMAYQGFASGDPERDAKSIRIFLEDGHLIGCSQSYAKNMGLYGQRVGCLSLVCEDEKQAVAVKSQLQQLARPMYSNPPVHGALIVSTILGDPDLKQLWLKEVKGMADRIIGMRSSLRENIEKLGSPLSWEHVTKQIGMFCYSGMTPEQVDRLTSEFHIYMTRNGRISMAGVTSGNVEYLAKAIHEVTKAA

SEQ ID NO: 17668 - protein, 422 aa, Plantago ovata
MAQVIRAGRSGRITSSAFARSISTAWWRHVEPAPKDPILGVTEAFLADPSPEKVNVGVGAYRDDNGKPVVLECVREAERRIAGNSNMEYLPMGGSVKMVEETLKLAYGENSDLIKDKRIAAIQALSGTGACRIFADFQKRFSPDSQVFIPVPTWSNHHNIWRDANVPQKTFRYYHPETKGLDFSSLMDDVKNAPNGSFFLLHACAHNPTGVDPTEEQWKEISQEFKVKGHFALFDMAYQGFASGDPERDAKSIRIFLEDGHMIGCAQSYAKNMGLYGQRVGCLSVVCEDEKQAVAVKSQLQQLARPMYSNPPVHGALIVSTILGDPDLKKLWLKEVKGMADRIIGMRTSLRENLEKLGSPLSWEHITKQIGMFCYSGMTPEQVDRLTKEFHIYMTRNGRISMAGVTSGNVGYLANAIHEVTK

SEQ ID NO: 17669 - protein, 429 aa, Brassica oleracea
MAMMAMTIRNSASRRTMMSRPIFGSRSMSSWWKNVEPAPKDPILGVTEAFLADPSPDKVNVGVGAYRDDNGKPVVLDCVREAERRIAGTSFMEYLPMGGSVKMVEETLKLAYGDNSEFIKDKRIAAVQSLSGTGACRLFADFQTRFSPASQIYIPVPTWSNHHNIWRDAQVPQKTYHYYHPETKGLDFKGLMDDVKNAPEGSFFLLHACAHNPTGVDPTEEQWREISQLFKAKNHFAFFDMAYQGFASGDPARDAKSIRIFLEDGHHIGISQSYAKNMGLYGQRVGCLSVLCEDEKQAVTVKSQLQQLARPMYSNPPLHGAQIVSTILGDPELKSLWLKEVKIMADRIIGMRTTLRDSLEKLGSPLSWEHVTKQIGMFCYSGLTPEQVDRLTSEYHIYMTRNGRISMAGVTTGNVGYLANAIHEVTKSS

SEQ ID NO: 17670 - protein, 425 aa, Ricinus communis
MAFRSAITRRLIRQKKNAMGARSMSLWWQSVEPAPKDPILGVTEAFLADPSPAKVNVGVGAYRDDNGKPVVLECVREAERRIAGNLNMEYLPMGGSVNMVEETLKLAYGENSEFIKDKRIAAVQSLSGTGACRLFADFQKRFRPDSQIYIPVPTWANHHNIWRDAQVPQNTYHYYHPESRGLNFAALMEDVKSAPDGSFFLLHACAHNPTGVDPSEEEWREISHVFKVKNHFAFFDMAYQGFASGDPERDAKSIRIFLEDGHHIGIAQSYAKNMGLYGQRVGCLSVLCEDEKQAVAVKSQLQQLARPMYSNPPVHGALIVSTILGDPDLKKLWLKEVKVMADRIISMRMALRENLEKLGSPLSWKHITNQIGMFCYSGMAPEQVDRLTKEFHIYMTCNGRISMAGVTTGNVGYLANAIHEVTKSG

SEQ ID NO: 17671 - protein, 420 aa, Cicer arietinum
MSIRNFLPIRSSVTGARFMSSWFRSIEQAPKDPILGVTEAFLADQSPNKVNVGVGAYRDDNGKPVVLECVREAERRIAGNQFMEYLPMGGSIKMVEESLKLAYGDNSEFINDKRIAAVQALSGTGACRLFAAFQQRFHPNTQIYIPVPTWANHHNIWRDSGVPLKTFRYYHPESRGLDFSGLMDDIKNAPDGSFFLLHACAHNPTGVDPSEEQWREISSQMKAKGHFPFFDMAYQGFASGNPERDAKAIRIFLDDGHLLGLAQSYAKNMGLYGQRVGCLSLLCEDEKQAVAVKSQLQLIARPMYSNPPLHGALVVSTVLGDPELKTLWLKEVKVMADRIIGMRATLRENLENLGSPLPWQHITNQIGMFCYSGMTPEQVDRLTNEFHIYMTRNGRISMAGLNTGNVGYVANAINEVTKSA

SEQ ID NO: 17672 - protein, 422 aa, Chrysanthemum coronarium
MSMLKSSSTTIYGSSRLMSTTSSWWKNVEPAPKDPILGVTEAFLADPTPHKVNVGVGAYRDDNGKPVVLDCVREAERRIAGNLNMEYLPMGGSNKMVDETLKLAYGENSDLIKDKRIAAIQALSGTGACRIFADFQKRFSPDSQIYIPVPTWSNHHNIWRDANVPQRTYHYYHPETKGLDFASLMDDVKNAPNGSFFMLHACAHNPTGVDPTIEQWKEISYQFKVKGHFAFFDMAYQGFASGDPERDAQSIRIFLEDGHLIGCSQSYAKNMGLYGQRVGCLSLVCEDEKQAVAVKSQLQQLARPMYSNPPVHGALIVSTILGDPDLKQLWLKEVKGMADRIIGMRSSLRENIEKLGSPLSWEHVTKQIGMFCYSGMTPEQVDRLTSEFHIYMTRNGRISMAGVTSGNVEYLAKAIHEVTKAA

SEQ ID NO: 17673 - protein, 424 aa, Petroselinum crispum
MALRSANSSAIISRSCLYGVRSMSSWWRNVEPAPKDPILGVTEAFLADPSPNKVNVGVGAYRDDEGKPVVLECVREAERRIAGNLHMEYLPMGGSVNMIDKTLKLAYGENSDLIKDRRIAAIQALSGTGACRVFAEFQKRFSPDSQIYIPVPTWSNHHNIWRDAHVPQRTFHYYHPETKGLDFASLMDDVKNAPSGSFFLLHACAHNPTGVDPTEEQWKEISYQFKVKGHFAFFDMAYQGFASGDPEKDAKSIRIFLEDGHLIGCSQSYAKNMGLYGQRVGCLSLVCEDEKQAVAVKSQLQQIGRPMYSNPPVHGALLVSTILGEPDLKKLWLKEVKGMADRIIGMRTSLRENLENLGSPLSWEHITNQIGMFCYSGMTPEQVDRLTNDFHIYMTRNGRISMAGVTTGNVGYLANAIHEVTKST

SEQ ID NO: 17674 - protein, 424 aa, Cajanus cajan
MPIPNSLTAPILRRSTVAGVRSISSWFRSIEPAPKDPILGVTEAFLADQSPNKVNVGVGAYRDDNGKPVVLECVREAERRIAGNDFMEYLPIGGSIKMVEESLKLAYGDNSEFIKDKRIAAVQALSGTGACRLFAAFQQRFHPNTQIYIPVPTWANHHNIWRDAGVPMKTFRYYYPESRGLDFAGLMDDIKNAPDGSFFLLHACAHNPTGVDPTEEQWREISSQIKAKGHFPFFDMAYQGFASGDPERDAKAIRIFLDDGHLIGLAQSYAKNMGLYGQRAGCLSLLCEDEKQAVAVKSQLQLIARPMYSNPPLHGALIVSTVLGDPELKKLWLKEVKVMADRIIGMRTTLRENLEKRGSPLSWQHITNQIGMFCYSGLTPEQVDRMTSEFHIYMTRNGRISMAGLNTGNVGYVADAIHEVTKSS

SEQ ID NO: 17675 - protein, 425 aa, Eutrema parvulum
MTIRNAASRRAMNPISADFSLRSMSSWWKNVEPAPKDPILGVTEAFLADPSPDKVNVGVGAYRDDNGKPVVLECVREAERRIAGSSFMEYLPMGGSVKMVEETLKLAYGDDSEFIKDKRIAAVQALSGTGACRLFADFQKRFCPGSQIYIPVPTWSNHHNIWRDADVPQKTYHYYHPETKGLNFSGLMDDVKNAPEGSFFLLHACAHNPTGVDPTEEQWREISQLFKAKKHFAFFDMAYQGFASGDPARDAKSIRIFLEDGHHIGISQSYAKNMGLYGQRVGCLSVLCEDEKQAVTVKSQLQQLARPMYSNPPLHGAQIVSTILGDPELKSLWLKEVKIMADRIIGMRTTLRESLEKLGSPLSWEHVTKQIGMFCYSGLTPKQVDRLTSEYHIYMTRNGRISMAGVTTGNVGYLANAIHEVTKSS

SEQ ID NO: 17676 - protein, 66 aa, Sorghum bicolor
  Sequence also found in Organisms: Setaria italica, Panicum virgatum
MLQLLMALAFSAAPLTLYVPPVRSLSLFVEAMEAVCRDCAPYSHGAVLRFRLGLSRILAGLARALR

SEQ ID NO: 17677 - protein, 66 aa, Panicum virgatum
MLQLLMALAFSAAPLTLYVPPVRSLSLFVEAMEAVCRDCAPYSHGAVARFRLGLSRILAGLARALR

SEQ ID NO: 17678 - protein, 66 aa, Zea mays
MLQLLMALAFSAAPLTLYVPPVRSLSLFVEAMEAVCRDCAPYSHGAVARFRLGLSRVLAGLARALR

SEQ ID NO: 17679 - protein, 66 aa, Saccharum officinarum
MLQLLMALAFSAAPLTLYVPPVRSLSLFVEAMETVCRDCAPYSHGAVLRFRLRLSRILAGLARALR

SEQ ID NO: 17680 - protein, 66 aa, Zea mays
MLQLLMALAFSAAPLTLYVPPVRSLSLFVEAMEAVCRDCGPYSHGAVARFRLGFSRVLAGLARALR

SEQ ID NO: 17681 - protein, 66 aa, Hordeum vulgare
MLQLMMALAFSAAPLTLYVPPVRSLSLFVEAMETMCRECAPYSQGAVSRFRLGLSRIFAGLARALR

SEQ ID NO: 17682 - protein, 66 aa, Leymus cinereus x Leymus triticoides
  Sequence also found in Organisms: Triticum aestivum
MLQLMMALAFSAAPLTLYVPPVRSLSLFVEAMETLCRECAPYSQGAVSRFRLGLSRIFAGLARALR

SEQ ID NO: 17683 - protein, 66 aa, Brachypodium distachyon
MLQLMMALAFSAAPLTLYVPPVRSLSLFVEAMESMCRECAPYSHGAVVRFRLGLSRIFAGLARALR

SEQ ID NO: 17684 - protein, 66 aa, Zea mays
MLQLLMALAFSATPLTLYVPPARSLSLFVEAMEAVCRDCGPYSHGAVARFRLGLSRVLAGLACALR

SEQ ID NO: 17685 - protein, 65 aa, Setaria italica
MILVAIVAELLEEYTALVARVLEQLLNDAPFPRRMRFLMLRSLPFVPPPGPPPPPSHALRVTTRG

SEQ ID NO: 17686 - protein, 65 aa, Pennisetum glaucum
MILVAIVAELLEEYTALVARVLEQLLNDAPFPRRMRFLMLRSLPFVPPPGLPPPPPHALRVTTRG

SEQ ID NO: 17687 - protein, 65 aa, Sorghum bicolor
  Sequence also found in Organisms: Triticum aestivum
MILVAVVAELLEEYTALVARVLEQLLTDAPFPRRMRFLMLRSLPFVPPPLPPPPPPHALHVTTRG

SEQ ID NO: 17688 - protein, 65 aa, Zea mays
MILVAIVAELLEEYTALVARVLEQLLNDAPFPRRMRFLMLRSLPFVPPPLPPPPPPHALHVTTRV

SEQ ID NO: 17689 - protein, 66 aa, Panicum virgatum
MILVAIVAELLEEYTALVARVLEQLLADAPFPRRMRFLMLRSLPFVPPPLPPPPPPHALRVTTRAA

SEQ ID NO: 17690 - protein, 66 aa, Panicum virgatum
MILVAIVAELLEEYTALVARVLEQLLADAPFPRRMRFLMLRSLPFVPPPLLPPPPQHALRVTTRVA

SEQ ID NO: 17691 - protein, 65 aa, Setaria italica
MILVAIVAELMEEYMVLVARVLEQLLHGAPFPRRMRFLMLRSLPFAAPPLPPPPPAHALHVATRG

SEQ ID NO: 17692 - protein, 65 aa, Pennisetum glaucum
MILVAIVAELMEEYTVLVARVLEQLLHGAPFPRRMRFLMLRSLPFAAPPLPPPPPVHALHFATRG

SEQ ID NO: 17693 - protein, 65 aa, Saccharum officinarum
MILVAIVAELLEEYTALVARVLEQLLHGAPFPRRMRFLMLRSLPFTAPPLPPPPPPHALHVATRA

SEQ ID NO: 17694 - protein, 65 aa, Hordeum vulgare
MFLVGIVAELLEDYTMLVAEVLEQLLNSAPFPRRMRTLMLRSLPFVAPPLAPPPPPHALRVTTRG

SEQ ID NO: 17695 - protein, 66 aa, Brachypodium distachyon
MFLVGVVAELLEDYTALVARVLEQLLNDAPFPRPMRTLMLRSLPFAAPPPPPPPPPHALRVTAARG

SEQ ID NO: 17696 - protein, 62 aa, Sorghum bicolor
MILVAIVAELLEEYTALVARVLEQLLHGAPFPRRMRFLMLRSLPFAAPPPPPPHALHVATRA

SEQ ID NO: 17697 - protein, 65 aa, Triticum aestivum
MFLVGIVAELLEDYTMLVAEVLEQLLDGAPFPRRMRTLMLRSLPFVAPPLAPPPPPHALRVTTRG

SEQ ID NO: 17698 - protein, 65 aa, Triticum aestivum
MFLVGIVAELLEDYTMLVAEVLEQLLNGAPFPRRMRTLMLRSLPFVAPPLAPPPPPYALRVTTRG

SEQ ID NO: 17699 - protein, 623 aa, Saccharum officinarum
AARRPSLLHLAAVAVLCSVSYLLGIWHHGGFSAGPAAGGGVSSSVSIATAVSCATPALTTASSSPPAGPLDFAAHHTAEGMEAEAALRQRSYEACPAKYSEYTPCEDVERSLRFPRDRLVYRERHCPADGERLRCLVPAPKGYRNPFPWPASRDVAWFANVPHKELSVEKAVQNWIRVDGDRFRFPGGGTMFPRGAGAYIDDIGKLIPLHDGSIRTALDTGCGVASWGAYLLSRNILAMSFAPRDSHEAQVQFALERGVPAMIGVLASNRLTYPARSFDMAHCSRCLIPWQLYDGLYLIEVDRILRPGGYWILSGPPINWKKHWKGWDRTKEDLDAEQKAIESVAKSLCWKKIKEEGDIAIWQKPTNHIHCKAIHKVIKSPPFCSNQNPDAAWYDKMEACITPLPEVSDLKEVAGGALKKWPERLTAVPPRIASGSIEGVTAEMFVEDTVLWKKRVGHYKSVIAQLGQKGRYRNLLDMNAKFGGFAAALVNDPLWVMNMVPTVGNSTTLGIIYERGLIGSYQDWCEGMSTYPRTYDLIHADSVFTLYNGRCEAENILLEMDRILRPEGTVIIRDDVDLLVKIKSITDGMRWNSQIVDHEDGPLVREKLLLVVKTYWTLEDNKQ

SEQ ID NO: 17700 - protein, 638 aa, Zea mays
MAVGATATKLLPSAAAAARRPSMLHLAAVAVLCSLSYLLGIWHHGGFSAGPAAGDSSSSVSIATAVSCATPAPTTASSSPPAGPLDFAAHHTAEGVEAEGALRHRNYEACPAKYSEYTPCEDVERSLRFPRDRLVYRERHCPAAGERLRCLVPAPKGYRNPFPWPASRDVAWFANVPHKELSVEKAVQNWIRVDGDKFRFPGGGTMFPRGAGAYIDDIGKLIPLHDGSIRTALDTGCGVASWGAYLLSRNILAMSFAPRDSHEAQVQFALERGVPAMIGVLASNQLTYPARSFDMAHCSRCLIPWQLYDGLYLIEVDRILRPGGYWILSGPPINWKKHWKGWDRTKEDLDAEQKAIEAVARSLCWKKIKEEGDIAIWQKPTNHIHCKAIHKVIKSPPFCSNKNPDAAWYDKMEACITPLPEVSDLKEVAGGSLKKWPERLTAVPPRIASGSIEGVTEEMFVEDTELWKKRVGHYKSVIAQLGQKGRYRNLLDMNAKFGGFAAALVNDPLWVMNMVPTVGNSTTLGVIYERGLIGSYQDWCEGMSTYPRTYDLIHADTVFTLYNGRCEAENILLEMDRILRPEGTVIIRDDVDLLVKIKSMADGMRWNSQIVDHEDGPLVREKLLLVVKTYWTLDGSEQ

SEQ ID NO: 17701 - protein, 641 aa, Zea mays
MAVGATAAKLHLSSAAAAARRPSLLHLAAVAVLCSLSYLFGIWHHGGFSAGPAAGGATSSSSVSIATAVSCASPALTTAPSSPPAGPLDFAAHHTAEGMESEAALRQRSYEACPAKYSEYTPCEDVERSLRFPRDRLVYRERHCPADGERLRCLVPAPRGYRNPFPWPASRDVAWFANVPHKELSVEKAVQNWIRVDGDRFRFPGGGTMFPRGAGAYIDDIAKLIPLHDGSIRTALDTGCGVASWGAYLLSRDILAMSFAPRDSHEAQVQFALERGVPAMIGVLASNRLTYPARSFDMAHCSRCLIPWQLYDGLYLIEVDRILRPGGYWILSGPPINWKKHWKGWDRTKEDLDAEQKAIEAVARSLCWKKIKEAGDIAIWQKPTNHIHCKAIHKVSKSIPFCSNQNPDAAWYDKMEACITRLPEVSDLKEVAGGALKKWPERLTAVPPRIASGSIEGVTEEMFVEDTELWKKRVGHYKSVIAQLGQKGRYRNLLDMNAKFGGFAAALVNDPLWVMNMVPTVGNSTTLGAIYERGLIGSYQDWCEGMSTYPRTYDLIHADSLFTLYNGRCEADNILLEMDRILRPEGTVIIRDDVDMLVKIKSITDGMRWNSQIVDHEDGPLVREKLLLAVKTYWTLDDSKQ

SEQ ID NO: 17702 - protein, 640 aa, Setaria italica
MAVGTTAVKLHLSSAAAAARRPSLLHLAAVAALCSLSYLFGIWHHGGFSAARASGAGAAVSIATAVSCASPTPTASSSSSTPAGPLDFAAHHTAEGMEEDAAPRQRAYDACPVKYSEYTPCEDVERSLRFSRDRLVYRERHCPSSDAERLRCLVPAPRGYRNPFPWPASRDVAWFANVPHKELTVEKAVQNWIRVDGDKFRFPGGGTMFPRGAGAYIDDIGKIIPLHDGSIRTALDTGCGVASWGAYLLSRNILAMSFAPRDSHEAQVQFALERGVPAMIGVLASNRLTYPARSFDMAHCSRCLIPWQLYDGLYLIEIDRVLRPGGYWILSGPPINWKKHYKGWARSKDDLNQEQQAIEKVAASLCWKKVKEEGDIAIWQKPTNHIHCKAIRKVIKSPPFCSSQNPDAAWYDKMEACITPLPEVSDLKEVAGGKLKKWPERLTAVPPRIASGSLEGVTEEMFVEDTELWKKRIGHYKSVIPQLAQKGRYRNLLDMNAKFGGFAAALVNDPVWVMNMVPTVGNSTTLGVIYERGLIGSYQDWCEGMSTYPRTYDLIHADSVFTLYHGRCEMENVLLEMDRILRPEGTVIIRDDVDLLVKIKSIADGMRWNSQIVDHEDGPLVREKLLLVVKTYWTLGDNKQ

SEQ ID NO: 17703 - protein, 637 aa, Panicum virgatum
VGATAAKLHLSSVAGAARRPSLLHLAAVAVLCSLSYLLGIWHHGGFSAAPAAGAGAGVSIATAVSCASPTPTVPAGSSSSGPLDFAAHHTAEGMEAEAAPRQRAYEACPAKYSEYTPCEDVERSLRFSRDRLVYRERHCPSSDTERLRCLVPAPRGYRNPFPWPASRDVAWFANVPHKELTVEKAVQNWIRVDGDKFRFPGGGTMFPRGADAYIDDIGRIIPLRDGSIRTALDTGCGVASWGAYLLSRNILAMSFAPRDSHEAQVQFALERGVPAMIGVLASNRLTYPARSFDMAHCSRCLIPWQLYDGLYLIEIDRVLRPGGYWILSGPPINWKKHWKGWARTKEDLNAEQQAIEKVARNLCWKKVKEEGDIAIWQKPTNHIHCKVNRKVIKSPPFCSSQNPDAAWYDKMEACITPLPEVSDLKEVAGGELKKWPERLTAVPPRIASGSIEGVTEDMYVEDTELWKRRVGHYKSVISQFGQKGRYRNLLDMNAKFGGFAAALVDDPVWVMNMVPTVGNSTTLGVIYERGLIGSYQDWCEGMSTYPRTYDLIHADSVFTLYNGRCEMENILLEMDRILRPEGTIIIRDDVDLLVKIKSIADGMRWNSQIVDHEDGPLVREKLLLVVKTYWTLGDNKQ

SEQ ID NO: 17704 - protein, 646 aa, Oryza sativa
MAVGATATKLHMPSAGGRRPSLFHLAAVAVLCTVSYLIGIWHHGGFSASPAGGVASSVSIATTASVSCVSPTPTLLGGGGGGGDSSSSAPLDFAAHHTAEGMEVASGQVHRTYEACPAKYSEYTPCEDVERSLRFPRDRLVYRERHCPSEGERLRCLVPAPQGYRNPFPWPTSRDVAWFANVPHKELTVEKAVQNWIRVEGEKFRFPGGGTMFPHGAGAYIDDIGKIIPLHDGSIRTALDTGCGVASWGAYLLSRNILAMSFAPRDSHEAQVQFALERGVPAMIGVLSSNRLTYPARAFDMAHCSRCLIPWQLYDGLYLAEVDRILRPGGYWILSGPPINWKKHWKGWQRTKEDLNAEQQAIEAVAKSLCWKKITLKEVGDIAIWQKPTNHIHCKASRKVVKSPPFCSNKNPDAAWYDKMEACITPLPEVSDIKEIAGGQLKKWPERLTAVPPRIASGSIEGVTDEMFVEDTKLWQKRVGHYKSVISQFGQKGRYRNLLDMNARFGGFAAALVDDPVWVMNMVPTVGNSTTLGVIYERGLIGSYQDWCEGMSTYPRTYDLIHADSVFTLYKDRCQMDNILLEMDRILRPEGTVIIRDDVDMLVKIKSITDGMRWNSQIVDHEDGPLVREKLLLVVKTYWTLGEEKE

SEQ ID NO: 17705 - protein, 643 aa, Echinochloa colona
TGRHGGGSSRREAAPLVRRRGRAAPLAAPPRGRRGPLLPVLPPRHPGHHGGFSGSAPAGGAGASVSIATAVSCASPTPTGSSPSSSAGPLDFAAHHTAEGMEAVAAPRQRAYEACPAKYSEYTPCEDVDRSLRFSRDRLIYRERHCPKDDERLRCLVPAPEGYRNPFPWPASRDVAWFANVPHKELTVEKAVQNWIRVDGDRFRFPGGGTMFPRGAGAYIDDIGKIIPLHDGSIRTALDTGCGVASWGAYLLSRNILAMSFAPRDSHEAQVQFALERGVPAMIGVLASNRLTYPARSFDMAHCSRCLIPWQLYDGLYLIEVDRILRPGGYWILSGPPINWKKHWKGWARTTKDLNEEQQAIEAVAKSLCWKKVKEEGDIAVWQKPTNHIHCKAIRKVIKSPPFCSDQNPDAAWYDKMEACITPLPEVSDLKEVAGGELKKWPERLTAVPPRIASGSIEGVTEEIFVEDTELWKKRVGHYKSVISQFGQKGRYRNLLDMNAKFGGFAAALVSDPVWVMNMVPTVGNSTTLGVIYERGLIGSYQDWCEGMSTYPRTYDLIHADSVFTLYNGRCEMENILLEMDRILRPEGTVIIRDDVDLLVKVKSIADGMRWNSQIVDHEDGPLVREKLLLVVKTYWTLGDSKQ

SEQ ID NO: 17706 - protein, 633 aa, Secale cereale
MAVGAKPHLSSAARRPTLPQLLAVALLCSASYLAGVWHHGGFTAGPAASPSPVSIAAAAASVTCVSPNPPAVAGGSSLDFEAHHAADDAEVKAAPARRAYEACPAKYSEYTPCEDVERSLRFPRDRLVYRERHCPAEGERLRCLVPAPKGYRTPFPWPASRDRAWFANVPHKELTVEKAVQNWIHVEGDKFRFPGGGTMFPHGAGAYIDDIGKLIPLHDGSIRTALDTGCGVASWGAYLLSRNILAMSFAPRDSHEAQVQFALERGVPAMIGVLASNRLTYPARAFDMAHCSRCLIPWQLYDGLYLIEVDRILRPGGYWILSGPPINWKKHWKGWQRTREDLNTEQQAIETVAKSLCWKKIKEVGDIAIWQKPTNHIHCKALRKVIKSPPFCSNKNPDAAWYDKMEACITPLPEVSDIKEVAGGELKKWPQRLTAVPPRIVSGSIEGVTAEMFNEDTKLWKKRVRHYKSVITQFGQKDRYRNLLDMNARFGGFAAALAGDPMWVMNMVPTVGNSTTLGVIYERGLIGNYQDWCEGMSTYPRTYDLIHADSVFSLYKDRCDMDTILLEMDRILRPEGTVIIRDDVDLLVKIKSISDGMRWNSQIVDHEDGPLVREKLLLVVKTYWTLGDEKQQQ

SEQ ID NO: 17707 - protein, 643 aa, Brachypodium distachyon
MAVGVPGTKLHLSSVARRPTLHQLAAVAVLCSVSYLIGVWHHGGFSASPPGGTTSPVSVAITTPSVPCVSPNVTVLGGGGGGGRLAPPLDFRAHHTAEGTEVESAPAKRTYEACPAQYSEYTPCEDVERSLRFPRDRLMYRERHCPSEGERLRCLVPAPQGYRNPFPWPTSRDVAWFANVPHKELTVEKAVQNWIRVDGDKFRFPGGGTMFPHGAGAYIDDIGKLIPLHDGSIRTALDTGCGVASWGAYLLSRDILVMSFAPRDSHEAQVQFALERGVPAMIGVLSSNRLTYPARAFDMAHCSRCLIPWQLYDGLYLIEVDRILRPGGYWILSGPPINWKKHWKGWQRTTEDLNAEQQAIEAVAKSLCWKKIKEVGDIAIWQKPTNHIHCKASRRITKSPPFCSNKNPDAAWYDKMEACITPLPEVSDIKKVAGGELKKWPQRLTAVPPRIASGSIAGVTDEMFLEDTKLWRKRVGHYKSVISQFGQKGRYRNLLDMNAHFGGFAAALVGDPMWVMNMVPTVGNSTTLGVIYERGLIGNYQDWCEGMSTYPRTYDLIHADSVFSLYKDRCEMDSILLEMDRILRPEGTVIIRDDVDILVKIKSITDGMRWNSQVVDHEDGPLVREKLLLVVKTYWTLGDEKKQ

SEQ ID NO: 17708 - protein, 712 aa, Zea mays
MATPGHAVAVDIDEPASCGNGEAAAATPLPQPTVPYVLRFTDLSYSIRKRGSGLGCLPSRWPSNRLASLDAPASSATAASATRNTKTLLDGISGEARERELFAVMGASGSGKSTLLDALAGRIARDSLRGGGATLNGEPLQGRRLRAISAYVMQDDLLYPMLTVRETLLFAAEFRLPRALPADRKRARVDALVDQLGLARAADTIIGDEAHRGVSGGERRRVSIGTDIIHDPILLFLDEPTSGLDSASAFMVVQVLRRIARSGSVVIMTVHQPSARILAILDRLLLLSRGRTVYAGTPAGLKPFFADFGAPIPDNENPAEFALDTIREYERCPDGAAPLADFNVKWQNGSSSTSTFDNNNDDDNDSSSKLMPLELAIAESVSRGKLVAGSAVTASSVPTFANPPWTEVWVLIKRSFTNTGRMPELFVMRLGTIMVTGFILATIFWRLDDTPKGVQERLGFFAMAMSTMFYVCADALPVFVQERHIYLRETAHNAYRRISYVLANAVVAFPPLVFLSLAFAVTTFWAVGLAGGAPSFLFFVLIILASFWAGSGFVTFLSAVVPHVMLGYTVVVAILAYFLLFSGFFINRDRIPDYWIWFHYLSLVKYPYQAVLQNEFRDASRCFSRGVEMFEGTPIGHMTEPVKLKVLQAISRTLGSNMTATTCVTTGADVLAQQAVTDIGKWKCLLVTVAWGFFFRALFYVVLLVGSKNKRK

SEQ ID NO: 17709 - protein, 693 aa, Setaria italica
MANSGQAVVDIDEAGGEAMRPPALPPVPYVLNFTDLSYSVKKGGGLLGCLPSRPSNRLASADAPPAAPAGNTKTLLDGISGEACAGELFAVMGASGSGKSTLVDALAGRIARESLHGSVTLNGEPLQGRRLRAISAYVMQDDLLYPMLTVRETLHFAAEFRLPRALSQEKKRARVDALIDQLGLTRAADTIIGDEGHRGVSGGERRRVSIGTDIIHDPILLFLDEPTSGLDSASAFMVVQVLRRIAQSGSVVIMTIHQPSARILGILDRLLLLSRGRTVYAGTPAGLKPFFAEFGAPIPDNENPAEFALDTIREYERQPDGAAALADFNAKWQNNGSSTDKDSKLMSTMPLELAIAESVSRGKLVAGSGSGSAVSGTVPTFANPPWTEVWVLIKRSFTNTARMPELFAMRLGTIMVTGFILATIFWRLDDTPKGVQERLGFFAMAMSTMFYVCADALPVFVQERHIYLRETAHNAYRRISYVLANAAVAFPPLVLLSLAFAVTTFWAVGLAGGASSFLFFVLIILASFWAGSGFVTFLSAVVPHVMLGYTVVVAILAYFLLFSGFFINRDRIPDYWIWFHYLSLVKYPYQAVLQNEFRDASRCFSRGIEMFDGTPVGRMSEAVKLKVLDAISKTLGSNMTASTCVTTGADVLVQQAVTDISKWKCLLVTVAWGFFFRALFYVVLLVGSKNKRK

SEQ ID NO: 17710 - protein, 714 aa, Zea mays
MATSGHAAVVVDIDIDEPASCGGNADAAGTRQLLPPVVLPPVTYVLRFTDLSYSVKKRGGGLGCLLPRRRPSNRLASSDAPAPAPSDTTTKTLLDGISGEARDGELLAVMGASGSGKSTLVDALAGRIARGSLRGGVTLNGEPLQGRRLRAISAHVMQDDLLHPMLTVRETLRFAAEFRLPRALPADRKRARVDALVDQLGLARAADTIIGDEARRGVSGGERRRVSIGTDIIHDPILLFLDEPTSGLDSASAFMVVQVLRRIARSGSVVIMTVHQPSARILGILDRLLLLSRGRTVYAGTPAGLKPFFAAFGAPIPDNENPAEFALDTIREYESSPGGAAPLADFNVKWQRGGDAPAEGKLMPLELAIAESVSRGKLVAGSGRPGGGGGGGAATGSSVPTFANPPWTEVWVLIKRSFTNTGRMPELFLMRLGTIMVTGFILATIFWRLDDSPKGVQERLGFFAMAMSTTFYVCADALPVFVQERHIYLRETAHNAYRRASYVLANAVVAFPPLVLLSLAFAVTTFWAVGLAGGGPSFLFFVLIILASFWAGSGFVTFLSAVVPHVMLGYTVVVAILAYFLLFSGFFINRDRIPDYWIWFHYLSLVKYPYQAVLQNEFSDASRCFTRGVEMFEGTPIAHMTEAVKLKVMQAISDTLGSNLTANTCVTTGADVLAQQAVTDIGKWNCLLVTVAWGFFFRALFYVVLLVSSKNKRK

SEQ ID NO: 17711 - protein, 710 aa, Sorghum bicolor
MAATGHAVVDIDFPDEAADAAKPPVAPVPYVLHFADLSYSVRTRSKGGGGGLLPSSSSGHRRLVASAATPPPPAPTSSGSSSRRTKTLLDGVSGAARAGELLAVMGASGSGKSTLLDALAGRIARDSLRGAVTLNGEPLQGRRLRAISAHVMQDDLLYAMLTVRETLRFAAEFRLPRALSAERKRARVDALVDQLGLSRAADTIIGDEGHRGVSGGERRRVSIGTDIIHDPILLFLDEPTSGLDSASAFMVVQVLRRVAQSGSVVVMTIHQPSTRILGILDSLLLLSRGRTVYAGTPAGLKPFFAEFGAPVPDNENPAEFALDTIREYEHQPDGAAPIADFNVKWQHSSSASFAAVDNNNNNKLMPLELAIAESVSRGKLVAGSGGTGGGSAVTVPTFANPPWTEVWVLIKRSFTNTGRMPELFVMRLGTIMVTGFILATIFWRLDDTPKGVQERLGFFAMAMSTMFYVCADALPVFVQERHIYLRETAHNAYRRISYVLANAVVAFPPLVLLSLAFAVTTFWAVGLAGGASSFLFFVLIVLASLWAGSGFVTFLSAVVPHVMLGYTVVVAILAYFLLFSGFFITRDRIPDYWIWFHYLSLVKYPYQAVLQNEFGAASRCFSRGVEMFDGTPIGRMPEAMKMKVLEAISATLGTNVTADTCVVTGADVLAQQAVMDISKWKCLLVTVAWGFFFRVLFYVVLLVGSKNKRK

SEQ ID NO: 17712 - protein, 699 aa, Oryza sativa
MATSAHTVLDVDSGGGAATAAAGPPVPYLLSFTDLSYSVRKGGGGVLSCLPSSRRRRHSNRLASADAPAPPDAPTKALLDGISGEARDGELFAVMGASGSGKSTLVDALAGRIARESLRGAVELNGEPLHGRRLRAISAYVMQDDLLYPMLTVRETLLFAAEFRLPRALSPDKKRARVDALIDQLGLARAADTIIGDEAHRGVSGGERRRVSIGTDIVHDPILLFLDEPTSGLDSASAFMVVQVLRRIAQSGSVVIMTIHQPSARILNILDRLLLLSRGRTVYAGTPVGLKPFFSEFGDPIPDNENPAEFALDTIRELEHQPDGAAPLADFNVKWQSMHAALPAADSKDSKRCTMPLELAITESVSRGKLVAGSGSGTASSTSVPTFANPLSVEVWVLMKRSFTNTGRMPELFVMRLGTIMVTGFILATIFWRLDDTPKGVQERLGFFAMAMSTMFYVCADALPVFVQERHIYLRETAHNAYRRLSYVFANAVVAFPPLVFLSLAFAVTTFFAVGLAGGGGSFLFFVLIILASFWAGSGFVTFLSAVVPHVMLGYTVVVAILAYFLLFSGFFINRDRIPSYWIWFHYLSLVKYPYQAVLQNEFRDATRCFSRGVEMFDGTPIGAMSRAVKLKVLDAISKTLGTNMTANTCVTTGADVLAQQAVTDIGKWKCLLVTVAWGFFFRALFYVVLLVGSKNKRR

SEQ ID NO: 17713 - protein, 690 aa, Setaria italica
MAASGHAVVDIDAAKPALAPVPYVLSFADLSYSVRKGGGLAGCLPSRASSSRLVASADAPPSSSGSRHTKTLLNGVSGEACAGELLAIMGASGSGKSTLVDALAGRIARESLRGSVTLNGEPLQGRRLRAISAYVMQDDLLYPMLTVRETLHFAAEFRLPRALSPEKKRARVDALIDQLGLARAADTIIGDEGHRGVSGGERRRVSIGTDIIHDPILLFLDEPTSGLDSASAFMVVQVLRRIAQSGSVAIMTIHQPSARILGILDHLLLLSRGRTVYAGTPAGLKPFFAEFGAPIPDNENPAEFALDTIREYERQPDGAAALADFNAKWQNNASSTDKDSKLMSTMPLELAIAESVSRGKLVAGSGSGSPVSGTVPTFANPPWTEVWVLIKRSFTNTARMPELFAMRLGTIMVTGFILATIFWRLDDTPKGVQERLGFFAMAMSTMFYVCADALPVFVQERHIYLRETAHNAYRRISYVLANAAVAFPPLVLLSLAFAVTTFWAVGLAGGASSFLFFVLTILASFWAGSGFVTFLSAVVPHVMLGYTVVVAILAYFLLFSGFFITRDRIPGYWIWFHYLSLVKYPYQAVLQNEFGGAARCFSRGVELFDGSPIGRLPEAVKLKVLEAISATLGTNVTANTCVTTGADVLALQAVTDIGKWKCLLVTVACGFLFRALFYVVLLVSSKNKRK

SEQ ID NO: 17714 - protein, 705 aa, Oryza sativa
MATSAHTVLDVDSGGGAATAAAGPPVPYLLSFTDLSYSVRKGGGGVLSCLPSSRRRRHSNRLASADAPAPPDAPTKALLDGISGEARDGELFAVMGASGSGKSTLVDALAGRIARESLRGAVELNGEPLHGRRLRAISAYVMQDDLLYPMLTVRETLLFAAEFRLPRALSPDKKRARVDALIDQLGLARAADTIIGDEAHRGVSGGERRRVSIGTDIVHDPILLFLDEPTSGLDSASAFMVVQVLRRIAQSGSVVIMTIHQPSARILNILDRLLLLSRGRTVYAGTPVGLKPFFSEFGDPIPDNENPAEFALDTIRELEHQPDGAAPLADFNVKWQSMHAALPAADSKDSKRCTMPLELAITESVSRGKLVAGSGSGTASSTSVPTFANPLSVEVWVLMKRSFTNTGRMPELFVMRLGTIMVTGFILATIFWRLDDTPKGVQERLGFFAMAMSTMFYVCADALPVFVQERHIYLRETAHNAYRRLSYVFANAVVAFPPLVFLSLAFAVTTFFAVGLAGGGGSFLFFVLIILASFWAGSGFVTFLSAVVPHVMLGYTVVVAILAYFLLFSGFFINRDRIPSYWIWFHYLSLVKYPYQAVLQNEFRDATRCFSRGVEMFDGTPIGAMSRAVKLKVLDAISKTLGTNMTANTCVTTGADVLAQQAVTDIGKWKCLLVTVAWGFFFRALFYVVLLVGSKNKRSWCLAPG

SEQ ID NO: 17715 - protein, 687 aa, Panicum virgatum
MAASGHTVIDIDAADGEATKTPLAPVPYVLSFADLSYSVNKAGCCLAPRANSRLVASADAPPPRTSGSGRAKTLLDGVSGEARAGELLAVMGASGSGKSTLLDALAGRIERESLRGSVTLNGEPLQGRRLRAISAHVMQDDLLYPMLTVRETLRFAAEFRLPRALSQDRKRARVDALIDQLGLSRAADTIIGDEGHRGVSGGERRRVSIGTDIIHDPILLFLDEPTSGLDSASAFMVVQVLRRIAQSGSVVIMTIHQPSARILGILDRLLLLSRGRTVYAGTPAGLKPFFAEFGVPIPDNENPAEFALDTIREFERQPDGAAALAEFNANRTMKTIVKLTSTMALELAIAESVSRGKLVAGSGSGSALSGTVPTFANPPWTEVWVLIKRSFTNTARMPELFAMRLGTIMVTGFILATIFWRLDDTPKGVQERLGFFAMAMSTMFYVCADALPVFVQERHIYLRETAHNAYRRISYVLANAVVAFPPLVLLSVAFALITFWAVGLAGGASSFLFFVLIILASFWAGSGFVTFLSAVVPHVMLGYTVVVAILAYFLLFSGFFITSDRIPDYWMWFHYLSLVKYPYQAVLHNEFRDASRCFSRGIEMFDGRPIGHLPEAVKLKVLDAISNTLGSNMTASTCVTTGADVLAQQAVTDIGRWKCLMVTVAWGFVFRALFYVVLLIGSKNKRK

SEQ ID NO: 17716 - protein, 692 aa, Hordeum vulgare
MSNSGHIAVEVDDAAERELQALVAAGPPVPYTLSFTDLSYRVKQGRGGLLGCLPARASNRLASTDAPPANTKALLDGISGEAREGELFAVMGASGSGKSTLVDALAGRIARDSLRGHVTLNGEPLHGSRLRAISAYVMQDDLLYPMLTVRETLLFAAELRLSRALSPAAKRDRVDRLVDQLGLSRAADTIIGDEGHRGVSGGERRRVSIGTDIIHDPILLFLDEPTSGLDSASAFMVVQVLRTIARSGSVVVMTIHQPSARILGILGRLLLLSRGRTVYAGTPAGLKPFLAEFGTPIPDNENPAEFALDTIREREGQPDGTAVLADFNAKWQATHKLMDGNGAKRVSPMTLEYAIAESVARGKLVAGSGTGTVSLQMPTYANPMPVEVWVLIKRAFTNTRRMPELFGMRLGTIMVTGLILATIFLRLDDTPKGVQERLGFFAMGMSTMFYVCADALPVFVQERHIYLRETAHNAYRRISYVLANAVVSFPPLVALSLAFAVTTFFAVGLAGGASSFLYFSLIILASLWAGSGFVTFLSAVVPHVMLGYTVVVAILAYFLLFSGFFINRDRIPDYWIWFHYISLVKYPYQAVLQNEFGDATRCFARGVQMFDGTPIGGMPEAIKMKVLGAIGNALGTRMTSHTCVLTGADVLAQQAVTDLGKWMCLLVTAGFGFFFRALFYVVLLVGSKNKRK

SEQ ID NO: 17717 - protein, 231 aa, Setaria italica
MAANVGESTSGSSSGADAGGSFECNICFELPQEPIVTLCGHLFCWPCLYKWLRIHSHSPECPVCKAVVEEDKLVPLYGRGKDRVDPRSKNVPGADIPNRPAGQRPATAPQADPNNHFPNANPNPWFMGGGIPLANARWGNYTFSAAFGGLFPLLSFQVHGFPDATAYGQPAGFPYGYGHGHGHAFHGGHAGHAHAAAPRHGPHGQQQQADVYLKALLILVGFLVIASLITF

SEQ ID NO: 17718 - protein, 228 aa, Saccharum officinarum
MAANVGESTSGSSSGADAGGSFECNICFELPQEPIVTLCGHLFCWPCLYKWLRIHSHSPECPVCKAIVEEDKLVPLYGRGKDRVDPRSKNVPGADIPNRPAGQRPATAPQADPNTHFPNANANPWFMGGGIPLANARWGNYTFSAAFGGLFPLLSFQVHGFPDATAYGQPAGFPYGYGHGHAFHGGHAGGHAHAAAAPRHGQQQQADVYLKALLILVGVLVIVSLVTF

SEQ ID NO: 17719 - protein, 234 aa, Oryza sativa
MAANVGESTSGSSSGGADSGGSFECNICFELPQEPIVTLCGHLFCWPCLYKWLHIHSHSPECPVCKAVVEEDKLVPLYGRGKDRVDPRSKNVPGADIPNRPAGQRPATAPQANPNTHFPNANPNPWFMGGGIPLANARWGNYTFSAAFGGLFPLLSFQVHGFPDATAYGQPAGFPYGYGHGHGHGHGHAFHGGHAHAAAAPRHGPPGQQQQADVYLKALLILVGFLVIASLITF

SEQ ID NO: 17720 - protein, 227 aa, Panicum virgatum
MAANVGESTSGSSSGADAGGSFECNICFELPQEPIVTLCGHLFCWPCLYKWLRIHSHSPECPVCKAVVEEDKLVPLYGRGKDRVDPRSKNVPGADIPNRPAGQRPATAPQADPNNHFPNADPNNHFPLANARWGNYTFSAAFGGLFPLLSFQVHGFPDATAYGQPAGFPYGYGHGHGHAFHGGHAGHAHAAAPRHGPHGQQQQQADVYLKALLILVGFLVIASLITF

SEQ ID NO: 17721 - protein, 236 aa, Festuca arundinacea
MAANVGESTSGSSVAGDGGGSFECNICFELPQEPIVTLCGHLFCWPCLYKWLHIHSHSPECPVCKAVVEEDKLVPLYGRGKDRVDPRSKNVPGAADIPHRPTGQRPAMAPQADPNNHFPNANPNPWFMGGGGSVPLANARWGNYTFSAAFGGLFPLLSFQVHGFPDATAYGQPAGFPYGYGHGHGHGHAFHGGHAGHAHAAPRHGPHGQQQQQADVYLKALLILVGFLVIASLITF

SEQ ID NO: 17722 - protein, 233 aa, Avena sativa
MAANVGESTSGSSVAGDGGGSFECNICFELPQEPIVTLCGHLFCWPCLYKWLHIHSHSPECPVCKAVVEEDKLVPLYGRGKDRVDPRSKNVPGAADIPHRPTGQRPATAPQADPNNHFPNANPNPWFMGGGGGVPLANARWGNYTFSAAFGGLFPLLSFQVHGFPDATAYGQPAGFPYGYGHGHGHGHAFHGGHAHAAPRHGPHGQQQQQADVYLKALLILVGFLVIASLITF

SEQ ID NO: 17723 - protein, 234 aa, Triticum aestivum
MAANVGESTSGSSSVAGDGGGSFECNICFELPQEPIVTLCGHLFCWPCLYKWLHIHSHSPECPVCKAVVEEDKLVPLYGRGKDRVDPRSKGVPAGAEIPNRPTGQRPATAPQADPNNHFPNANPNPWFMGGGGVPLANARWGNYTFSAAFGGLFPLLSFQVHGFPDATAYGQPAGFPYGYGHGHGHGHAFHGGHAHAAAPRHAPPGQQQQQADVYLKALLILVGFLVIASLITF

SEQ ID NO: 17724 - protein, 241 aa, Zea mays
MAAANVGESTSGGSSSSGADAGGGFECNICFELPQEPIVTLCGHLFCWPCLYKWLRIHSHSPECPVCKAVVEEEKLVPLYGRGKDRVDPRSKNVPGAADIPSRPAGQRPATAPQADPNNAHFPNAANPANPWFMGGGGGGIPLANARWGNYTFSAAFGGLFPLLSFQVHGFPDATAYGQPAGFPYGYGHGHAFHGGHAGAHAHAAAAAPRHAQHQQQQADVYLKALLILVGVLVIASLVTF

SEQ ID NO: 17725 - protein, 236 aa, Lolium multiflorum
MAANVGESTSSSSVAGDGGGSFECNICFELPQEPIVTLCGHLFCWPCLYKWLHIHSHSPECPVCKAVVEEEKLVPLYGRGKDRVDPRSKNVPGAADIPHRPTGQRPATAPQADPNNHFPNANPNPWFMGGGGGVPLANARWGNYTFSAAFGGLFPLLSFQVHGFPDATAYGQPAGFPYGYGHGHGHGHAFHGGHAGHAHAGPRHGPHGQQQQQADVYLKALLILVGFLVIASLITF

SEQ ID NO: 17726 - protein, 234 aa, Secale cereale
MAANVGESTSGSSSVAGDAGGSFECNICFELPQEPIVTLCGHLFCWPCLYKWLHIHSHSPECPVCKAVVEEDKLVPLYGRGKDRVDPRSKGVPAGAEIPNRPTGQRPATAPQADPNNHFPNANPNPWFMGGGGVPLANARWGNYTFSAAFGGLFPLLSFQVHGFPDATAYGQPAGFPYGYGHGHGHGHAFHGGHAHAGAPRQAPPGQQQQQADVYLKALLILVGFLVIASLVTF

SEQ ID NO: 17727 - protein, 234 aa, Secale cereale
MAANVGESTSGSSSVAGDGGGSFECNICFELPQEPIVTLCGHLFCWPCLYKWLHIHSHSPECPVCKAVVEEDKLVPLYGRGKDRVDPRSKGVPAGAEIPNRPTGQRPATAPQADPNNHFPNANPNPWFMGGGGVPLANARWGNYTFSAAFGGLFPLLSFQVHGFPDATAYGQPAGFPYGYGHGHGHGHAFHGGHAHAGAPRHAPPGQQQQQADVYLKALLILVGFLVIASLVTF

SEQ ID NO: 17728 - protein, 233 aa, Brachypodium distachyon
MAANVGESTSSSGGAGDGGGSFECNICFELPQEPIVTLCGHLFCWPCLYKWLHIHSHSPECPVCKAVVEEDKLVPLYGRGKDRVDPRSKNVPGAEIPHRPTGQRPATAPQADPNNHFPNANPNPWFMGGGGVPLANARWGNYTFSAAFGGLFPLLSFQVHGFPDATAYGQPAGFPYGYGHGHGHGHAFHGGHAGHPHAAPRQAQPGQQQQADVYLKALLILVGFLVIASLITF

SEQ ID NO: 17729 - protein, 234 aa, Secale cereale
MAANVGESTSGSSSLAGDGGGSFECNICFELPQEPIVTLCGHLFCWPCLYKWLHIHSHSPECPVCKAVVEEDKLVPLYGRGKDRVDPRSKGVPAGAEIPNRPTGQRPATAPQADPNNHFPNANPNPWFMGGGGVPLANARWGNYTFSAAFGGLFPLLSFQVHGFPDATAYGQPAGFPYGYGHGHGHGHAFHGGHAHAGAPRQAPPGQQQQQADVYLKALLILVGFLVIASLVTF

SEQ ID NO: 17730 - protein, 231 aa, Hordeum vulgare
MAANVGESTSASGSVAGDGGGSFECNICFELPQEPIVTLCGHLFCWPCLYKWLHIHSHSPECPVCKAVVEEDKLVPLYGRGKDRVDPRSKGVPPGAEIPHRPTGQRPATAPQADPNNHFPNANPNPWFMGGGGVPLANARWGNYTFSAAFGGLFPLLSFQVHGFPDATAYGQPAGFPYGYGHGHGHGQAFHGHAAAPRHAPPGQQQQQADVYLKALLILVGFLVIASLITF

SEQ ID NO: 17731 - protein, 228 aa, Panicum virgatum
MSANVGESASAGSSSDAAGGSFECNICFELPQEPIVTLCGHLFCWPCLYRWLHVHAHSPECPVCKALVEEDKLVPLYGRGKDRVDPRSKNMPESDIPHRPTGQRPATAPQADANNNFPNANANPWFMGTGVPLANARWGNYAFSAAFGGLFPMLSFQVHGFPDAAAYAQPAGFHYGYGHGHGFHGGHMGHAHGVHRQAPLGQQQQADIYLKALLLMVGVLVIASLIAF

SEQ ID NO: 17732 - protein, 228 aa, Pennisetum glaucum
MSANVGESTSAGSSSDAAGGSFECNICFELPQEPIVTLCGHLFCWPCLYRWLHIHAHSPECPVCKALVEEDKLVPLYGRGKDRVDPRSKNMPESDIPNRPTGQRPATAPQVDTNNNFPNANANPWFMGTGVPLANARWGNYAFSAAFGGLFPMLSFQVHGFPDAAAYAQPAGFHYGYGHGHGFHGGHMGHTHGVQRQAPLGQQQQADIYLKGLLLVVGVLVIASLLAF

SEQ ID NO: 17733 - protein, 230 aa, Avena sativa
MATNVGESTSVGSSSDAAGGSFECNICFELPQEPIVTLCGHLFCWPCLYRWLHMHAHTPECPVCKAIVEEDKLVPLYGRGKDRVDPRSKNTPGADIPNRPAGQRPATAQQADPNNNFPNAHANPWFMGMGAGVPLANARWGNYAFSAAFGGLFPMLSFQMHGIPDPTAYAQPAGFHYGYGHGHGFHGGHMGPAHGVPRQGPLGQQQQADVYLKALLLMVGVLVIASLLAF

SEQ ID NO: 17734 - protein, 230 aa, Avena sativa
MATNVGESTSVGSSSDAAGGSFECNICFELPQEPIVTLCGHLFCWPCLYRWLHMHAHTPECPVCKAIVEEDKLVPLYGRGKDRVDPRSKNTPGADIPNRPAGQRPATAQQADPNNNFPNAHANPWFTGMGAGVPLANARWGNYAFSAAFGGLFPMLSFQMHGIPDPTAYAQPAGFHYGYDHGHGFHGGHMGPAHGVPRQGPLGQQQQADVYLKALLLMVGVLVIASLLAF

SEQ ID NO: 17735 - protein, 576 aa, Zea mays
MRRGGGRRFPKPSLAPSTAAEATPALDASVIRNLDSAFSRRDSDANSLCSSRPASTVGAILNFSDRATQVAALRVVNTFLAPAVTLRGPLPAARDIQAALRLLVDRLHLPRNDATFDDDLIQDLRLLGCPYKVTRSALKAPGTPHSWPVLLSVLHWLTLLCHSQGDDPDAPSGPSDDLLLYITQSYSHFLSGDDAAVETVDEEYASKARMTGEAYVATARALEKEAEELETQVNKLISGPSRREALESEKEAFNADIHKFDAVVNAWKTKFNEREQSFGDLEKELEAKVSDTQRAAAEIQDLLKQVDAQPVNVKDVDRMRREMQAIEDDIANAEKGKTALEDKVWELEAKLVTKLEELERHAEQCNQALKKLKPTVAFQYMIDSKGSSPAEMLGTGYKTVLKPALLAHAEENKRICLSNLENLNDLQKQLQGNAKVLEEERNNISSLQEKNDEIVARLNLLDREIINDDSRFTSEAAQMKDELEKKKNSLISAEKQADDFLKKSEKRLQDVTLKVEEETQAAAKELLELLDSMAEHKEFMETTIAQRRKDLYETADYIASVASKTVITQVPNPAES

SEQ ID NO: 17736 - protein, 255 aa, Flaveria ramosissima
MIGPQRPQIVLFGSSIVQLSFSNDGWGAILADVYARKADIVLRGYYGWNSRRAVKVLDQVFPKDAASQPSLIIVYFGGNDSMGPHSSGLGPHVPLPEYIENMRKIATHLQGLSDTTRLIFLTCPPVDEVKLGENTSSIFSELVRTNELCRTYSDACVELCNEMGIKVIDLWTAFQKRDDWLTFFTDGVHLSGEGSKIVVEEILKVLKEAEWKPSLHWKSMPTEFSEDSPYDLVFSDGKTTLNPSDWTFHRDIQWD

SEQ ID NO: 17737 - protein, 255 aa, Echinacea purpurea
MVGPQRPQIVLFGSSIVQLSFSNDGWGAILADVYARKADIVLRGYYGWNSRRAVKVLDQVFPKDAASQPSLIIVYFGGNDSMGPHSSGLGPHVPLPEYIENMRKVATHLQGLSDTTRLIFLTCPPVDEVKLSETTSSIFSELVRTNELCRAYSDACVELCNEMGIKVIDLWTAFQKRDNWLTCFTDGVHLSGEGSKIVVEEILKVLKEAEWKPSLHWKSMPTEFSEDSPYDLVYTDGKTTLNPSDWTFHREIQWD

SEQ ID NO: 17738 - protein, 255 aa, Ambrosia trifida
MTGPQRPQIVLFGSSIVQLSFSNDGWGATLADIYARKADIVLRGYYGWNSRRAVKVLDQVFPKDAASQPSLIIVYFGGNDSMGPHSSGLGPHVPLPEYIENMRKIATHLQGLSDTTRLIFLTCPPVDEVKLGENTSSIFSELVRTNELCRTYSDACVELCNEMGIKVIDLWTAFQKRDNWLTFFTDGVHLSGNGSKIVVEEILKVLKEAEWKPSLHWKSMPTEFSEDSPYDLVYTDGKTTLNPSDWTFHREIQWD

SEQ ID NO: 17739 - protein, 256 aa, Cichorium intybus
MVGPGRPQIVLFGSSIVQLSFSNDGWGAILADVYARKADIVLRGYYGWNSRRAVKVLDQVFPKDAASQPSLIIVYFGGNDSMGPHSSGLGPHVPLPEYIENMRKIATHLKGLSDTTRLIFLSCPPVDEVKLSENTSSIFSELVRTNELCRTYSEACVELCNEMGIKVIDLWTAFQKRDDWMTACFTDGVHLSGEGSKIVVEEILKVLKDAEWKPSLHWKSMPTEFSEDSPYDLVYSDGKTTLNPSDWTFHREIQWD

SEQ ID NO: 17740 - protein, 256 aa, Cichorium intybus
MVGPGRPQIVLFGSSIVQLSFSNDGWGAILADVYARKADIVLRGYYGWNSRRAVKVLDQVFPKDAASQPSLIIVYFGGNDSMGPHSSGLGPHVPLPEYIENMRNIATHLKGLSDTTRLIFLSCPPVDEVKLSENTSSIFSELVRTNESCRIYSEACVELCNEMGIKVIDLWTAFQKRDDWLTACFTDGVHLSGEGSKIVVEEILKVLKDAEWKPSLHWKSMPTEFSEDSPYDLVYSDGKTTLNPSDWTFHREIQWD

SEQ ID NO: 17741 - protein, 255 aa, Chrysanthemum coronarium
MIGPERPQIVLFGSSIVQLSFSNDGWGAALADIYSRKADIVLRGYYGWNSRRAVKVIDQIFPKEAASQPSLIIVYFGGNDSMGPHSSGLGPHVPLSEYIENMRKIASHLQGLSDTTRLIFLGCPPVDEAKLSENTSTIFSELVRTNELCRIYSEACVELCNEMGIKVIDLWTAFQKHDNWLTFFTDGVHLSGEGSKIVVEEILKVLKEAEWKPSLHWKSMPTEFSEDSPYDLVYSDGKTTLNPSDWTFHREIQWD

SEQ ID NO: 17742 - protein, 255 aa, Artemisia annua
MIGPERPQIVLFGSSIVQLSFSNDGWGAALADIYSRKADIVLRGYYGWNSRRAVKVIDQIFPKEAASQPSLIIVYFGGNDSMGPHSSGLGPHVPLAEYIENMRKIASHLQGLSDTTRLIFLGCPPVDEARLRENTSTIFSELVRTNELCRIYSEACVELCNEMGIKVIDLWTAFQKHDNWLTFFTDGVHLSGEGSKIVVEEILKVLKEAEWKPSLHWKSMPTEFSEDSPYDLVYSDGKTTLNPSDWTFHREIQWD

SEQ ID NO: 17743 - protein, 255 aa, Chrysanthemum coronarium
MIGPERPQIVLFGSSIVQLSFSNDGWGAALADIYARKADIVLRGYYGWNSRRAVKVIDQIFPKEAASQPSLVIVYFGGNDSMGPHSSGLGPHVPLAEYIENMRKIASHLQGLSDTTRLIFLGCPPVDEARLRENTSTIFSELVRTNELCRIYSEACVELCNEMGIKVIDLWTAFQKHDNWLTFFTDGVHLSGEGSKIVVEEILKVLKEAEWKPSLHWKSMPTEFSEDSPYDLVYSDGKTTLNPSDWTFHREIQWD

SEQ ID NO: 17744 - protein, 256 aa, Lactuca sativa
MIGPGRPQIVLFGSSIVQLSFSNDGWGAILADVYARKADIVLRGYYGWNSRRAIKVLDQVFPKDAAIQPSLIIVYFGGNDSMGPHSSGLGPHVPLPEYIENMRKIVTHLKGLSDTTRLIFLSCPPVDEVKLSENTSSIFSELVRTNELCRTYSEACVELCNEMGVKVIDLWTAFQKRDDWMTACFTDGVHLSGEGSKIVVAEILKVLKEAEWKPSLFWKSMATEFSEDSPYDLVYTDGKTTLNPSDWTFHREIQWD

SEQ ID NO: 17745 - protein, 255 aa, Chrysanthemum coronarium
MIGPERPQIVLFGSSIVQLSFSNDGWGAALADIYARKADIVLRGYYGWNSRRAVKVIDQIFPKEAASQPSLVIVYFGGNDSMGPHSSGLGPHVPLAEYIENMRKIASHLQGLSDTTRLIFLGCPPVDEARLRENTSTIFSELVRTNELCRIYSEACVELCNEMGIKVIDLWTAFQKHENWLTFFTDGVHLSGEGSKIVVEEILKVLKEAEWKPSLHWKSMPTEFSEDSPYDLVYSDGKTTLNPSDWTFHREIQWD

SEQ ID NO: 17746 - protein, 255 aa, Chrysanthemum coronarium
MIGPERPQIVLFGSSIVQLSFSNDGWGAALADIYSRKADIVLRGYYGWNSRRAVKVIDQIFPKEAASQPSLIIVYFGGNDSMGPHSSGLGPHVPLAEYIENMRKVASHLQGLSDTTRLIFLGCPPVDEAKLSENTSTIFSELVRTNELCRMYSEACVELCNEMGIKVIDLWTAFQKHDNWMTFFTDGVHLSGEGSKIVVEEILKVLKEAEWKPSLHWKSMPTEFSEDSPYDLVYSDGKTTLNPSDWTFHRKIQWD

SEQ ID NO: 17747 - protein, 255 aa, Chrysanthemum coronarium
MIGPERPQIVLFGSSIVQLSFSNDGWGAALADIYARKADIVLRGYYGWNSRRAVKVIDQIFPKEAASQPSLVIVYFGGNDSMGPHSSGLGPHVPLAEYIENMRKIASHLQGLSDTTRLIFLGCPPVDEARLRENTSTIFSELVRTNELCRIYSEACVELCNEMGIKVIDLWSAFQKHENWLTFFTDGVHLSGEGSKIVVEEILKVLKEAEWKPSLHWKSMPTEFSEDSPYDLVYSDGKTTLNPSDWTFHREIQWD

SEQ ID NO: 17748 - protein, 256 aa, Cirsium arvense
MIGPQRPQIVLFGSSIVQLSFSNDGWGATLADIYARKADIVLRGYYGWNSRRAIKVLDQVFPKDSANQPSLVIVYFGGNDSMGPHSSGLGPHVPLPEYIENMRKVATHLQELSDTTRIIFLSCPPVDEVRVRENTSSIFSELVRTNELCRIYSEACVELCNEMGVKVIDLWTAFQKRDDWMTACFTDGVHLSGEGSKIVVEEILKVLKEAEWKPSLHWKSMPTEFSEDSPYDLVYSDGKTTLNPSDWTFHREIKWD

SEQ ID NO: 17749 - protein, 257 aa, Centaurea maculosa
MVGPADRPQIVLFGSSIVQLSFSNDGWGAILADVYARKADIVLRGYYGWNSRRAIKVLDQVFPKDSANQPSLVIVYFGGNDSMGPHSSGLGPHVPLPEYVENMRKIATHLQGLSETTRIIFLSCPPVDEVRVRENTSSIFSELVRTNELCRMYSEACVELCNEMGVKVIDLWTAFQKRDDWTTACFTDGVHLSGEGSKIVVAEILKVLKEAEWKPSLHWKSMPTEFSEDSPYDLVYSDGKTTLNPSDWTFHREIKWD

SEQ ID NO: 17750 - protein, 257 aa, Centaurea maculosa
MVGPAERPQIVLFGSSIVQLSFSNDGWGAILADVYARKADIVLRGYYGWNSRRAIKVLDQVFPKDSANQPSLVIVYFGGNDSMGPHSSGLGPHVPLPEYVENMRKIATHLQGLSETTRIIFLSCPPVDEVRVRENTSSIFSELVRTNELCRIYSEACVELCNEMGVKVIDLWTAFQKRDDWMTACFTDGVHLSGEGSKIVVAEILKVLKEAEWKPSLHWKSMPTEFSEDSPYDLVYSDGKTTLNPSDWTFHREIKWD

SEQ ID NO: 17751 - protein, 255 aa, Helianthus annuus
MVGPERPQIVLFGSSIVQLSFSNDGWGAILADVYARKADIVLRGYNGWNSARAVKVLDQIFPKDAASQPSLIIVYFGGNDSMEPHPSGLGPHVPLPEYIENMRKIATHLQGLSDTTRLIFLGCPPVDEVGLRENTSSILREHVRTNELCRIYSEACIELCNEMGIKVIDLWTAFRKQDDWLTYFTDGVHLSGSGSKIVAEEILKVLKEADWKPSLHWKSMPTEFSEDSPYDLVSSDGKTTLNPSDWTFHREIQWD

SEQ ID NO: 17752 - protein, 255 aa, Arnica chamissonis
MAGPQRPQMVLFGSSIVQLSFSNDGWGATLADIYARKADIVLRGYYGWNSRRAIEVLDQIFPKDAAIQPSLIIVYFGGNDSMGPHSSGLGPHVPLPEYVENMRKVATHLQGLSDTTRLIFLTCPPVDEVKVRENTSAVFSELVRTNELCRIYSEACVKLCNEMGIKVIDLWTAFQKHDDWLTFFTDGVHLSGSGSNIVVGEILKVLKEAEWKPSLHWKSMPTEFSENSPYDLVYKDGKTTINASDWTFHRDIQWD

SEQ ID NO: 17753 - protein, 255 aa, Echinacea purpurea
MVGPRRPQIVLFGSSIVQLSFSNDGWGAILADVYARKADIVLRGYNGWNSRRTVKILDQIFPKDAASQPSLIIVYFGGNDSMEPHSSGLGPHVPLPEYIENMRKIATHLQGLSDTTRIIFLGCPPVDEVSLRGDKSSILREHVRTNELCRIYSEACIELCNEMGIKVIDLWTAFRKQDDWLTYFTDGVHLSGSGSKIVVEEILKVLKEAEWKPSLHWKSMPTEFSEDSPYDLVYTDGKTTLNPSDWTFHREIKWD

SEQ ID NO: 17754 - protein, 256 aa, Amsonia hubrichtii
MVGPQRPQFVLFGSSIVQLSFSNGGWGAILADVYARKADIVLRGYYGWNSRRAVQVLDQVFAKDAANQPSLVIVYFGGNDSMGPHSSGLGPHVPLPEYIENMRKIATHLKSLSESTRLIFLSCPPVDEVKVRENTSSAFSELVRTNDLCQKYSEACIELCHEMGIKVVDLWTAMQKREDWLSACFTDGVHLSEEGSKIVVEEILKVLKEAEWVPCLHWKSMPTEFSEDSPYDLVASDGKNTLNPSDWTFHRKIQWD

SEQ ID NO: 17755 - protein, 256 aa, Catharanthus roseus
MVGPQRPQFVLFGSSIVQLSFSNGGWGAILADVYARKADILLRGYYGWNSRRAVQVLDQVFPKDAANQPDLVIVYFGGNDSMGPHSSGLGPHVPLPEYIENMRKIAIHLKNLSESTRLIFLSCPPVDEVKVRENTSSVFSELVRTNELCRSYSDACIELCHELGIKVVDLWTAMQKREDWLTACFTDGVHLSEEGSKIVVEEILKVLKEADWVPCLHWKSMLTEFSEDSPYDLVASDGKTTLNPSDWTFHRKIQWD

SEQ ID NO: 17756 - protein, 256 aa, Tabernaemontana elegans
MVGPQRPQFVLFGSSIVQLSFSNGGWGAILADVYARKADILLRGYYGWNSRRAVQVLDQVFPKDAANQPSLVIVYFGGNDSMGPHSSGLGPHVPLPEYIENMRNIATHLKNLSESTRLIFLSCPPVDEVKVHENRSSALSELVRTNDLCRTYSEACIELCHEMGIKVVDLWTAMQKREDWLTACFTDGVHLSEEGSKIVVEEILKVLKEAEWVPCLHWKSMPSEFSEDSPFDLVASDGKTTLNPSDWTFHRKIQWD

SEQ ID NO: 17757 - protein, 256 aa, Mimulus guttatus
MVGPGRPLFVLFGSSIVQLSFSNGGWGAILSDIYARKADIITRGYYGWNSRRALKILDQVFPKDAAVQPSLIIVYFGGNDSMGAHSSGLGPHVPLPEYIDNMRKIATHLKNLSDKTRLIFLSCPPVNEVKLRENTSSYFSELVRTNELCRIYSEACINVCQEMDIKVIDLWTAIQKREDWSNACFTDGVHLSGEGSKVVVEEILKVLKEAEWEPKLHWKSMATEFSEDSPYDLVASDGKTTINPSEWTFHRDIQWD

SEQ ID NO: 17758 - protein, 254 aa, Vinca minor
GPQRPQFVLFGSSIVQHSFSNGGWGAILADIYARKADILLRGYFGWNSRRAIQVLDQVFPKDAANQPSLVIVYFGGNDSMGPHSSGLGPHVPLPEYVENMRKIANHLKNLSESTRVIFLSCPPVNEVKVRENTSSVFSELVRTNELCRIYSEACIELCHKMGIKVVDLWTAMQKREDWLTACFTDGIHLSEEGSEIVVEEILKVLKEADWVPCLHWKSMPTEFSEDSPYDLVYSDGKTTLNPSDWTFHRKIQWD

SEQ ID NO: 17759 - protein, 256 aa, Valeriana officinalis
MVGPARPQIVLFGSSIVQLSFSNGGWGAILSDVYSRKADIVLRGYYGWNSRRALQVLDQVFPKDAVVQPSLIIVYFGGNDSMGPHSTGLGPHVPLPEYIENMRKVATHLKSLSDTTRIIFLSCPPVNEEKVLKNSSIFSELVRTNELCRVYSEACMELCQEMGLKAIDLWTAFQRRDDWLNVCFIEDGVHLAEEGSIIVVEEILKVVKEADWSPSLHWKSMPTEFSEDSSYDLVYSDGKTLLNPSDWTFHRKIQWD

SEQ ID NO: 17760 - protein, 256 aa, Vitis vinifera
MVGPQRPQFVLFGSSIVQLSYANGGWGAILSDVYARKADIVLRGYYGWNSRRAVEVLHQVFPKDAATQPSLVIVYFGGNDSMGPHSSGLGPHVPLPEYIEHMRSIAAHLQSLSDTTRVIFLSCPPVNEAKVRAGASGIFSELVRTNELCRQYSEACIELCQEVGVKVVDLWTAFQKRDDWLNACFTDGVHLSAEGSKIVVEEILKVLKGAEWEPSLHWKSMLTEFGDDSPYDLVAFDGKTTLNPSDWTFHREIQWD

SEQ ID NO: 17761 - protein, 256 aa, Rosmarinus officinalis
MVGPARPLFVLFGSSIVQLSYSNGGWGAILSDIYARKADIILRGYYGWNSRRAAQILDQVFPEDATVQPSLIIVYFGGNDSMGPHSSGLGPHVPLPEYIENMRKIATHLKNLSEKTRIIFLSCPPVNETKLRENTSTYFSELVRTNELCRMYSEACIELCKEMDVKVVDLWTAMQKREDWMNACFTDGVHLSAEGSKVVVEEILEVLKQAEWEPSLHWKSMLTEFSEDSPYDLVASDGKTTINPSEWTYHREIQWD

SEQ ID NO: 17762 - protein, 256 aa, Theobroma cacao
MVGPARPQFVLFGSSIVQLSFSNGGWGAILADVYARKADILLRGYYGWNSRRAVEVLDHVFPKDAATQPSLIITYFGGNDSMGPHPSGLGPHVPLNEYIEHMRKIAIHLKSLSDSTRLIFLTCPPVDEDRVSKNTSEFFSHLIRTNELCQKYSEACVKLCQELDVKVVDLFTAFQRRDNWTADCFTDGVHLSAEGSKIVVAEILNVLKEAEWQPSLHWKAMPTEFSEDSPYDLVAADGKTTLNPSEWTFHRAIQWD

SEQ ID NO: 17763 - protein, 659 aa, Ambrosia trifida
MSFYTVKVEDSRAEAGDVPSAGPVYRCIYAKDGLMELPPGYDSPWDFFSESAKRNPKHPALGRRQIIDGKAGDYSWISYQDAYNSAIRIASAIRTRSVNPGDRCGIYGPNCPEWIISMEACNSSGITYVPLYDTLGANAVEFIINHAEISLVFVQDNKIPAILSCLPNCSSNLKTIVSFGNISESQKKEATEHGVECFSWEEFVSMGSLEDELPAKHKTDICTIMYTSGTTGEPKGVILSNAAFMSEVLSMHQLLVETDKPGTEEDTYFSFLPLAHIFDQIIETYCIYRGASIGFWQADIRYLIEDLLVLKPTIFCGVPRVYDRIYTGIMAKILAGGTVRKALFDFAYNYKLRNLEKGIQQDKSAPLLDKLVFDKIKQGFGGRVRLMLSGAAPLPKHVEEFLRVTCCTVLSQGYGLTESCGGCFTSIANVYSMIGTVGVPMTTIEARLESVPEMGYDALGSVPRGEICLRGNTLFSGYHKREDLTKDVLVNGWFHTGDIGEWQADGAMKIIDRKKNIFKLSQGEYVAVENIESTYSRCPLVTAIWVYGNSFESFLVAVVVPDKTAIEEWAAKNNESGDYISLCKNSNVRKYVLDELNAEAQNNKLRGFEMLKAVHLEPVPFDFERDLITPTFKLKRQQLLKYYKDCIDTLYAEAKTSKK

SEQ ID NO: 17764 - protein, 659 aa, Ambrosia trifida
MSFYTVKVEDSRAEAGDVPSAGPVYRCIYAKDGLMELPPGYDSPWDFFSESAKRNPKNPALGRRQIIDGKAGDYSWISYQDAYNSAIRIASAIRTRSVNPGDRCGIYGPNCPEWIISMEACNSSGITYVPLYDTLGANAVEFIINHAEISLVFVQDNKIPAILSCLPNCSSNLKTIVSFGNISESQKKEATEHGVECFSWEEFVSMGSLEDELPAKHKTDICTIMYTSGTTGEPKGVILSNAAFMSEVLSMHQLLVETDKPGTEEDTYFSFLPLAHIFDQIIETYCIYRGASIGFWQADIRYLIEDLLVLKPTIFCGVPRVYDRIYTGIMAKILAGGTVRKALFDFAYNYKLRNLEKGIQQDKSAPLLDKLIFDKIKQGFGGRVRLMLSGAAPLPKHVEEFLRVTCCTVLSQGYGLTESCGGCFTSIANVYSMIGTVGVPMTTIEARLESVPEMGYDALGSVPRGEICLRGYTLFSGYHKREDLTKDVLVNGWFHTGDIGEWQADGAMKIIDRKKNIFKLSQGEYVAVENIESTYSRCPLVTAIWVYGNSFESFLVAVVVPDKTAIEEWAAKNNESGDYTSLCKNSNVRKYVLDELNAEAQNNKLRGFEMLKAVHLEPVPFDFERDLITPTFKLKRQQLLKYYKDCIDTLYAEAKTSKK

SEQ ID NO: 17765 - protein, 660 aa, Echinacea purpurea
MSVYTFKVEDAMAAAGEVPSAGPVYRSKYAKDGLMELPPGYDSPWDFFSESAKRNPKNPALGRRQIIIDGKAGGYSWISYQDAYNSALRIASTMRSRSVNPGDRCGIYGANCPEWIISMEACNSNGITYVPLYDTLGANAVEFIINHAEISLVFVQDNKIPAILSCLPNCSSNIKTIVSFGKISDSQRKEAMEHGVECFSWEEFVSMGNLEDELPAKHKTDICTIMYTSGTTGEPKGVILSNSAFMSEVLSMHQMLVETDKPGTEEDTYFSFLPLAHIFDQIIETYCIYRGASIGFWQADIRYLIEDLLVLKPTIFCGVPRVYDRIYTGIMAKILAGGTVRKALFDFAYNYKLRNLEKGIQQDKSAPLLDKLVFDKIKQGFGGRVRLMLSGAAPLPKHVEEFLRVTCCTVLSQGYGLTESCGGCLTSIANVYSMVGTVGVPMTTIEARLESVPEMGYDALSSVPRGEICLRGNTLFSGYHKREDLTKDVLVNGWFHTGDIGEWQADGAMKIIDRKKNIFKLSQGEYVAVENIESTYSRCPLVTAIWVYGNSFESFLVAVVVPDRMAIEEWAAKNNKSGDYESLCKNSHVRKYVLDELNCEAQDNKLRGFEMLKAVYLEPVPFDFERDLITPTFKLKRQQLLKYYKDCIDKLYAEAKAFKK

SEQ ID NO: 17766 - protein, 659 aa, Arnica chamissonis
MSVYTVKVEDSREAAGETPSAGPVYRCIYAKDALMELPPGYDSPWDFFSESVKRNPKNPALGRRQIIDGKAGGYTWISYQDAYSSALRIASAIRTRAVNPGDRCGIYGPNCPEWIISMEACNRNGITYVPLYDTLGANAVEYIINHAEISLVFVQQNKIPAILSCVPNCSSNLKTIVSFGNISESQRKEAVEQGVDCFSWEEFASMGSLEDELPAKCKTDICTIMYTSGTTGEPKGVILSNAAFMSEVLSMHQLLVETDKPGTEEDIYFSFLPLAHIFDQIIETYCIYRGSSIGFWQADIRYLIEDLLVLKPTIFCGVPRVYDRIYTGTMAKILAGGTVRKALFDFAYNYKLRNLEKGIQQDKSAPLLDKLVFDKIKQGFGGRVRLMLSGAAPLPKHVEEFLRVTCCTVLSQGYGLTESCGGCFTSIANVYSMIGTVGVPMTTIEARLESVPEMGYDALSSVPRGEICLRGNTLFSGYHKREDLTNDVLVNGWFHTGDIGEWQADGAMKIIDRKKNIFKLSQGEYVAVENIESTFSRCPLVTAIWVYGNSFEYFLVAVVVPDRMAIEEWAAKNNESGDYESLCRNSNVRKYVLDELNSEAQNNKLRGFEMLKAVHLEPVPFDFERDLITPTFKLKRQQLLKYYKDRVDRLYAEAKTSKK

SEQ ID NO: 17767 - protein, 659 aa, Cichorium intybus
MSVYTIKVDESRPATGETPSAGPAYRCIYAKDALMELPPGYESPWDFFSESVKRNPKNPALGRRQIIDGKAGGYSWQSYQDAYNSAIRIASAIRGRSVNPGDRCGIYGTNSPEWIISMEACNSNGITYVPLYDTLGANAVEYIINHAEISLVFVQETKLPAILSCVPNCSSYLKTIVSFGNVSESQKKESMEQGVDCFSWEEFTSMGRLDDELPAKHKTDICTIMYTSGTTGEPKGVILSNAAFMAEVLSVHQLLVETDKPATEEDTYFSFLPLAHIFDQIMETYCIYCGSSIGFWQGDIRYLIEDLLVLKPTIFCGVPRVYDRIYTGIMAKISTGGAVKKALFDFAYYYKLRNLEKGIQQDKSAPLLDKLVFDKIKQGFGGRVRLMLSGAAPLPKHVEEFLRVTCCTVLSQGYGLTESCGGCFTSIANVHSMIGTVGVPMTTIEARLESVPEMGYDALAPVPRGEICLRGNTLFSGYHKREDLTDSVLVDGWFHTGDIGEWQADGAMKIIDRKKNIFKLSQGEYVAVENIESTYSRCPLVTSIWVYGNSFESFLVAVVVPDRIVIEEWAERNNESGDFMSLCKNSNVRKYVLDELNSEAQKNKLRGFEMLKAVHLEPIPFDFERDLITPTFKLKRQQLLKYYKDCIDQLYSEAKTSKK

SEQ ID NO: 17768 - protein, 660 aa, Chrysanthemum coronarium
MSLYTVKVEDSRVATGETPSAGPVYRCIYAKDGLMELPPGYESPWDFFSESVKRNPKNPALGRREIIDGKAGGYTWSSYQEAYNSALRIASAIRIRSVNPGDKVGIYGTNCPEWIISMEACNSNAITYVPLYDTLGANAVEYIINHAEISLVFAQENKLPAILSCLPNCSSNLKTIVSFGNISESQRKEATEKGVDCFSWEEFSSTGNLEDELPAKSKTDICTIMYTSGTTGEPKGVILTNGAFMSEVLSMHQLLVETDQPGSEEDTYFSFLPLAHIFDQIIETYCIYSGASIGFWQGDIRYLIEDLIVCKPTIFCGVPRVYDRLYTGIMAKVSAGGAVRKALFDFAYNYKLRNLEKGIQQDKSAPLLDRLVFDKIKQAFGGRVRLMLSGAAPLPKHVEEFLRVACCTVLSQGYGLTESSGGCFTSIANVYSMIGTVGVPMTTIEARLESVPEMGYDALGSVPRGEICLRGNTLFSGYHKREDLTNSVLVDGWFHTGDIGEWQADGAMKIIDRKKNIFKLSQGEYVAVESIESTYSRCPLVTAVWVYGNSFESFLVAVVVPERIALEEWAAKNNESGDYESLCKNPNARKYVLDELNSEAKNNKLRGFEMLKAVHLEPVPFDFERDLITPTFKLKRQQLLKYYKECIDQLYAEAKTTAKK

SEQ ID NO: 17769 - protein, 659 aa, Chrysanthemum coronarium
MSLYTVKVEDSRVATGETPSAGPVYRCIYAKDGLMELPPGYESPWDFFSESVKRNPKNPALGRREIIDGKAGGYTWLSYQDAYNSALRIASAIRSRSVNPGDKVGIYGPNCPEWIISMEACNSNGITYVPLYDTLGANAVEYIINHAEISLVFAQENKLPAILSCLPNCSSNLKTIVSFGNIPESQRKEATEKGVDCFSWEEFSSTGNLEDELPAKNKTDICTIMYTSGTTGEPKGVILTNGTFMSEVLSMHQLLVETDKPGSEDDTYFSFLPLAHIFDQIIETYCIYSGASIGFWQGDIRYLIEDLIVCKPTIFCGVPRVYDRLYTGIMAKVSAGGAVRKALFDFAYNYKLRNLEKGIQQDKSAPLLDRLVFDKIKQAFGGRVRLMLSGAAPLPKHVEEFLRVACCTVLSQGYGLTESSGGCFTSIANVYPMIGTVGVPMTTIEARLESVPDMGYDALGSVPRGEICLRGNTLFSGYYKREDLTNAVLVDGWFHTGDIGEWQADGAMKIIDRKKNIFKLSQGEYVAVESIENTYSKCPLVTAVWVYGNSFESFLVAVVVPERMALEEWAAKNNESGDYESLCKNPNARKYVLDELNSEAKMNKLRGFEMLKAVHLEPVPFDFERDLITPTFKLKRQQLLKYYKECIDQLYAEAKTTKK

SEQ ID NO: 17770 - protein, 630 aa, Flaveria ramosissima
MPKMVLWSCLLVMTLHGTFSANLRKEPKNPALGRRQIIDGKAGGYSWISYQDAYNSALKIASAIRSRSVNPGDRCGIYGPNCPEWIISMKACNSSGITYVPLYDTLGANAVEYIINHAEISLVFVQDNKIPAILSCVPNCSSNLKTIISFGNVSESQRKEAMEHGVDCFSWEEFVSMGNLEDELPAKHKTDICTIMYTSGTTGEPKGVILSNAAFMSEVLSMHQLLVETDKPGTEEDTYFSFLPLAHIFDQIIETYCIYSGASIGFWQADIRYLIDDLLVLKPTIFCGVPRVYDRIYTGIMAKILAGGTVRKALFDFAYNYKLRNLEKGIQQDKSAPLLDRLVFDKIKQGFGGRVRLMLSGAAPLPKHVEEFLRVTCCTVLSQGYGLTESCGGCFTSIANVYSMVGTVGVPMTTIEARLESVPEMGYDALSSVPRGEICLRGTTLFSGYHKREDLTNDVLVDGWFHTGDIGEWQADGAMKIIDRKKNIFKLSQGEYVAVENIESTYSRCPLVTAIWVYGNSFESFLVAVVVPDRMAIEDWAAKNNESGDYESLCKNSNVRKYVLDELNSEAKNNKLRGFEMLKAVHLEPTPFDFERDLITPTFKLKRQQLLKYYKDCIDKLYAEAKASKK

SEQ ID NO: 17771 - protein, 641 aa, Chrysanthemum coronarium
MSLYTVKVEDSRVATGETPSAGPVYRCIYAKDGLMELPPGYESPWDFFSESVKRNPKNPALGRREIIDGKAGGYTWSSYQEAYNSALRIASAIRIRSVNPGDKVGIYGTNCPEWIISMEACNSNAITYVPLYDTLGANAVEYIINHAEISLVFAQENKLPAILSCLPNCSSNLKTIVSFGNISESQRKEATEKGVDCFSWEEFSSTGNLEDELPAKNKTDICTIMYTSGTTGEPKGVILTNGAFMSEVLSMHQLLVETDQPGSEEDTYFSFLPLAHIFDQIIETYCIYSGASIGFWQGDIRYLIEDLIVCKPTIFCGVPRVYDRLYTGIMAKVSAGGAVRKALFDFAYNYKLRNLEKGIQQDKSAPLLDRLVFDKIKQAFGGRVRLMLSGAAPLPKHVEEFLRVACCTVLSQGYGLTESSGGCFTSIANVYSMTGTVGVPMTTIEARLESVPEMGYDALGSVPRGEICLRGNTLFSGYHKREDLTNSVLVDGWFHTGDIGEWQADGAMKIIDRKKNIFKLSQGEYVAVESIENTYSRCPLVTAVWVYGNSFESFLVAVVVPERMALEEWAAKNNESGDYESLCKNPNARKYVLDELNSEAKKNKLRGFEMLKAVHLEPVPFDFERDLITPTFKLKRQQLLK

SEQ ID NO: 17772 - protein, 599 aa, Flaveria ramosissima
LGRRQIIDGKAGGYSWMSYQDAYNSALKIASAIRSRSVNPGDRCGIYGPNCPEWIISMEACNSSGITYVPLYDTLGANAVEYIINHAEISLVFVQDNKIPAILSCVPNCSSNLKTIVSFGNVSESQRKEAMEHGVDCFSWEEFASMGNIEDELPAKRKTDICTIMYTSGTTGEPKGVILSNAAFMSEVLSMHQLLVETDKPGTEEDTYFSFLPLAHIFDQIIETYCIYSGASIGFWQADIRYLIDDLLVLKPTIFCGVPRVYDRIYTGIMAKILAGGTVRKALFDFAYNYKLRNLEKGIQQDKSAPLLDRLVFDKIKQGFGGRVRLMLSGAAPLPKHVEEFLRVTCCTVLSQGYGLTESCGGCFTSIANVYSMVGTVGVPMTTIEARLESVPEMGYDALSSVPRGEICLRGTTLFSGYHKREDLTNDVLVDGWFHTGDIGEWQADGAMKIIDRKKNIFKLSQGEYVAVENIESTYSRCPLVTAIWVYGNSFESFLVAVVVPDRMAIEEWAAKNNESGDYESLCKNSNVRKYVLDELNSEAKNNKLRGFEMLKAVHLEPVPFDFERDLITPTFKLKRQQLLKYYKDCIDKLYAEAKASKK

SEQ ID NO: 17773 - protein, 600 aa, Flaveria ramosissima
ALGRRQIIDGKAGGYSWMSYQDAYNSALKISSAIRSRSVNPGDRCGIYGPNCPEWIISMEACNSSGITYVPLYDTLGANAVEYIINHAEISLVFVQDNKIPAILSCVPNCSSNLKTIISFGNVSESQRKEAMEHGVDCFSWEEFASMGNIEDELPAKHKTDICTIMYTSGTTGEPKGVILSNAAFMSEVLSMHQLLVETDKPGTEEDTYFSFLPLAHIFDQIIETYCIYSGASIGFWQADIRYLIDDLLVLKPTIFCGVPRVYDRIYTGIMAKILAGGTVRKALFDFAYNYKLRNLEKGIQQDKSAPLLDRLVFDKIKQGFGGRVRLMLSGAAPLPKHVEEFLRVTCCTVLSQGYGLTESCGGCFTSIANVYSMVGTVGVPMTTIEARLESVPEMGYDALSSVPRGEICLRGTTLFSGYHKREDLTNEVLVDGWFHTGDIGEWQADGAMKIIDRKKNIFKLSQGEYVAVENIESTYSRCPLVTGIWVYGNSFESFLVAVVVPDRMAIEEWAAKNNESGDYESLCKNSNVRKYVLDELNSEAKNNKLRGFEMLKAVHLEPAPFDFERDLITPTFKLKRQQLLKYYKDCIDKLYAEAKASKK

SEQ ID NO: 17774 - protein, 611 aa, Artemisia annua
SESVKRNPKNPALGRREIIDGKAGGYTWLSYQDAYNSALRIASAIRSRSVNPGDKVGIYGPNCPEWIISMEACNSNGITYVPLYDTLGANAVEYIINHAEISLVFAQENKLPAILSCLPNCSSNLKTIVSFGNIPESLRKEATEKGVDCFSWEEFSSTGNLEDELPAKNKTDICTIMYTSGTTGEPKGVILTNGAFMSEVLSMHQLLVETDKPGSEDDTYFSFLPLAHIFDQIIETYCIYSGASIGFWQGDIRYLIEDLIVCKPTIFCGVPRVYDRLYTGIMAKVSAGGAVRKALFDFAYNYKLRNLEKGIQQDKSAPLLDRLVFDKIKQAFGGRVRLMLSGAAPLPKHVEEFLRVACCTVLSQGYGLTESSGGCFTSIANVYPMIGTVGVPMTTIEARLESVPEMGYDALGSVPRGEICLRGNTLFSGYYKREDLTNSVLVDGWFHTGDIGEWQADGAMKIIDRKKNIFKLSQGEYVAVESIENTYSKCPLVTAVWVYGNSFESFLVAVVVPERMALEEWAAKNNESGEYESLCKNPNARKYVLDELNSEAKINKLRGFEMLKAVHLEPVPFDFERDLITPTFKLKRQQLLKYYKECIDQLYAEAKTTKK

SEQ ID NO: 17775 - protein, 284 aa, Solanum phureja
MKRGSGFSFHVTVVIAAIAFIYFSTVFVFIDQWFGIWSSPGMLNAVFFTVVAVMCISNYALAIYTDPGQVPSSFVPDVEDPDNIVHEIKRKGGDLRYCQKCSLYKPPRAHHCRICNRCILRMDHHCVWMNNCVGHANYKIFFIFVMYAVVACIYSLVLLAGSITIDSPKDDQLSEGSYRVVYIISGLILVPLSLALGFFLCWHFYLILQNKTTIEYQEGVRAMCVAEKGGYVYSHPYDLGAYENLIAVLGPNVLYWLLPSTKHIDSGLRFRTSFDNVPRTPVSK

SEQ ID NO: 17776 - protein, 279 aa, Capsicum annuum
VFSFHVTVVIAAIAFIYFSTVFVFIDEWFGLWSSPGMLNAVFFTVVAVMCIYNYALAIYTDPGQVPSSFVPDVEHPDHIVHEIKRKGGDLRYCQKCSLYKPPRTHHCRICNRCVLRMDHHCVWMNNCVGHANYKIFFIFVMYAVVACIYSLVLLAGSITVDSSKDDLQSEGSYRVVYIISGLTLVPLSLALGFFLGWHFYLILQNKTTIEYQEGVRAMCVAEKGGYVYSHPYDIGAYENLISVLGPNVLCWPFPSTKHIDSGLRFRTSFDSIPGTPASK

SEQ ID NO: 17777 - protein, 284 aa, Nicotiana benthamiana
MKRGSKFSFHVTVVIAAIAFIYFSTVFVFIDQWFGRWSSPGMLNAVLFTVVAAMCISNYALAIYTDPGHVPSSFVPDIEDPEHIVHEIKRKGGDLRYCQKCSLHKPPRAHHCRICNRCVLRMDHHCVWMNNCVGHANYKIFFIFVMYAAVACIYSLVLLVGSMTLDSPKDDEESEGSYRVVYIISGLILVPLSLALSFFLGWHFYLILQNKTTIEYQEGVRAMCVAEKGGYVYSHPYDLGAYENLISVLGPNVLCWPFPSRRHIGSGLRFRTGFDNVPGRAASK

SEQ ID NO: 17778 - protein, 211 aa, Secale cereale
MAAPRALALCVLLAIAVANAEAASVVVGLAKCADCTRKNMKAEEAFKGLQVAIKCKNVHGDYESKAVGALDRTGAFSVPLAADLHGADCVAQLHSAASNTPCPGQEPSKIVPVSEGTTYGIVAGDNVATPSAASPECASMTLCGPIKKHIIEHFHHKKPVPPKPEPKPQPHPDYGPVPKPEPKPQPHPDYHPVPPTPTYGGGGGGGYHGHH

SEQ ID NO: 17779 - protein, 210 aa, Secale cereale
MATPRALVLGVLLVIAVSNAEAASVVVGLAKCADCTRKNIKAEEAFKGLQVAIKCKNVHGDYESKAVGALDRTGAFSVPLAADLHGADCVAQLHSAASNTPCPGQEPSKIVPVSEGTTYGIVAGDNSASPATASPECASMTLCGPIKKHIIEHFHHKKPVPPKPEPKPQPHPDYGPVPKPEPKPQPHPDYHPVPPTPTYDGGGGGYHGHH

SEQ ID NO: 17780 - protein, 468 aa, Hordeum vulgare
MVISVPGHRRSMRDAMLGGGRQLHKPLRCAFYDGIPGEGLAAALAEATGSVSLSRSPATDGGGGGKAARNVLILMSDTGGGHRASAEALRDAFRHDFGDAYQVFVRDLGKEYGGWPLNDMERSYKFMIRHVRLWKMAFHGTSPRWVHGMYLTALAYLYANEVVAGMMKYKPNVIISVHPLMQHIPLWVLKWQSLQPKVPFFTVITDLNTCHPTWFHHGVTRCYCPSAEVAKRALTRGLDPSQIRVYGLPIRPSFCRAVLDKDELRKELGLHPQLPAVLLMGGGEGMGPVEETAKALGQELYDHQRHRPAGQVVVICGRNQALRSTLLSLTWKVPVKIRGFEKQMEKWMGSCDCIITKAGPGTIAEALIRGLPIILNDFIPGQEVGNVPYVVDNGAGVFCKDPGEAARQVARWFTTETDELKRYSCNALKLAQPEAVFDIARDIHKLQPQPAALTRIPYSLTSSFSYHI

SEQ ID NO: 17781 - protein, 478 aa, Brachypodium distachyon
MVISVPSHRRSIRDAVLGGGRQLYTPLRCAFYDGAAAGGGVPGEGLAAVLSEAAGSCLSLSAGISAVDGGGGGGRKAAKNVLILMSDTGGGHRASAEALRDAFRLEFGDAYQVFVRDLGKEYGGWPLNDMERSYKFMIRHVRLWKVAFHGTSPRWVHGVYLAALAYYYANEVVAGIMKYKPDVIISVHPLMQHIPLWVLKWQSLQPKVPFLTVITDLNTCHPTWFHHGVTRCYCPSAEVAKRALLRGLEPSQIRVYGLPIRPSFCRAVLDKDELREELGMHPELPALLLMGGGEGMGPVEETARALGEELYDHRRRRPVGQVVVICGRNQALRNTLQRLPWKVPVKIRGFEKQMEKWMGACDCIITKAGPGTIAEALIRGLPIILNDFIPGQEVGNVPYVVDNGAGVFCKDPREAARQVSQWFSTDIDELKRYSRNALKLAEPEAVFNIVRDIHKLQQQPAAVTRIPYSLTSSFSYHT

SEQ ID NO: 17782 - protein, 469 aa, Oryza sativa
MVISVATPRRSIRDAVLGGVLGAGGRQLYQPLRCAFYDGAAGGGLTAALSEDGAEGGVPLPCGRKTAAAKNVLILMSDTGGGHRASAEALRDAFRLEFGDAYQVFVRDLGKEYGGWPLNDMERSYKFMIRHVRLWKVAFHGTSPRWVHGMYLAALAYFYANEVVAGIMRYNPDIIISVHPLMQHIPLWVLKWQSLHPKVPFVTVITDLNTCHPTWFHHGVTRCYCPSAEVAKRALLRGLEPSQIRVYGLPIRPSFCRAVLDKDELRKELDMDPDLPAVLLMGGGEGMGPVEETARALSDELYDRRRRRPVGQIVVICGRNQVLRSTLQSSRWNVPVKIRGFEKQMEKWMGACDCIITKAGPGTIAEALIRGLPIILNDFIPGQEVGNVPYVVDNGAGVFSKDPREAARQVARWFTTHTNELRRYSLNALKLAQPEAVFDIVKDIHKLQQQPATVTRIPYSLTSSFSYSI

SEQ ID NO: 17783 - protein, 479 aa, Sorghum bicolor
MVISVATPRRSTSIRDAVLGGVLGGGGRQLYQPLRCAFYDGTAGGGGGGLPGDGLSAALSEEPARVSAAGGGNKQKQAARNVLILMSDTGGGHRASAEALRDAFRIEFGDTYKVFVTDLGKEYGGWPLNDMERSYKFMIRHVRLWKVAFHGTSPRWVHGMYLAALAYYYANEVVAGIMKYEPDIIISVHPLMQHIPLWVLKWQSLHPKVPFVTVITDLNTCHPTWFHHGVTRCYCPSTEVANRALLRGLGPSQVRVFGLPIRPSFCRAVLDKDEVRKELGLDPQLPAVLLMGGGEGMGPVEETARALGEELYDHRRRRRVGQVVVICGRNQALRSTLQSLRWKVPVKIRGFETQMEKWMAACDCIITKAGPGTIAEALIRGLPIILNDFIPGQEVGNVPYVVDNGAGVFSKDPREAARQVVRWFSTDEDELKRYSRNALKLAQPEAVFHIVKDIHKLQQQPAAVTRIPYSLTSSFPYHI

SEQ ID NO: 17784 - protein, 477 aa, Zea mays
MVISVPAARRSTSVRDAVLGGGGRQLYQPLRCAFYDGLAAALSESEEPSDSDAAARVPAGCKRQAARNVLILMSDTGGGHRASAEALRDAFRIEFGDAYKVFVTDLGKEYGGWPLNDMERSYKFMIRHARLWKVAFHGTSPRWVHGVYLAALAYLYANEVVAGITKYEPDMIISVHPLMQHIPLWVLKWQQSLRQHHPKAVVPFVTVVTDLNTCHPTWFHHGVTRCYCPSAEVASRALLRGLSPSQVRVFGLPIRPSFCRAVLDKDEVRKELGLDPQLPAVLLMGGGEGIGPVEETARALGEELYDRRRRRRVGQVVVVCGRNRALRSTLQSLRWKVPVKIRGFETQMEKWMAACDCIITKAGPGTIAEALIRGLPIILNDFIPGQEVGNVPYVVDNGAGVFSKDPGEAARQVARWFSSSSTDGDELRRYSRNALRLAQPEAVFHIVRDIHKQLQRQPAAVTRIPSRSLTSSFPYHM

SEQ ID NO: 17785 - protein, 475 aa, Panicum virgatum
MVISVGTGRRSIRDAVLGGGVQGGGGRQLYYRPPLRCGLYDGSVVGGQSVDGLAAALSEEAAADPVRIPDGAAKAKNVLILMSDTGGGHRASAEALRDAFRIEFGDAYQVLVRDLGKEYGGWPLNDMERSYKFMIRHVRLWKVAFHGTSPRWVHGVYLAALAYLYGNEVVAGLMKYKPDMIISVHPLMQHIPLWVLKWQSLQRKVPFFTVVTDLNTCHPTWFHYGVTKCYCPSAEVANRALLRGLQTSQVRVFGLPVRPSFCRAELDKDEMRKELELDPNLPAVLLMGGGEGMGPVEETARALGEELYDDERRRPIGQIVVICGRNRALRSSLQSLTWKVPVKIRGFEKQMEKWMGACDCIITKAGPGTIAEALIRGLPIILNDFIPGQEVGNVPYVVDNGAGVFFKDPRKVANQVARWFSVDVDALKRYSRNALKLAQPEAVFDIVKDIHKLQQHSAALTRIPYFLTSSFLYHI

SEQ ID NO: 17786 - protein, 576 aa, Triticum aestivum
MATPPSPPPPTRASCGSLLQELQELWGEIGPDELERDRMILQLEEDCLNVYRKKVEQTRKQKADLLQVMSLGEAEIEKILSALGERESFSRVEKLGGTLMEQLAKLEPVLDDLRRRRDERINEFLAVQLHIVRLQAEISGTINHGDPAAPLVDETDLSTGRLAELKTQLNELQTEKNLRLQKIDGQIKCINEMCNMMSLDLKKTLYEVHPSFVELERIKSMSISDSTLDRLAGKLHALNQEKKQRLRKLQDLGSTLIELWSLMDTPLDEQKCFDHVTSLISVSPNTVMPQGCLAHDLIEKVEVEVKRLKHLKASKMKELVLKKMTQLEEIYRSVHMHIDSDHEWQILTELIDSGRADLSELLTDMDDRIAEARDLALSRKDILEKVEKWTSATEEEGWLGEYEGDQNRYNAGRGAHINLKRAEKARVLVSKIPSLLENLTTKVNAWEKEKGMSFMYDKKRLLDSLEKYTSERQQKEEEKRRSRELKKLQEQFAAEQGAPYGAKPSPMRPLSARKPLGQSTNVNIVGGTPNSRRVSTPVSRKGGSSCGKMKDTGKTAASIPANYVSLPKDCSDNSYM

SEQ ID NO: 17787 - protein, 575 aa, Secale cereale
MATPPSPPPTRASCGSFLQELQELWGEIGPDELERDRMILQLEEDCLNVYRKKVEQTRKQKADLLQVMSLGEAEIEKILSALGERESFSRAEKLGGTLMEQLAKLEPVLDDLRRRRDERINEFLAVQLHIVRLQAEISGTINHGDPAAPLVDETDLSTGRLAELKTQLNELQTEKNLRLQKIDGQIKCINEMCNMMSHDLKKTLYEVHPSFVELERIKSMSISDSTLDRLAGKLHALNQEKKQRLRKLQDLGSTLIELWSLMDTPLDEQKCFDHVTSLISVSPNTVMPQGCLAHDLIEKVEIEVKRLKHLKASKMKELVLKKMTQLEEIYRSVHMHIDSDNEWRILTELIDSGRADLSELLTDMDDRIAEARDLALSRKDILEKVEKWTSATEEEAWLGEYEGDQNRYNAGRGAHINLKRAEKARVLVSKIPSLLENLTTKVKAWEKEKGMSFMYDKKRLLDSLEEYTSERQQKEEDKRRSRELKKLQEQFAAEQGAPYGAKPSPMRPLSARKPLGQSTNVNIVGGTPNSRRVSTPVSRKGALSCGKMKDTGKTAASIPANYVSLPKDCSDNSYM

SEQ ID NO: 17788 - protein, 543 aa, Triticum aestivum
LERDRMILQLEEDCLNVYRKKVEQTRKQKADLLQVMSLGEAEIEKILSALGERESFSRVEKLGGTLMEQLTKLEPVLDDLRRRRDERINEFLAVQLHIVRLQAEISGTINHGDPAAPLVDETDLSTGRLAELKTQLNELQTEKNLRLQKIDAQIKCINEMCNMMSLDLKKTLYEVHPSFVELERIKSMSISDSTLDRLAGKVHALNQEKKQRLRKLQDLGSTLIELWSLMDTPLDEQKCFDHVTSLISVSPNRVMPQGCLAHDLIEKVEVEVKRLKHLKASKMKELVLKKMTQLEEIYRSVHMHIDSDHEWQILTELIDSGRADLSELLTDMDDRIAEARDLALSRKDILEKVEKWTSAIEEEGWLGEYEGDQNRYNAGRGAHINLKRAEKARVLVSKIPSLLENLTTKVKAWEKEKGMSFMYDKKRLLDSLEKYTSERQQKEEEKRRSRELKKLQEQFAAEQGAPYGAKPSPMRPLSARKPLGQSTNVNIVGGTPNSRRVSTPVSRKGGLSCGKMKDTGKTAASIPANYVSLPKDCSDNSYM

SEQ ID NO: 17789 - protein, 576 aa, Brachypodium distachyon
MATPPSPPPPTRASCGSFLQELQELWGEIGQDELERDKMILQLEEDCLNVYRTKVEETRKQKADLLQTMSLGEADIDRILSALGERESFSRIEKLGGTLMEQLAKVEPVLDDLRMRRDERVNEFLTVQLRIFRLEAEISGTTDHGDPAAPLVDETNLSIRRLTELKTQLTELQTEKNLRLQKIDFQIKCINEMCSMMSLDLKKTLYEVHPSFVELGKTKSMSISDCTLDSLAGKVHALNQEKKQRLRKLQDLGSTLIELWNLMDTPIDEQKCFDHVTSLISVSPNTVMPQGCLAHDLIEKVEVEVKRLKHLKASKMKELVLKKMTELEEIYKSVHMHMDSDHEWRLLADLIDSGRADLSELLTGMDDRITEARELALSRKDILEKVEKWTSASEEEGWLGEYERDQNRYNAGRGAHVNLKRAEKARILVSKIPSLLENLTAKIKAWEKEKGIQFMYDKTRLLHSLEEYTSERQQKDEEKRRSRELKKLQEQFAAEQGATYGAKPSPMRPVSARKPLGQSSNVNIIGGTPNSRRVSTPMSRKGGLSSGKMKDAGKTAASIPANYVAITKDCSDNSSL

SEQ ID NO: 17790 - protein, 547 aa, Secale cereale
ELERDRMILQLEEDCLNVYRKKVEQTRKQKADLLQMMSLGEAEIEKILSALGERESFSRVEKLGGTLMEQLAKLEPVLDDLRRRRDERINEFLAVQLHIVRLQAEISGTINHGDPAAPLVDETDLSTGRLAELKTQLTELQTEKNLRLQKIDAQIKSINEMCNMMSLDLKKTLYEVHPSFVELERIKSMSISDSTLDRLAGKVHALNQEKKQRLRKLQDLGSTLIELWSLMDTPIDEQKCFDHVTSLISVSPNTVMPQGCLAHDLIEKVEIEVKRLKHLKASKMKELVLKKMTQLEEIYRSVHMHIDSDHEWRILTELIDSGRADLSELLTDMDDRIAEASDLALSRKDILEKVEKWTSATEEEGWLGEYEGDQNRYNAGRGAHINLKRAEKARVLVSKIPSLLETLTTKVKAWEKEKGMSFMYDKKRLLDSLEKYTSERQQKEEEKRRSRELKKLQEQFAAEQGAPYGAKPSPMRPLSARKPLGQSTNVNIVGGTPNSRRVSTPVSRKGALSCGKNEGYWQDSSFYTGKLCFSSQGLLRQFLHVKM

SEQ ID NO: 17791 - protein, 428 aa, Panicum virgatum
MARPQRVYEAWKGNNKFLFGGRLIFGPDAKSLILSVSLIVVPVSVFCALVARHLRHHFLAYNAGYAIPLVAVVFMIYVLVLLLITSAQDPGIVPRAAHPPEEEFSYGNALSGGTPGRLQFPRVKEVMVNGMLVKVKYCDTCMIYRPPRCSHCSICNNCVERFDHHCPWVGQCIGQRNYRYFFMFVSSSTLLCIYVFAMSALYIKFLMDEGYPTVWKAFKHSPASLGLLIYCFIALWFVGGLTGFHLYLISTNQTTYENFRYRSDSRPNVYNQGCLNNFLEVFCSKTKPSKHKFRAYAQEELRPPTVSFGRGVEDEPVGGPRSKVEDDLEIGSDLLKISQRRNYEDVDVEMGGRCSNEMEGIANAKLGTGSESYIPAVGSDVRVRHSSWDRRSGNWDMSSDVLTRSASDVIERSVFATEAAHPSQAETH

SEQ ID NO: 17792 - protein, 430 aa, Sorghum bicolor
MARPQRVYEAWKGNNKFFFGGRLIFGPDAKSLILSVSLIVIPVLVFCGFVARHLRHHFPDYNAGYAIPAVAVVFMIYVLVLLLVTSAQDPGIVPRAAHPPEEEFSYGNALSGGTPGRLQFPRVKEVMVKGMPVKVKYCDTCMIYRPPRCSHCSICNNCVERFDHHCPWVGQCIGQRNYRYFFMFVSSSTLLCIYVFAMSALYIKFLMDEGYPTVWKAFKHSPASLGLLIYCFIALWFVGGLTGFHLYLISTNQTTYENFRYRSDSRPNIYSQGCLNNFLEVFCSKTKPSKHKFRAYAQEEVRPPTVSFGRDVEDEPVGGPRSKVEDDLEIGSDLLKISQRRNYEDVNVEVGGPHRLSSEMEGIANAKLVACSESQIPAVGSDVRVRHSSWDRRSGNWDMSSDVLTRSASDVIERSVFATEAAHPSLAETH

SEQ ID NO: 17793 - protein, 432 aa, Zea mays
MARPQRVYEAWKGNNKFFFGGRLIFGPDAKSLILSVSLIVAPVLVFCGFVARHLRHHFPAYNAGYAIPAVAVVFMIYVLVLLLITSAQDPGIVPRAAHPPEDEFSYGNALSGGTPGRLQFPRVKEVLVNGMPVKVKYCDTCMIYRPPRCSHCSICNNCVERFDHHCPWVGQCIGQRNYRYFFMFVSSSTLLCIYVFAMSALYIKFLMDEDYPTVWKAFKHSPASLGLLIYCFIALWFVGGLTGFHLYLISTNQTTYENFRYRSDSRPNIYSQGCLNNFLQVFCSKTKPSKHKFRAYAQEEVRPPTVSFGREVDEEPVGGPRPKVEDDLEIGTDLLKISQRRNYEDVDAETGGRRSRSSEVEGTASARPAVACSESQIPAVGGTDVRVRHSSWDRRSGNWDMSAVLTRSASDVIGRSSVFAADAARPSLEETR

SEQ ID NO: 17794 - protein, 429 aa, Oryza sativa
MAQPQKRVYEAWKGNNRFLFGGRLIFGPDAKSLLVSVSLIVVPVLVFCVFVARHLRHQFSTYNAGYAIPAVAVLFMIYVLTLLFITSAQDPGIVPRASHPPEEEFAYGNPLNGGTPGRLQFPRVKEIMVNGMLVKVKYCDTCMIYRPPRCSHCSICNNCVERFDHHCPWVGQCIGQRNYRFFFLFVSSSTLLCIYVFAMSALYIKFLMEEGYPTVWKALKHSPASLVLMIYCFIALWFVGGLTGFHSYLICTNQTTYENFRYRSDNRPNVYDQGCLNNCLGVFCSKTKPSKHKFRAYVQEEVRAPVVNFGRQMEEEPAGGPRAKVEDDLEIGSDLLQISQRRNYGDVDLEMGSQDCSEMEGIPNAKLAIGSESQIPAIGSEVRVRHSSWDRRSGNWDMSLDVIGRSASDVIRRSASGHEAAPPFQTETH

SEQ ID NO: 17795 - protein, 426 aa, Brachypodium distachyon
MAQPQRVYEAWKGNNRFFLGGRFIFGPDAKSLLVSVALIVVPVFVFCVFVARYLLHRFSVYNAGYAIPAVAIAFMIYVLLLLLITSAQDPGIVPRASHPPEEEFSYGNPLAGETPGRLQFPRVKEVMVNGMPVKVKYCDTCMIYRPPRCSHCSICNNCVERFDHHCPWVGQCIGQRNYRYFFLFVSSSTLLCIYVFAMSALHIKFLMDGDYPTVWKAFKHSPACLVLMIYCFIALWFVGGLTGFHSYLISTNQTTYENFRYRSDNRPNVYNQGCLNNFLEVLCSKGKPSKHRFRAYVQEEVRAPVVNFGRQMEEEPTGGSRAKVEDDLEIGSDLLKISQRRNYEDVDVEMGNQDHSEMESMANAKLVMGSESQIPAVVSEVRVRHSSWDQRSGNWDMSSDVMGRSASDVIGRSASVSEVASQRETH

SEQ ID NO: 17796 - protein, 429 aa, Lolium multiflorum
MGQPQQRVYQAWKGNNKFILGGRLIFGPDAKSLLVSVALIAVPVLVFCAFVAPHLLHRFSAYNAGYAIPAVAIVFMIYVLLLLLTTSARDPGIVPRASHPPEEDFTYGNPLAGETPGRLQFPRIKEVMVNGMLVKVKYCDTCMIYRPPRCSHCSICNNCVERFDHHCPWVGQCIGQRNYRYFFLFVSSSTLLCIYVFAMSALHIKFLMDEDYPTVWKALKHSPACLVLMIYCFIALWFVGGLTGFHSYLISTNQTTYENFRYRADSRPNVYDQGCLNNFLEVLCSKGKPSKHRFRAYVQEEVRAPVVNFGRQMEEEPAGGPRAKVEDDLEIGSDLLKISQRRNYEDVDVEMGSQDYSESEGTGNAKLGMGSGSQIPAVGSEVRVRHSSWDQRSGNWDMSSDVIGRSASDVLGRSSSLTQVASPSRRENH

SEQ ID NO: 17797 - protein, 431 aa, Triticum aestivum
MAQPQPQQRVYQAWKGNNRFFLGGRLIFGPDAKSLLVSVALIVVPVLVFCAFIAPHLLHRFSGYNAGYAIPAVAVGFMIYVLLLLLITSAQDPGIVPRASHPPEEDFAYGNPLAGETPGRLQFPRIKEVMVNGMLVKIKYCDTCMIYRPPRCSHCSICNNCVERFDHHCPWVGQCIGQRNYRYFFLFVSSSTLLCIYVFAMSALHIKFLMDGDYPTVWKAFKHSPACLVLMIYCFIALWFVGGLTGFHSYLISTNQTTYENFRYRADSRPNVYDRGCLNNFLEVLCSKGKPSKHRFRAYVQEEVRAPVVNFGRQMEEEPAGGPRAKVEDDPEIGSDLLKISRRRNYEDVDVEMGNQDDGEKEGMGDAKLAAGSGSQIPAVGSEVRVRHSSWDRRSGNWDMSSDVIGRSASDVLGRSASLTEAAPRSQRETH

SEQ ID NO: 17798 - protein, 431 aa, Secale cereale
MAQPQPQQRVYQAWKGNNRFFLGGRLIFGPDAKSLLVSVALIVVPVLVFCAFIAPHLLHRFPGYNTGYAIPAVAVGFMIYVLLLLLITSAQDPGIVPRASHPPEEDFAYGNPLAGETPGRLQFPRIKEVMVNGMLVKIKYCDTCMIYRPPRCSHCSICNNCVERFDHHCPWVGQCIGQRNYRYFFLFVSSSTLLCIYVFAMSALHIKFLMDGDYPTVWKAFKHSPACLVLMIYCFIALWFVGGLTGFHSYLISTNQTTYENFRYRADSRPNVYDRGCLNNFLEVLCSKGKPSKHRFRAYVQEEVRAPVVNFGRQMEEEPAGGPRAKVEDDLEIGNDLLKISRRRNYEDVDVEMGNQDDSETEGTGDAKLATGSGSQIPAVGSEVRVRHSSWDRRSGNWDMSSDMIGRSASDVLGRSASLTEAVPRSQRETH

SEQ ID NO: 17799 - protein, 507 aa, Pennisetum glaucum
WSQVRAPVIVPLLRLAVAVCLTMSVLLFLERMYMAVVISVVRVFRLRPDRRYRCEPLPEDDPELGSSAFPSVLVQIPMFNEREVYQLSIGAVCGLSWPSDRLVVQVLDDSTDEVIKEMVRMECERWARKGINITYQIRDDRRGYKAGALKAGMKHAYVRECEYVAIFDADFQPDPDFLKRTVPYLVHNPEIALVQARWRFVNADECLMTRMQEMSLDYHFTVEQEVSSSVCAFFGFNGTAGVWRITAVNEAGGWKDRTTVEDMDLAIRASLKGWKFVYLGDVQVKSELPSTFKAFRFQQHRWSCGPANLFRKMLMEIVTNKKVTIWKKIHVIYNFFLIRKIIAHIITFSFYCLIIPATIFVPEVRIPKWGCVYIPSAITLLNSVGTPRSFHLLFFWVAFENVMSLHRTKATLIGLLEAGRANEWVVTAKLGSAMKMKSANKGGLKKQFMRIWERLHITELGVGTFLFSCGWYDLAYGRDHFYIYLFFQSIAFFIIGIGYVGTIVPQS

SEQ ID NO: 17800 - protein, 521 aa, Sorghum bicolor
MDAAAGTAAALPEAWSQVRAPVIVPLLRLAVAVCLTMSVLLFLERMYMAIVITGVRLLRFRPDRRYRCDPLPDDDPELGSSAFPVVLVQIPMFNEREVYQLSIGAVCGLSWPADRLVVQVLDDSTDEMIKEMVRLECERWARKGINITYQIRDDRKGYKAGALRAGMKHAYVRECEYVVIFDADFQPDPDFLKRTVPYLVHNPEIALVQARWRFVNADECLMTRMQEMSLDYHFTVEQEVSSSVCAFFGFNGTAGVWRISAINEAGGWKDRTTVEDMDLAIRASLKGWKFVYLGDVQVKSELPSTFKAFRFQQHRWSCGPANLFRKMLMEIVTNKKVTIWKKIHVIYNFFLIRKIIAHIITFSFYCLVIPATIFVPEVRIPKWGCVYIPSAITLMNSVGTPRSFHLLFFWVAFENVMSLHRTKATLIGLLEAGRANEWVVTAKLGSAMKMKAANKAGLRKQFMRIWERLHVTELGVAAFLFSCGWYDFAYGRDHFFIYLFFQSVAFFIVGIGYVGTIVPQS

SEQ ID NO: 17801 - protein, 514 aa, Zea mays
MDALPEAWSQVRAPVIVPLLRLAVAVCLTMSVLLFLERVYMAVVISGVRLLRLRPDRRYRCDPLPEDDPELGSSAFPVVLVQIPMFNEREVYQLSIGAVCGLSWPADRLVVQVLDDSTDEVIKEMVRMECERWARKGINITYQIREDRKGYKAGALRAGMRHAYVRDCEYVAIFDADFQPDPDYLKRTIPYLVHNPEIALVQARWRFVNADECLMTRMQEMSLDYHFTVEQEVSSSVCAFFGFNGTAGVWRISAVNEAGGWKDRTTVEDMDLAIRASLKGWKFVYLGDVQVKSELPSTFKAFRFQQHRWSCGPANLFRKMLMEIVTNKKVTIWKKIHVIYNFFLIRKIIAHIITFSFYCVIIPATIFVPEVRIPKWGCVYIPSAITLLNSVGTPRSFHLLFFWVAFENVMSLHRTKATLIGLLEAGRANEWVVTAKLGSAMKMKSANKAGLRKQFMRIWERLHVTELGVAAFLFSCGWYDLAYGRDHFFIYLFFQSVAFFIVGVGYVGTIVPQS

SEQ ID NO: 17802 - protein, 517 aa, Saccharum officinarum
MDAAAALPEAWSQVRAPVIVPLLRLAVAVCLTMSVLLFLERMYMAIVIAGVRLLRFRPDRRYRCDPLPEDDPELGSSAFPVVLVQIPMFNEREVYQLSIGAVCGLSWPADRLVVQVLDDSTDEMVKELVRLECERWGRKGINITYQIREDRKGYKAGALRAGMKHAYVRECEYVVIFDADFQPDPDFLKRTIPYLVHNPEIALVQARWRFVNADECLMTRMQEMSLDYHFTVEQEVSSSVCAFFGFNGTAGVWRISAINEAGGWKDRTTVEDMDLAIRASLKGWKFVYLGDVQVKSELPSTFKAFRFQQHRWSCGPANLFRKMLMEIVTNKKVTIWKKIHVIYNFFLIRKIIAHIITFSFYCLIIPATIFVPEVRIPKWGCVYIPSAITLMNSVGTPRSFHLLFFWVAFENVMSLHRTKATLIGLLEAGRANEWVVTAKLGSAMKMKAANKAGLRKQFMRIWERLHVTELGVAAFLFSCGWYDFAYGRDHFFIYLFFQSVAFFIVGIGYVGTIVPQS

SEQ ID NO: 17803 - protein, 521 aa, Oryza sativa
MEVNGGGAAGLPEAWSQVRAPVIVPLLRLAVAVCLTMSVLLFLERMYMAVVISGVKILRRRPDRRYRCDPIPDDDPELGTSAFPVVLIQIPMFNEREVYQLSIGAVCGLSWPSDRLVVQVLDDSTDPVIKEMVRIECERWAHKGVNITYQIRENRKGYKAGALKEGMKHGYVRECEYVAIFDADFQPDPDFLRRTIPFLVHNSDIALVQARWRFVNADECLMTRMQEMSLDYHFTVEQEVSSSVCAFFGFNGTAGVWRVSAVNEAGGWKDRTTVEDMDLAIRASLKGWKFVYLGDVQVKSELPSTFKAFRFQQHRWSCGPANLFRKMLMEIVRNKKVTIWKKIHVIYNFFLIRKIIAHIVTFAFYCLIIPATIFVPEVRIPKWGCVYIPTIITLLNSVGTPRSFHLLFFWILFENVMSLHRTKATLIGLLEAGRANEWVVTEKLGNALKMKSSSKSSAKKSFMRVWDRLNVTELGVAAFLFSCGWYDLAFGKDHFFIYLFFQGAAFFIVGIGYVGTIVPQS

SEQ ID NO: 17804 - protein, 521 aa, Oryza sativa
MEVNGGGAAGLPEAWSQVRAPVIVPLLRLAVAVCLTMSVLLFLERMYMAVVISGVKILRRRPDRRYRCDPIPDDDPELGTSAFPVVLIQIPMFNEREVYQLSIGAVCGLSWPSDRLVVQVLDDSTDPVIKEMVRIECERWAHKGVNITYQIRENRKGYKAGALKEGMKHGYVRECEYVAIFDADFQPDPDFLRRTIPFLVHNSDIALVQARWRFVNADECLMTRMQEMSLDYHFTVEQEVSSSVCAFFGFNGTAGVWRVSAVNEAGGWKDRTTVEDMDLAIRASLKGWKFVYLGDVQVKSELPSTFKAFRFQQHRWSCGPANLFRKMLMEIVRNKKVTIWKKIHVIYNFFLIRKIIAHIVTFTFYCLIIPATIFVPEVRIPKWGCVYIPTIITLLNSVGTPRSFHLLFFWILFENVMSLHRTKATLIGLLEAGRANEWVVTEKLGNALKMKSSSKSSAKKSFMRVWDRLNVTELGVAAFLFSCGWYDLAFGKDHFFIYLFFQGAAFFIVGIGYVGTIVPQS

SEQ ID NO: 17805 - protein, 518 aa, Hordeum vulgare
MDAAVGLPDAWSQVRAPVIVPLLKLAVAVCLLMSVLLFLERLYMAVVIVGVKLLGRRPERRYKCDPISEDDDPELGSAAFPVVLVQIPMFNEREVYQLSIGAVCGLSWPSDRLVVQVLDDSTDPLIKEMVRMECERWAHKGINITYQIREDRKGYKAGALKAGMKHGYVRECEYMVIFDADFQPDPDFLHRTIPYLHHNPEIALVQARWRFVNADECLMTRMQEMSLDYHFKVEQEVSSSVCAFFGFNGTAGVWRISAVNEAGGWKDRTTVEDMDLAIRASLKGWKFVYLGDVQVKSELPSTFKAFRFQQHRWSCGPANLFRKMLLEIVTNKKVTIWKKFHVIYNFFLVRKIVAHIVTFTFYCIIIPTTIFVPEVHIPKWGCVYIPTIITLLNSVGTPRSFHLLFFWILFENVMSLHRTKATLIGLLEAGRANEWVVTEKLGSAMKMKSANKASARKSFMRMWERLNVPELGVGAFLFSCGWYDVAFGKDNFFIYLFFQSMAFFVVGVGYVGTIVPPS

SEQ ID NO: 17806 - protein, 518 aa, Secale cereale
MDAAVGLPDAWSQVRAPVIVPLLKLAVAVCLLMSVLLFLERLYMAVVIVGVKLLGRRPERRYKCDPISEDDDPELGSAAFPVVLVQIPMFNEREVYQLSIGAVCGLSWPSDRLVVQVLDDSTDPLVKEMVRMECERWAHKGINITYQIREDRKGYKAGALKAGMKHGYVRECEYMVIFDADFQPDPDFLHRTIPYLHHNPEIALVQARWRFVNADECLMTRMQEMSLDYHFKVEQEVSSSVCAFFGFNGTAGVWRISAVNEAGGWKDRTTVEDMDLAIRASLKGWKFVYLGDVQVKSELPSTFKAFRFQQHRWSCGPANLFRKMLVEIVTNKKVTIWKKFHVIYNFFLVRKIVAHIVTFTFYCIIIPTTIFVPEVHIPKWGCVYIPTIITLLNSVGTPRSFHLLFFWILFENVMSLHRTKATLIGLLEAGRANEWVVTEKLGSAMKMKSANKASARKSFMRMWERLNVPELGVGAFLFSCGWYDVAFGKDNFFIYLFFQSMAFFVVGVGYVGTIVPQS

SEQ ID NO: 17807 - protein, 518 aa, Brachypodium distachyon
MEAAVGLPEAWSQVRAPVIVPLLRLAVAVCLGMSVLLFLERLYMAVVIVGVKLLGRRPDRRYKCDPISEDDDPELGSAAFPVVLVQIPMFNEREVYQLSIGAVCGLSWPSDRLVVQVLDDSTDAVVKEMVRMECERWAHKGINITYQIREDRKGYKAGALKQGMKHGYVRECEYVVIFDADFQPDPDFLHRTIPYLHHNPEIALVQARWRFVNADECLMTRMQEMSLDYHFTVEQEVSSSVCAFFGFNGTAGVWRISAVNEAGGWKDRTTVEDMDLAIRASLKGWKFVYLGDVQVKSELPSTFKAFRFQQHRWSCGPANLFRKMLLEIVTNKKVTIWKKFHVIYNFFLVRKIVAHIVTFTFYCIIIPTTIFVPEVHIPKWGCVYIPTIITLLNSVGTPRSFHLLFFWILFENVMSLHRTKATLIGLLEAGRVNEWVVTEKLGNAMKMKSASKASARKSFMRIWDRLNVPELGVGAFLFSIGWYDVAFGKDNFFIYLFFQSMAFFIVGVGYVGTIVPQS

SEQ ID NO: 17808 - protein, 569 aa, Sorghum bicolor
MTEESAKKSKLSWSKSLVRKWFNIRPKAQDFHADFDASQARDGGGGSWKPSCSSSEASASTAAKKSRTDRSSSKRSAERARRGKNNFDAARLTEVQDYRIFAATWNVGGKSPPRGLNLDEWLHTSPPADIYVLGFQEIVPLNAGNVLGTEDNLPAKKWVSLIRRTLNKNPGASGCGGYHTPSPVLDPVVELDADFEGSARRQENFSFFHRRSFHNLSRSLRMDGDFMFPQPRLDRRFSVCDPVNLGGRPSDFDGNLRCPGSPDEDNIDMEVSDGAQISPFPHSYSASAPSEQNDDQSNSSRYCLVASKQMVGIFLTVWVRNEIRDDVRNLKVSCVGRGLMGYLGNKGSISISMSLHQTSFCFICCHLTSGEKEGDELRRNSDVLEILRKTRFPRVRGAGDVKSPETILDHDRIIWLGDLNYRIALSYCSAKALVEMHNWKQLLEKDQLRMQQRYGRVFQGWREGRIYFPPTYKYSFNSDRYAGEGRHPKEKRRTPAWCDRILWYGNGLNQLSYVRGESRFSDHRPVYSIFLAEVDIVHQRRRNMGYFSSRIEVEELLPHSQSYREIKFY

SEQ ID NO: 17809 - protein, 578 aa, Zea mays
MTEESAKKSKLSWSKSLVRKWLNIRPRAQDFHADFDAGHQARDGGGGGGGSWRPSCSSSEASASTAKKSRADRPSSKRSAERARRGRNNFDLARLTEVQDYRIFAATWNVGGKSPPRGLNLDEWLHTSPSADIYVLGFQEIVPLNAGNVLGTEDNLPAKKWVSLIRRTLNKNPGSSGCGGGYHTPSPVLDPVVELDADFEGSARRQDNFSFFHRRSFHNLSRSLRMDGDLMFPQPRLDRRFSVCDPVNLGGRPSDFDGSLRCPGSPDEDTIDMEMGDSVQVSPFPHSYSASAPSEQNDDQSNSSRYCLVASKQMVGIFLTVWVRNEIRDDVRNLKVSCVGRGLMGYLGNKGSISVSMCLHQTSFCFVCCHLTSGEKEGDELRRNSDVLEILRKTRFPRVRGAGDVRSPETILEHDRVIWLGDLNYRIALSYCSAKALVEMHSWKQLLEKDQLRMQQRYGRVFQGWKEGRIYFPPTYKYSFNSDRYAGEGRHPKEKRRTPAWCDRILWHGNGLSQLCYVRGESRFSDHRPVYGIFLAEVGVVRQRRRNNAGYFGSRVEVEELLPRSRSYRLRDDEVLLS

SEQ ID NO: 17810 - protein, 570 aa, Oryza sativa
MREESAKKSKLSWSKSLVRKWFNIRTKAQDFHADSETTTQGRDGGGGAGGRASFSASSASTSSAKKSRTDRSSSKRSADRVRRGRNDFDLARLTEVQDYRIFAATWNVGGKSPPRGLNLDEWLHSSPPADIYVLGFQEIVPLNAGNVLGTEDNIPAKKWVSLIRRTLNKNPGASGSGVYHTPSPVLNPVVELEADFEASARRQENYSFFHRRSFHNLSRSLRMDADYMFPQPKLDRRFSVCDPVSLGGRPSDFDGNLRWLGSPDEENIDEELSNAAQCSPLPYSCNTTAPTEANDEQPNGSRYCLVASKQMVGIFLTVWVRNEIRDDVRNLKVSCVGRGLMGYLGNKGSISISMSLHQTSFCFICCHLTSGEKEGDELRRNSDVMEILRKTRFPRVRGANDVKSPETILEHDRIIWLGDLNYRIALSYCSARALVEMHNWKQLLEKDQLRIQQRYGRVFQGWKEGRIYFPPTYKYSFNSDRYAGEGMHPKEKRRTPAWCDRILWYGNGLNQLCYVRGESRFSDHRPVYSIFMAEVEIVHHRRKNMGYFSSRIEVEELLPHSQSYREINFY

SEQ ID NO: 17811 - protein, 608 aa, Panicum virgatum
MTEESAKKSKLSWSKSLVRKWFNIRPKAQDFHADSDGGQGRDGGGGSWRPSCSAREASASMAKKSRTGMWWNEPSVPYVHTPLSVPAAPEMQLSLPTMAAGCSSVPLYGSSSKQSAERARRGKNNFDIARLTEVQDYRIFAATWNVGGKSPPRGLNLDEWLHTSPPADIYVLGFQEIVPLNAGNVLGTEDNLPAKKWVSLIRQTLNKNPGASGCGGYHTPSPVLDPVVELDADFEGSARRQKNFPFFHRRSFHNLSRSLRMDGDYMFPQPRLDRRFSVCDPVNLGGRPSDFDGNLQCPGLPDEENICMEVSDAAQFSPFPHSYTASAPSEQNDEQSSSARYCLVASKQMVGIFLTVWVRNEIRDDVRNLKVSCVGRGLMGYLGNKGSISISMSLHQTSFCFICCHLTSGEKEGDELHRNSDVLEILKKTRFPRVRGAGDIKSPETILEHDRIIWLGDLNYRIAMSYCSAKALVEMHNWKQLLEKDQLHMQQRYGRVFQGWKEGRIYFPPTYKYSFNSDRYAGEGMHPKEKRRTPAWCDRILWYGNGLNQLSYVRGESRFSDHRPVYSIFLADVDIVHQRRRNMGYFSSRIEVEELLPHSQRYREIKFY

SEQ ID NO: 17812 - protein, 569 aa, Brachypodium distachyon
MREESSKKGKLSWSKSLVRKWFNIRNKAQDFHADLDAGHQGRNHGGGEARRVSFSASEASTSTAKKSRNDRSSKRSGDRFRRGRNDFDPARMTEVQDYRIFAATWNVGGKSPPRGLNLDEWLHSSPPADIYVLGFQEIVPLNAGNVLGTEDNIPAKKWVSLIRRTLNKNPGASGYGGYHTPSPVLDPVVELDADFEGSARRQDNFSLFHRRSFHDLSRSLRMDGDFMSQQPRLDRRFSVCDPVNLGGRPSDFDGNSRWIGSPDDENIDEEVSTSAQFSPFPYTYNMSGPTEENDGQSNNSRYCLVASKQMVGVFLTVWVRSEIRDDVRNLKVSCVGRGLMGYLGNKGSISVSMSLHQTSFCFICCHLTSGEKEGDELRRNCDVMEILRKTRFPRVHGTGDVKSPETILDHDRIIWLGDLNYRIALSYCSAKALVEMHNWKQLLEKDQLRIQRRYGRVFQGWKEGRIYFPPTYKYSFNSDRYAGEGMHSKEKRRTPAWCDRILWYGNGLNQLSYVRGESRFSDHRPVYSIFMAEVEIVHQRKRNMGYFSSRIEVEELLPHSQSYRGINFY

SEQ ID NO: 17813 - protein, 508 aa, Panicum virgatum
MAKKSRTDRSSSKQSAERTRRGKNNFDIARLTEVQDYRIFAATWNVGGKSPPRGLNLDEWLHTSPPADIYVLGFQEIVPLNAGNVLGTEDNLPAKKWVSLIRQTLNKNPRASGCGGYHTPSPVLDPVVELDADFEGSARRQDNFPFFHRRSFHNLSRSLRMDGDYMFPQPRLDRRFSICDPVNLGGRPSDFDGNLQCPGSPVEENINMEVSDAAQFSPFLHSYTASAPSEQNDEQSSSPRYCLVASKQMVGIFLTVWVRNEIRDDVRNLKVSCVGRGLMGYLGNKGSISISMSLHQTSFCFICCHLTSGEKEGDELRRNSDVLEILKKTRFPPVRGAGDVKSPETILEHDRIIWLGDLNYRIALSYCSAKALVEMHNWKQLLEKDQLRMQKRYGRVFQGWKEGRIYFPPTYKYSFNSDRYAGEGMHPKEKRRTPAWCDRILWYGNGLNQLSYVRGESRFSDHRQVYSIFLAEVDIVHHRRRNMGYFNSRIEVEELLPHSQSYREIKLY

SEQ ID NO: 17814 - protein, 559 aa, Setaria italica
MRDESNKKKLSWSKSLVRKWFNIKSKAQDFHADHDASQGRDGHGDEWRTSCSEREAGTAKKSRTDRLSKRSVDRIRGVRNDFDPARLTEVQNYRIFASTWNVGGKSPPRGLNLDDWLHSSPPADIYVLGFQEIVPLNAGNVLGTEDNLPAKKWVSLVRRTLNKNPGCCYGGYRTPSPVPDPVVELDADFEGSSRKQDNFSILHRRSFNLSRSLRVEGNHMSSHPRLDRRFSVCDPVSLGGRPSDFDGNFPFMGSPDDHCIEEDSSNGAYFSPFTYGYGASAPTEENYSLQNTSRYCLVASKQMVGIFLTIWVRSEIRNDVRNLKVSCVGRGLMGYLGNKGSISISMSLHHTTFCFICCHLTSGEKEGDELRRNSDVMEILRKTRFPQVRGAGDVKSPETILEHDRVIWLGDLNYRIALSYCSAKALVEMHNWKQLLEKDQLRIERRCGRVFQGWKEGRIYFPPTYKYSFNSDRYSGVRPKEKRRTPAWCDRILWYGNGLMQLSYVRGESRFSDHRPVYSIFMADVEIVRPRRRNMGYFSSRIEVEELLPYSYSSGEKFY

SEQ ID NO: 17815 - protein, 565 aa, Oryza sativa
MREESNKKSKLSWSKSLVRKWFNIKSKANDFHADYDASQGRNGHGGEWRTSCSEREAGTAKKSRTDRMPKKNADCIRRGRTESDVSRLTEVQDYRIFASTWNVGGKSPSKGLDLDEWLHSSPPADIYILGFQEIVPLNAGNVLGTEDNVPAKKWVSLIRRTLNRNPGASSYGGYHTPSPVPDPVVELDADFEGSSRRHDNLSFFHRRSFQNLSQSLRVEGNYMSSQPRLDRRFSVCDPVSLGGRPSDFDGNFPCAGSPDDEYIEEDGSNGTYFSPFPYGYGTSIAMEENDEQPNTSRYCLVASKQMVGIFLTVWVRSELRNDVKNLKVSCVGRGLMGYLGNKGSISISMSLHHTSFCFICCHLTSGEKEGDELRRNSDVMEILRKTRFPRVRGAGDIKSPETILEHDRIIWLGDLNYRISLSYCSAKALVEMHNWKQLLEKDQLRIERRCGRVFQGWKEGRIYFPPTYKYSFNSDRYSGECVHSKEKRRTPAWCDRILWHGNGLIQLSYVRGESRFSDHRPVYSIFMAEVEIIRQRRRNMGCFNSRVEVEELLPYSYSFGDIKFN

SEQ ID NO: 17816 - protein, 563 aa, Brachypodium distachyon
MREESNKKSKLSWSKSLVRKWFNIKNKAQDFHADYDASQGRDGGERRTSCSEREAATAKKSRTDRSLKRNVDRIRRGRNEFDMSRLTETQDYRIFASTWNVGGKSPSRGLDLDDWLHSSPPADIYVLGFQEIVPLNAGNVLGTEDNVPAKKWVSLIRRTLNKNPEPSSHGGYRTPSPVPDPVVELDADFEGSSRRHDSSSFFQRRSFQNLSRSLRVEGNDMFPQPRLDRRFSVCGPVTLGGRPSNFDGNFMCTGSPDDQYIDEDANNGPYFSPFPYGYGASPPAEENNEHPNTPRYCLVASKQMVGVFLTVWVRNEIRNDVRNLKVSCVGRGLMGYLGNKGSISISMSLHHTTFCFVCCHLTSGEKEGDEFRRNSDVMEILRKTRFPRVRGCGDIKSPETILEHDRIIWLGDLNYRISLSYPSAKALVEMHNWKQLLEKDQLRIERRCGRVFQGWKEGKIYFPPTYKYSFNSDRYSGYGVRPKEKRRTPAWCDRILWYGNGIIQLSYVRGESRFSDHRPVYSIFVAEVEILRQRRRNMGYFSSRVEVEELLPYSHSYADIKFY

SEQ ID NO: 17817 - protein, 564 aa, Sorghum bicolor
MREESNKKSKLSWSKSLVRKWFNIKSKAQEFHADCDAAQGRDGHGTEWRTSCSEREAGAAKKSRTDRSSKRSSMDRTRGGKNDVVDVACLTEVQNYRIFASTWNVGGKSPPRGLNLDDWLHSSPPADIYVLGFQEIVPLNAGNVLGTEDNLPAKKWVSLVRRTLNKNPGSCCYGGYRTPSPVPDPVVEQDADFEGSSRRQDSLSYLHRRSFNLSRSLRVERNHMLSHPRLDRRFSVCDPVSLGGRPSDFDGNFPFMGSPDDHCIEEDTSNGAYFSPFPYGYGACAPMEENDYQTNTSRYCLVASKQMVGIFLTIWVRSEIRNDVRNLKVSCVGRGLMGYLGNKGSISISMSLHHTTFCFVCCHLTSGEKEGDELRRNSDVMEILRKTRFPQVRGAADVKSPETILEHDRIIWLGDLNYRIALSYCSAKALVEMHSWKQLLEKDQLRIERRCGRVFQGWKEGRIYFPPTYKYSFNSDRYSGVRPKEKRRTPAWCDRILWYGNGLMQLSYVRGESRFSDHRPVYSIFMAEVESIRHRRRNVGYFSSRIEVEELLPYPYSSGEMKFY

SEQ ID NO: 17818 - protein, 785 aa, Sorghum bicolor
MGCTASKVEQEDTVRRCKERRRHMKDAVAARQLLASAHADYLRSLRVTAAALSRFAQGHPSLAVSHHTAPVLLSAAAPPPAPSAAHALPTPAPSTATSSSLPPPTPLAQHPHPHPPSQPQPQPAAAMAVPQPAPARAPRPRRLRVPHILSDSSVASPAQSSFRKQPPVGTPSSSSAWDWENFYPPSPPDSEFFDRRKAEVEQASRLRELDEEEKARAYLHHHTHYNLKEEDEAAEDDDGEVDHEPEGMHCGGWEDDEHYASTTTSETRSEDEGEMGDRSECGFAARSECGFVARSEYGGTAPSEYAAVPLPLRRDERSEAGDSSSTVTAVTEMRMVVRHRTLAEIVAAIEEYFVKAADSGNDVSELLEASRAQLDRNFRQLKKTVYHSNSVLSALSSTWSSKPPLAVRYKLDTNALEMESTEGKSHGSTLERLLAWEKKLYEEVKARESVKIEHEKKLSTLQSLEYRGRDSAKLDKTKASINKLQSLIVVTSQAATTTSSAIVRVRDNELAPQLVQLCFALLGMWRSMNHFHEIQNEIVQQVRGLVDNSMAESTSDLHRLATRDLEAAVAAWHSNFNRLIKYQRDYIRSLYGWLKLTLCQVDNSVPQEAHASMISRELTSFCDEWKQALDRLPDAVASEAIKSFVNVVHVIYTKQAEEMKIKKRTETLSKELEKKTNSLRSIEKKYYQSYSMVGLGLPGSGRDGIESHAYDARDPLAEKKTEIAQCRRKVEDEMTRHAKAVEVTRSMTLNNIQTGLPGIFQAIAGFSGTVVEALDVVCRRAGSVR

SEQ ID NO: 17819 - protein, 781 aa, Zea mays
MGCTASKVEQEDTVRRCKERRRHMKDAVAARQLLASAHADYLRSLRVTAAALSRFAQGHPSLAVSHHTAPVLLSAAAPPPAPIAVHAFPTPAPSTAASSSLPPPTPLVQRPHPPPQPPTAAAMAAPQPALARAPRPRRLRVPHILSDSSVTSPAQPSFRKQPPVGTPSSSSAWDWENFYPPSPPDSEFFDRRKAEVEQASRLRELEEEEKARAYLHHHTHYNLKEEDEAAEDDDGEVDHEPDGMHSGGWEDDEHYASTTTSETRSDEEGEMGDRSECGFAARSECGFVARSEYGGTAPSEYAAVPLPLRRDERSEAGDFSTVMAATEMRMVVRHRTLAEIVAAIEEYFVKAADSGNDVSELLEASRAQLDRNFRQLKKTVYHSNSVLSAFSSTWTSKPPLAVRYKLDTNALEIESTEGKSHGSTLERLLAWEKKLYEEVKARESVKIEHEKKLSTLQSLEYKGRDSAKLDKTKASINKLQSLIVVTSQAATTTSSAIVRVRDNELAPQLVQLCFALLGMWRSMNHFHEIQNEIVQQVRGLVDSSMAESTSDLHRLATRDLEAAVAAWHSNFDRLIKYQRDYIRSLYGWLKLTLCQVDSCVPQGAHASMISRELTSFCDEWKQALDRLPDAVASEAIKSFVNVVHVIYAKQAEEMKVKKRAEAYSKELEKKTNSLRSVEKKYYQSYSMVGLGLPGSGGHGGIDSHAYDARDPLAEKKTEIAQCRRKVEDEMARHAKAIEVTRSMTLNNIQTGLPGIFQAIAGFSGTVVEALDVVCRRAGSVR

SEQ ID NO: 17820 - protein, 767 aa, Oryza sativa
MGCTASKVEQEDTVRRCKERRRHMKEAVASRQQLASAHADYLRSLRLTAAALSRFAQGHPSLAVSHHTAPVLLTTAAPALAPTPTPPPPSSTASSSLPPPTPLLPKHQQAPPPPPPTQLHQPPPPVAVRAPRGGPRRLKVPHILSDSSVASPARSSFRKPVVGTPSSSSAWDWENFYPPSPPDSEFFDRRKADLEEANRLRELEEEEKARGYLHPHHLKEEDEVDDDDDEREEEMHCGGWEDDDDHYASTTTSETRSEEGEMGNRSECGFAARSEYGGTAPSEYAAAPLPLPLRRRDERSEAGDSSSTVTAAAEMRMVIRHRTLAEIVAAIEEYFVKAAEAGNGVSELLEASRAQLDRNFRQLKKTVYHSNSLLSSLSSTWTSKPPLAVRYKLDTNALEMESMEGKSHGSTLERLLAWEKKLYQEVKARESVKIEHEKKLSTLQSLEYRGRDSTKLDKTKASINKLQSLIIVTSQAATTTSSAIVRVRDNELAPQLVELCFALLSMWRSMNHFHEIQNEIVQQVRGLVDNSMAESTSDLHRLATRDLEAAVSAWHSNFNRLIKYQRDYIRALYGWLKLTLFQVDSNIPQEAYTSLISRELTTFCDEWKQALDRLPDASASEAIKSFVNVVHVIYTKQAEEMKIKKRTETYSKELEKKTNSLRAIEKKYYQSYSMVGLGLPGSGRDGIESHSFDARDPLAEKKTEIAQCRRKVEDEMTRHAKAVEVTRSMTLNNIQTGLPGMFQAIAGFSGTVVEALDVVCRRAGSVR

SEQ ID NO: 17821 - protein, 767 aa, Oryza sativa
MGCTASKVEQEDTVRRCKERRRHMKEAVASRQQLASAHADYLRSLRLTAAALSRFAQGHPSLAVSHHTAPVLLTTAAPALAPTPTPPPPSSTASSSLPPPTPLLPKHQQAPPPPPPTQSHQPPPPVAVRAPRGGPRRLKVPHILSDSSVASPARSSFRKPVVGTPSSSSAWDWENFYPPSPPDSEFFDRRKADLEEANRLRELEEEEKARGYLHPHHLKEEDEVDDDDDEREEEMHCGGWEDDDDHYASTTTSETRSEEGEMGNRSECGFAARSEYGGTAPSEYAAAPLPLPLRRRDERSEAGDSSSTVTAAAEMRMVIRHRTLAEIVAAIEEYFVKAAEAGNGVSELLEASRAQLDRNFRQLKKTVYHSNSLLSSLSSTWTSKPPLAVRYKLDTNALEMESMEGKSHGSTLERLLAWEKKLYQEVKARESVKIEHEKKLSTLQSLEYRGRDSTKLDKTKASINKLQSLIIVTSQAATTTSSAIVRVRDNELAPQLVELCFALLSMWRSMNHFHEIQNEIVQQVRGLVDNSMAESTSDLHRLATRDLEAAVSAWHSNFNRLIKYQRDYIRALYGWLKLTLFQVDSNIPQEAYTSLISRELTTFCDEWKQALDRLPDASASEAIKSFVNVVHVIYTKQAEEMKIKKRTETYSKELEKKTNSLRAIEKKYYQSYSMVGLGLPGSGRDGIESHSFDARDPLAEKKTEIAQCRRKVEDEMTRHAKAVEVTRSMTLNNIQTGLPGMFQAIAGFSGTVVEALDVVCRRAGSVR

SEQ ID NO: 17822 - protein, 769 aa, Hordeum vulgare
MGCAASKVEQEDTVRRCKERRRNIKDAVTARQLLASAHADYLRSLRITAAALSRFAQGHSSLTVSHHTAPVLLTTAAPPALHAPGPTAATSSVASSSLPPPTPLPRHQPPPPPPPVQQQQPQAAAAALRVDMDPRMRRLKVPHILSDSSVASSFRKPPVVGTPSSSSAWDWENFYPPSPPDSEFFDRRKTDLEEANRLRELDDEAKARGYTQRRHDHLKEEDEADDGQGEDEEETEREDMHCGGWEDEEDHYASTTTSETRSEEGEVGNRSECGFAARSEYGGTAPSEYAAVPMQLRRAERSGVGDSFSTVTGATEMRMVVRHRTLSEIVAAIEEYFVKAADAGDGVSELLEASRAQLDRNFRQLKKTVYHSNSVLSALSSTWTSKPPLAVRYKLDTNSLEMGSMEGKSHGSTLERLLAWEKKLYEEVKARESVKIEHEKKLSTLQSLEYRGRDSAKLDKTKASINKLQSLIVVTSQAATTTSSAIVRVRDNELAPQLVELCFALLSMWRSMNYFHETQNEIVQQVRGLVDNSMAESTSDLHRLATRDLEAAVSAWHSNFNRLIKYQREYIRSLYGWLKLTLFQVDSISPQEAHASLISRELTTFCDEWKQALDRLPDAVASEAIKSFVNVIHVIYTKQAEEMKIKKRTETYSKELEKKTNSLRAIEKKYYQSYSMVGLGLPGSGRDGIEGHTFDARDPLSEKKTEIAQCRRKVEDEITRHAKAVEVTRSMTLNNIQTGLPGMFQAIAGFSGTVVEALDVVCRRAGSVR

SEQ ID NO: 17823 - protein, 784 aa, Brachypodium distachyon
MGCAASKVEQEDTVRRCKERRRNIRDAVAARQQLASAHADYLRSLRLTAAALSRFAQGHPSLAVSHHTAPVLLSTAAPPAALAPAPPAPAISSSVAPSSSLPPPTPPLPRHQAHHHPPPPPQPPQQQHAAAVSARERDPRMMRRLKVPHILSDSSVASPAQSSFRKPPVVGTPSSSSAWDWENFYPPSPPDSEFFDRRKTDLEEANRLRELDEEVDKARTRSYLHPGSRDRLKEEDEDEVATDDEEDDEDAHCGGWEDEEDHYASTTTSETRSEEGELGNRSECGFAARSEYGGTAPSEYAAAVPAPLQLRRRDERSEAGDSSSTVTAATEMRMVVRHRTLSEIVAAIEEYFVKAADAGDGVSELLEASRAQLDRNFRQLKKTVYHSNSVLSALSSTWTSKPPLAVRYKLDTNALEMESTEGKSHGSTLERLLAWEKKLYEEVKARESVKIEHEKKLSTLQSLEYRGRDSAKLDKTKASINKLQSLIVVTSQAATTTSTAIVRVRDTELAPQLVELCFALLSMWRSMNHFHEIQSEIVQQVRGLVDNSLAESTSDLHRLATRDLEAAVSAWYSNFNRLIKYQRDYIRSLYGWLKLTLFQVDSVAPQQAHASLISRELTSFCDEWKQALDRLPDAVASEAIKSFVNVVHVIYTKQAEEMKIKKRTETYAKELEKKANSLRAIEKKYYQSYSMVGLGLPGSGRDGIEGHSFDARDPLSEKKTEIAQCRRKVEDEITRHAKAVEVTRSMTLNNIQTGLPGMFQAIAAFSSTVAEALDVVCRRAGSVR

SEQ ID NO: 17824 - protein, 659 aa, Panicum virgatum
MAAPQPAPVRAPRPRRLRVPHILSDSSVASPARSSFRKQPPVGTPSSSSAWEWENFYPPSPPDSEFFDRRKAEVEEANRLRELDEEEKARAYLHHQHPYNLKEEDEVDDDDDGEVDHEPEGMHCGGWEDDDENYASTTTSETRSEEGEMGNRSECGFAARSECGFVARSEYGGTAPSEYAAVPLPLRRDERSEAGDSSSTVTAATEMRMVVRHRTLAEIVAAIEEYFVRAAEAGNDVSELLEASRAQLDRNFRQLKKTVYHSNSVLSALSSTWTSKPPLAVRYKLDTNALEMESTEGKSHGSTLERLLAWEKKLYEEVKARESVKIEHEKKLSTLQSLEYRGRDSAKLDKTKASINKLQSLIIVTSQAATTTSSAIVRVRDNELAPQLVQLCFALLGMWRSMNHFHEIQNEIVQQVRGLVDNSMAESTSDLHRLATRDLEAAVAAWHSNFNRLIKYQRDYIRALYGWLKLTLCQVDNTAPQEAHASMISRELTSFCDEWKQALDRLPDAVASEAIKSFVNVVHVIYTKQAEEMKIKKRAETYSKELEKKTNSLRSIEKKYYQSYSMVGLGLPGSGRDGIESHAYDARDPLAEKKTEIAQCHRKVEDEMTRHAKAVEVTRSMTLNNIQTGLPGIFQAIAGFSATVVEGLDVVCRRAGSVR

SEQ ID NO: 17825 - protein, 659 aa, Panicum virgatum
MAAPQPAPVRAPRPRRLRVPHILSDSSVASPARSSFRKQPPVGTPSSSSAWEWENFYPPSPPDSEFFDRRKAELEEANRLRELDEEEKARAYLHHQHPYNLKEEDEVDDDDDGEVDHEPEGMHCGGWEDDDEHYASTTTSETRSEEGEMGNGSECGFAARSECGFVARSEYGGTAPSEYAAVPLPLRRDERSDAGDSSSTVTAATEMRMVVRHRTLAEIVAAIEEYFVRAADAGDDVSELLEASRAQLDRNFRQLKKTVYHSNSVLSALSSTWTSKPPLAVRYKLDTNALEMESTEGKSHGSTLERLLAWEKKLYEEVKARESVKIEHEKKLSTLQSLEYRGRDSAKLDKTKASINKLQSLIIVTSQAATTTSSAIVRVRDNELAPQLVQLCFALLDMWRSMNHFHEIQNEIVQQVRGLVDNSMAESTSDLHRLATRDLEAAVSAWHSNFNRLIKYQRDYIRALYGWLKLTLCQVDNTAPQEAHASMISRELTSFCDEWKQALDRLPDAVASEAIKSFVNVVHVIYTKQAEEMKIKKRAETYSKELEKKTNSLRSIEKKYYQSYSMVGLGLPGSGRDGIDCHVYDARDPLVEKKTEIAQCRRKVEDEMTRHAKAVEVTRSMTLNNIQTGLPGIFQAIAGFSATVVEALDVVCRRAGSVR

SEQ ID NO: 17826 - protein, 485 aa, Panicum virgatum
MATVAAGSNKRGGGRGRKALVAVLDNEANISAGKAAAQAGDLSASSAQKAKRAPARSGKAAKAAAAVVDDVAELQGMLERLRLEKEKAEEMVRERDEVIRKKEEEIETKEKERERLQAELRKVQRAKEFKPTVSLPLVKSLLDKEQDADDKGKKKKGKAGLERKKPCPAYVLWIKDQWVEIKKENPEADFKEVSNTLGAKWKALGAEEKQPYEERYRQEKEAYLQVVGKEKREAEAMKLLEEQQMQWTANELLEQYLKFRQEAEEGDGKKGKRKNSKKDKDPSKPKQPMSAYFVYSQERRAALVAEKKNVPEIGKITGEEWKNMTEAQKAPYEEVAKKQKEEYHKQMEVYKQKKIEEAASLEKEEEEQKKIMKQEALQLLKKKEKADNIIKKTKEKRQKKKQENADPNRPKKPASSFILFSKEARKQLLEERAGINNSTLNALISVKWKELSSEERQMWNDKAAPAMAAYKKEMEEYTKAHSSSA

SEQ ID NO: 17827 - protein, 484 aa, Panicum virgatum
MATVAAGSKRGGGRGRKALVAVLDNEANISAGDLSASSAQKSKRAPARSGKAGKAAAAAVVDDVAELQGMLERLRLDKEKAEEMVRERDEVIRKKEEEIETKGKEQERLQAELRKVQRAKEFKPTVSLPLVKSLLEKEQDGDDKGKKKKKGKGKGKAGPERKKPCPAYVLWIKDQWVEIKKENPEADFKEVSNTLGAKWKALGAEEKQPYEERYRQEKEAYLQVVGQEKREAEAMKLLEEQQMQWTAKELLEQYLKFRQEAEEGDGGKKGKRKNSKKDKDPSKPKQPMSAYFVYSQERRAALVAEKKNVPEIGKITGEEWKNMTEAQKAPYQEVANKQKEEYHKQMEVYNQKKTEEAASLEKEEEEQKKIMKQEALQLLKKKEKTDNIIKKTKEKRQMKKQENADPNRPKRPASSFILFSKEARKQLLEERPGINNSTLNALISVKWKELSGEERQMWNDKAAPAMAAYKKEMEEYTKAHSSSA

SEQ ID NO: 17828 - protein, 489 aa, Saccharum officinarum
MATAAAAGSKRGGARGRKALVAVLDNEANISAGKAAQTADLSGSSAQKKAKRAPARSAKAKAATAAPAVVDDVAELQGMLQRLRLEKEKAEEMVRERDEVIRKKEEEIETKDKEQGRLQAELRKVQRAKEFKPTVSFPLVKSLLEKDQDADDKGKKKKGKGKAGPERKKPCPAYVLWLKDQWTEVKEENPEADFKEMSSTLGAKWKALGAEEKQPYEERYRQEKEAYLQVVGQEKREAEAMKLLEEQQMQWTAKELLDQYLKFRQEAEEGDCNKGKRKNSKKDKDPSKPKQPMSAYFVYSQERRAALVAEKKNVPEIGKITGEEWKNMTEAQKAPYEKVARKQKEEYRKQMEVYRQKKIEEAANLEKEEEEHKKIMKQEALQLLKKKEKADNIIKKTKEKRQKKKQENADPNRPKRPASSFLLFSKEARKQLLEERPGINNSTLNALISVKWKELNGEERQAWNAKAAPAMAAYKKEMEEYTKAQSSSD

SEQ ID NO: 17829 - protein, 488 aa, Sorghum bicolor
MATAAAAGSKRGGARGRKALVAVLDNEANISAGKAAAQAADLSASSAQKKAKRAPARTKAAVAASAVVDDVAELQGMLERLRLEKEKAEEMVRERDEVIRKKEEEIETKEKEQGRLQAELRKVQRAKEFKPTVSLPLVKSLLEKDQDADDKGKKKKGKGKAGPERKKPCPAYVLWLKDQWTEVKEENPEADFKEVSSTLGTKWKALSAEEKQPYEERYRQEKEAYLQVVGQEKREAEAMKLLEEQQMQWTAKELLDQYLKFRQEAEEEGDSKKGKRKNSKKDKDPSKPKQPMSAYFVYSQERRAALVAEKKNVPEIGKITGEEWKNMTEAQKAPYEKVARKQKEEYQKQMEVYKQKKIEEAASLEKEEEEHKKIMKQEALQMLKKKEKADNIIKKTKENRQKKKQENADPNRPKRPASSFLLFSKEARKQLLEERPGINNSSLNALISVKWKELSGEERQAWNAKAAPAMAAYKKEMEEYTKAQSSSD

SEQ ID NO: 17830 - protein, 472 aa, Echinochloa colona
MATVAAGSKRAGRGRKALVAVLDNEANISAGKAAQAADLSASSAQKGKRAPSKSSKAAAAAAAAAAPSVVDDVAELQGMLERLRLEKEKAEEMVRERDEVIRKKEEEIETKEKEQERLQAELKKVQRAKEFKPTVSFPLVKSLLEKDQDADDKGKKKKGKGKAGPERKKPCPAYVLWMKDQWTEVKKENPEADFKEVSNALGAKWKALGAEEKQPYEERYRQEKEAYLQVVGQEKREAEAMKLLEEQQMQWTAKELLEQYLKFRQEAEEGDAKKGKRKNSKKDKDPAKPKQPMSAYFVYSQERRAALVAEKKNVPEIGKITGEEWKSMTEAQKAPYEEVAKKKKEEYHKQMEVYKQKKMEEAASQEKEEEEQKKIMKQEALQLLKKKEKADNIIKKTKEKRQKKKQENADPNRPKKPASSFILFSKEARKQLQEERPGINNSTLNALISVKWKELSGEERQAWNDKAAPAMA

SEQ ID NO: 17831 - protein, 475 aa, Echinochloa colona
MATVAAGSKRAGRGRKALVAVLDNEANISAGKAAQAADLSASSTRKGKRAPSKSSKAAKAALAAASAPSVVDDVAELQGMLERLRLEKEKAEEMVRERDEVIRKKEEEIETKEKEQERLQAELKKVQRAKEFKPTVSFPLVKSLLEKDQDADDKGKKKKGKGKAGPERKKPCPAYVLWMKDQWTEVKKENPEADFKEVSNALGAKWKALGAEEKQPYEERYRQEKEAYLQVVGQEKREAEAMKLLEEQQMQWTAKELLEQYLKFRQEAEEADGKKGKRKNSKKDKDPAKPKQPMSAYFVYSQERRAALVAEKKNVPEIGKITGEEWKSMTEAQKAPYEEFAKKQKVEYHKQMEVYKQKKMEEAASQEKEEEEQKKIMKQEALQLLKKKEKADNIIKKTKEKRQKKKQENADPNRPKKPASSFILFSKEARKQLQEERPGINNSTLNALISVKWKELSGEERQAWNDKAAPAMAAY

SEQ ID NO: 17832 - protein, 487 aa, Zea mays
MATAAVESKRGSARGRKALVAVLDNEANISAGKAAQAADLSSCSAQKKAKRAPSRSSKAKAAAASAAVVVDDIAELQGMLERLRLEKEKAEEMVRERDEVIRKKEEEIETRDKEQERLQAELRKAQRAKEFKPTVSFPLVKSLLEKEQEADDKGKKKKGKGGHERKKPCPAYVLWLKDQWTEVKKENPEADFKEVSNTLGAKWKALGAEEKQPYEDRYRQEKEAYLQVVGQEKREAEAMKLLEEQQMQWTAKELLDQYLKFRQEAEEGDCKKGRKKKSKKDKDPSKPKQPMSAYFVYSQERRATLVAEKKNVPEIGKITGEEWKNMTEGQRAPYEEVARKQKEEYHKQMEVYKQKKAEEAASLEKEEQEHKKIMKHEALQLLKKKEKADNIIKKTKEKRQKKKQENADPNRPKRPASSFLLFSKEERKQLIEERPGINNSTLNALITVKWKELSGEERQAWNAKAAPAMAAYKKEMEEYTKAQSSSA

SEQ ID NO: 17833 - protein, 863 aa, Sorghum bicolor
MAPNHQLRLATALPLLLVLLLPAASRARDTIAPGQPLRGNDTLVSSGAGSFVLGFFSPLGSNNTYVGIWYAKVPIRTVVWVANRAAPVRGAATDNAGATLSVSSQECALAVADANATVVWSSASSPRPAGSSAASGGGCTARIRDDGNLVVTDQRGRVVWQGFDHPTDTLLPGMRLGVDFAAGTNMTLTAWASPSDPSPSPVVAAMDTSGDPEVFIWNGGTKVWRSGPWDGVQFTGVPDTITYKGMGFSFRFVNDGREATYSFQVRDAGIVSRLALNSTAGGIIGGGGLLQRWTWLESAAAWGLYWYAPKDQCDAVSPCGPNGVCDTNKVPACSCLPGFTPRSPASWAMRDGRDGCVRATPLDCGGNANRSSSTDGFAPLPHAKVPDTTRAVVDYGSSLDQCRQRCLRNCSCTAYASANLTGAAGHRGCVMWTGGLEDLRVYPSFGQDLYFRLAAADLASIGKSKKKVSMAISVVVSITAALAVLLAITGLLIWRAKKTKARKPGSTIWTASSRNKDGSEGKDHGDDLELPVYDFETIAAATEGFSTENKLGEGGFGPVYKGKLEDGQEIAVKTLSRTSTQGLEEFKNEVLLIAKLQHRNLVRLIGCSISGPEKILIYEYMENKSLDFFMFDTTKSKLLDWQTRYRIIEGIARGLLYLHQDSRYRIIHRDLKTSNILLDKDMTPKISDFGMARMFGSDDTEINTLRVVGTYGYMAPEYAMDGVFSVKSDVFSFGVIVLEIIAGKRNRGVYSYSGHLNLLAHAWSLLNGGNGLDLVDENLNGSYNSDEVLKCLKVGLLCVQENPDDRPLMSQVLMMFASTDTASLPTPKQPGFAARRAAAEDTSWSKPDCSIVDSMTITMVEGR

SEQ ID NO: 17834 - protein, 488 aa, Panicum virgatum
MGERRRRGSAAAAAAPGGGVARVAEEEKAAAAAPGKGPPPTVWFALKRSLHCRSEPSEVHVPRAKAAGPAAGAGHLSSIATKRAAPRSGCSRSIANLRDVIHGSKRHPGQPPSCSPRSIGSSEFLNPIAHEVVLSTNSRCELKITGFGGCGGLGAVGTAAQAADGAVVSSFVGTLRPGTPGPAWAGHGLHYCGSMRAGGVRCTPPRSPNVLLERNGSVPAAGHRASCEEAAKADAGKGSGGLSCHRCGEQFGKWEALEAHHLSKHAVTELVEGDSSRKIVEIICRTSLLKSESSCVRIERVFKVHNTQRTLSRFEEYREAVKLKASKLPKKHPRCLADGNELLRFHGATLSCALGSGGGASSGSSSSLCASDKCAVCRIIRHGFSARKEGKAGVGVFTTSTSGRAFESIEAPPPAGDDGEPAAARKALLVCRVIAGRVHKPLENLREFAGQTGFDSLAGKVGPYANIEELYLLNPRALLPCFVVICKP

SEQ ID NO: 17835 - protein, 505 aa, Zea mays
MSERRRRASAASLGGGGGGGVGGVAPARAEEDKVAAPGKAPPPTVWFAFKRSLHCRSEPSEVHVPRAKAGPVAGGGAGAAVGGGHLSSIVTKRAARSGCSRSIANLRDVIHGSKRHPGQPPSCSPRSIGSSEFLNPIAHEVVLSTNSRCELKITGFGGCGGLAAVGVGTGAANDADGGGDGGVVSSFVGTLRPGTPGPAWAGHGLPYSGSVRGSVRCTPPRSPNVMLERNGSVVNGHRASCDETAKNGASKGSGGLSCHKCGEQFSKWEALEAHHLSKHAVTELVEGDSSRKIVEIICRTSLLKSESSCVRIERVFKVHNTQRTLSRFEEYREAVKLKASKLAKKHPRCLADGNELLRFHGATLSCALGGGSGSSSLCASDKCAVCRIIRHGFSARKEGKGGVGVFTTSTSGRAFESIVEAPPAIGVGDDDGAGQLGLGTARRALLVCRVIAGRVHKPLDNLKEFVGQTGFDSLAGKVGPYSNIEELYLLNPRALLPCFVVICRP

SEQ ID NO: 17836 - protein, 485 aa, Oryza sativa
MGERRRRASAVAGGRAEDEKAASAPAAAAPAPTVWFALKRSLHCRSEPSEVHVPRPKAVAAAAAGGGGHLSAIVTKRAAPRSGCSRSIANLRDVIHGSKRHPERPPSCSPRSIGSSEFLNPIAHEVVLSTNSRCELKITGFGGCGGLAAAAAAGGGVLASPHEADGDGAVVSSFVGTLRPGTPGPGWSHGLQYSGSCRGSMRCTPPRSPNVLLDSRDAAAAGVTAHRASCEDAVKSFGKGGGLSCHRCGEQFSKWEALEAHHLSKHAVTELVEGDSSRKIVEIICRTSLLKSESSCVRIERVFKVHNTQRTLARFEEYREAVKLKASKLPKKHPRCLADGNELLRFHGATLSCALGGAAGSSSLCASDKCAVCRIIRHGFSAKKEGKAGVGVFTTSTSGRAYESIEASAGAVVGGDDPAATRKALLVCRVIAGRVHKPLENLKEFAGQTGFDSLAGKVGPYSNIEELYLLNPRALLPCFVVICKA

SEQ ID NO: 17837 - protein, 523 aa, Sorghum bicolor
MGERRRRASAASFGGGGGGGGGGSVVPARAEEGKAAAPGKAPPPTVWFALKRSLHCRSEPSEVHVPRAKAAGPVAAGGAAVGGGGHLSSIVTTKRATRSGCSRSIANLRDVIHGSKRHPGQPPSSCSPRSIGSSEFLNPIAHEVVLSTNSRCELKITGFGAGCGGLAAVGVGGGTGAGAGAGGAHDADSGGVVSSFVGTLRPGTPGPAWAGAGGHGLPYSGSVRGGGGVRCTPPRSPNVLLERNGSVVNGNGHRVSCDETGTKHGAGKGSGGLSCHRCGEQFSKWEALEAHHLSKHAVTELLEGDSSRKIVEIICRTSLLKSESSCVRIERVFKVHNTQRTLSRFEEYREAVKLKASKLPKKHPRCLADGNELLRFHGATLSCALGGAGSGNSSLCASDKCAVCRIIRHGFSAKKEGKAGVGVFTTSTSGRAFESIEAAPGPGAGDDGADQLQLGTTTTRKALLVCRVIAGRVHKPLDNLKEFVGQTGFDSLAGKVGPYSNIEELYLLNPRALLPCFVVICKP

SEQ ID NO: 17838 - protein, 501 aa, Zea mays
MGERRRRASTASLGGGGGAGGSGAVPARNEEDKAAEPPPPTLWFALKRSLHCRSELSEVHVPRANKASGPVVASGGHLSSIVTKRASARSGCSRSIANLRDVIHGSKRHPGQPPSCSPRSIGSSEFLNPIAHEVVLSTNSRCELKITGFGGCGGLAAVGTGAAAAHDACGGGDGGVVSSFVGTLRPGTPGPAWAGAGHGLPCSGSVRGGVRCTPPRSPCVLLERNGSVVSGHRASSCEETAKDGGAGKGSGGLSCHRCGEQFSKWEALEEHHLSRHAVTELVEGDSSRKIVEIICRTSLLKSESSCVRIERVFKVHNTQRTLSRFEEYREAVKLRASKLPKKHPRCLADGNELLRFHGATLSCALGGGGGGGGGSSRLCASDKCAVCRIIRHGFSGRKEGKTGVGVFTTSTSGRAFESIEAAGADGAGAGSVSGTTRRALLVCRVIAGRVHKPLDNLKEFAGQTMGFDSLAGKVGPYSNIEELYLLNPRALLPCFVVICKP

SEQ ID NO: 17839 - protein, 712 aa, Pennisetum glaucum
MGSSPSKATGEDALVLCKDRMRHIRRAIDSRDALSAAHLSYTQSLRTVGTALRRYAESEISPESSLSISEVDKSPSHSSMASPSPSHAVDNVASPMHRASPLTTTPSTRIHCMKASGTTPLTFMIDPSAAEFVGQESPVSAFVPPPPPLPPELCTSWDFFDPIDAAGSSSSNNENGLTLNFNRLKGLRESREAEVAPLKEEEEAVMSERRHTELPDSNALPEQERGISKPRQSMDASSKATSSEQVAAKVEESEMEKELCAETEDPSEFITHRAKDFVASMKDIETRFIRAAEAGNEVSRMLETKKIRLDICPKIPGSPGKLPTARFVSALRVCCNRDIILNQETAQHVSKVVTWKRSVSSLSSSSKSALMTSIIKDDVDDSNSDFVEEFAMVSGSHSSTLDRLHAWERKLYDEIKASENVRKTYDEKCNLLRRQFARGLNAQVIDKTRAVVKDLHSRVSVAIQAVDAISKRIEKIRDEELQPQLVELIQGLIRMWKSMLECHHKQFITITLAYHVKSSTSAQQGEHHRQAAMNLWNEMDSFCSSFRNWVTAHQSYVEALNAWLQKCVLQPPQDRRRRKRKVSFPPRQAVSPPIFVLCRDWLTLTESLPAEEVCKSIKDVMQLLRDSFDHQDDQNKPKSESQECGMLENNEQEEARSGSVPAAEGLQSRLTMVLDRLTKFSEASLKCYEELKQNYEIAHDDYKRVGPIAQLA

SEQ ID NO: 17840 - protein, 719 aa, Panicum virgatum
MGSSPSKATGEDALVLCKDRMRHIRRAIDSRDALSAAHLSYTQSLSTVGTALRRYAESEISPESSLSISEVDKSPSHSSMASPSPSRAVENVASPMHRASPFSTPPATRIHCMKAAGTTPLTFMIDPSAAEFVGQESPVSAFVPPPPPLPPELCTSWDFFDPIDTAGSSSSNNENGLTLNFSRLKGLRESKVAEVVPLKEEGEEEELVMSERRHTEFPGVNSPSKQEREPEQSVISKPSELVDVSSKAKSSEQVAAKVEESEMAKELCAETEDPSEFITHRAKDFVSSMKDIETRFIRAAEAGNEVSRMLETKKIRLDICPKMPGSPGKLPTARFVSALRVCCNRDIILNQETAHVSKVVTWKRSVSSLSSSSKSALMTSIIKDDVDDSNSDFVEEFAMVSGSHSSTLDRLHAWERKLYDEIKASENVRKAYDEKCNLLRRQFARGLNAQLIDKTRAVVKDLHSRVSVAIQAVDAISKRIEKIRDEELQPQLIELIQGLIRMWKSMLECHHKQFITITLAYHVKSSTPVQQGEHDRQAALNLLYEMDIFSSSFRNWVTAHQSYVEALNAWLQKCVLQPPQDRRRRKRKVSFPPRQAVSPPIFILCRDWLTLTESLPADELCKSIKDVMQLLRDSFEHQDDQNKPKSESQECGMLENNEQEEAKSGSVPAAEGLQSRLTMVLDRLTKFSEVSLKCYEELKQNYEIARDDYKRVGPYAQLA

SEQ ID NO: 17841 - protein, 719 aa, Sorghum bicolor
MGSSPSKATGEDALVLCKDRMRHIRQTIDSRDALSAAHLSYTQSLRTVGTALRRYAESEISPESSLSISEVDKSPSHSSMASPSPSRAVENLASPAHRASPLTTQPSTRIHCMKAAATAPLTFVIDPSAAEFVGHESPVSAFVPPPPPLPPELCTSWDFFDPIDAASSSSSNNENGVTLNFSRLKGLRESRVAEVVPLKEGEEEIMSERKHTELPDDNAPSKQEREPKQGGTRKPSQLVDTSTKATSEQVAAKLEESEMEKELCAEAEDPSEFITHRAKDFVSSMKDIEARFMRAAEAGNEVSRMLETKKIRLDICAKMPGSPGKLPTARFVSALRVCCNRDVILNQETAQHVSKVVTWKRSVSSLSSSSKSALMTSIIKDDVDDSNSDFVEEFAMVSGSHSSTLDRLHAWERKLYDEIKASENVRNAYDEKCNLLRRQFARGLNAQLIDKTRAVVKDLHSRVSVAIQAVDAISKRIEKIRDEELQPQLVELIQGLIRMWKLMLECHHKQFITITLAYHVKNSTPVHQGEHRRQAAMHLCNEMDSFSSSFRNWVTAHKSYVEALNAWLQKCLLQPPQDRRRRKRKVSFPPRQAVSPPIFVLCRDWLAMTESLPADEVCKSLKDVMQLLRDSFEHQDEQNKPRSESQECGMLENNSEPEAAKSGSGSVASAEGLQSRLTAVLDRLTKFSEASLKCYEELKQNYEMACDDYKRVGPNAPHA

SEQ ID NO: 17842 - protein, 722 aa, Oryza sativa
MGSSPSKATGEDALVLCKERMRHIRRAIDSRDALSASHLSYTQSLRSVGTALRRYAESEISPESSLSISEADKSPSHSSMASPSPSRAVESTGSPVHRGSQLTPPSTKIHYMKAAGTKPLTFTIDPSAADFVGQESPVSTFVPPPPPLPPELCTSWDFFDSNYTSGSATSNNENGVTLNFSRLKGLRDSRESEAVSLREETTNRSDRMHPELPGDNAAPKQEAQAKKGGMSKPSGSVEVTTEATTSGQVGAKVEEDDMEKELCTEAEDPSEFITHRAKDFVSSMKDIETRFVRAAEAGNEVSRMLETKKIRLDICAKIPGSPGKPPTARFVSALRVCCNRENILNQETAQNISKVVTWKRSVSSLSSSSKSPLTAAMITDDVGDSNSDFVEQFAMVSGSHSSTLDRLHAWERKLHDEIKASEHVRKTYDEKCNLLRRQFARGLNAQLIDKTRAVVKDLHSRVSVAIQAVDAISKRIEKIRDEELQPQLVELIQGLIRMWKAMLECHHKQFITISLAYHVKSSTMVQQGEHHRRAAAHLWNELDCFSSSFRIWVTAHKSYVESLNAWLQKCVLQPAQDRRRRKRKVSFPPRHALSPPIFVLCRDWLAMMESQSLPTDELCKSIKEVMQLLRGSFDHPADHQDKTTTESQSRNESQECGMLENNEQEVSGSVEAVEGLQSKLTTVLDRLTKFSEASLKHYEELKQNYEIARDDYQTGRSNAHLV

SEQ ID NO: 17843 - protein, 222 aa, Zea mays
MAGIFGAIHSPAAACLFSPRRPPSLRPLSPLPSIFSLISRRLHPTSLSTLVMAASNGAAAVDETVAATDSVQEPPQKISKISPLLKVKKLSEKAVLPSRGSALAAGYDLSSAEEMVVPARGKALVPTDLSVAIPHGTYARIAPRSGLALKHSIDVGAGVIDADYRGPVGVILFNHSDADFAVKPGDRIAQMIIEVIATPEVAEVEDLDATVRGDGGFGSTGV

SEQ ID NO: 17844 - protein, 225 aa, Oryza sativa
MAGKLGAICSRLISPLFNHHCRLRRFPQIHSPPPPFVPFSRHHRLPPRALSAVAMATATNGNASAAAAAADSAVQEPPHKIAKVAPLLKVKKLSENAVLPSRGSALAAGYDLSSAAEVVVPARGKAMVPTDLSIAIPEGTYARVAPRSGLALKHSIDVGAGVIDADYRGPVGVILFNHSDTDFAVKPGDRIAQMIIEVIVTPEVAEVEDLDATVRGEGGFGSTGV

SEQ ID NO: 17845 - protein, 216 aa, Sorghum bicolor
MHESRTARRPALADISGGGFFIRRVESPGAVLVKGAVKPLARRALSQSSNKENVPPVGAVRGAPKRKSPLPDWYPRTPLRDITSIVKAIERRSRLQNAATEQTILWTEDSSQSVDPITPASAEQGVPTIEGGQAVARHATSLGDGKLKTSSSPFDCSLQATPSKPNDPALADLMEKKLSNSIEQIEKMVRRNLKKTPKAAQPSKRTIQSRILMSMR

SEQ ID NO: 17846 - protein, 619 aa, Brachypodium distachyon
MATRPGPLTEWPWQRLGNFKYLVMAPVVVHGAHRVMTKGWGDIDLAYALILPSLLLRMIHNQIWISLSRYQTARSKHRIVDRGIEFDQVDRERGWDDQIIFNGLLFYAGYLAMPSVRGFPLWRTDGAVMTALLHAGPVEFLYYWFHRALHHHFLYSRYHSHHHASIVTEPITSVIHPFGEHVVYFTLFAIPMLSTIYMGNGSALVFVLYIVYIDFMNNMGHCNFELVPKWAFQVFPPLKYLMYTPSFHSLHHTQFRTNYSLFMPFYDYIYSTMDKSSDELYENSLKGTEETPDLVHLTHMTNLQSAYHLRIGFASIASKPSENSEWYMWTLWPLAWLSMVVAWMYGSSAFVVERIKLKKLKMQTWVIPRYNFQYALTWERESINDLIEKAILDADVRGVKVLSLGLLNQTKELNGAGELFRQKYPKLGVQLVDGSGLATAVVLKSIPLDAKQVFLQTGTSKIARAIAITLCGRGIQVIMNRKKEYDILKPQIPENRASYLKCSSDDMPKIWLVDCIDAKEQLVAPKGTVFIPISQFPTKKVRKDCTYLSTPAMKIPEAMQNIHSCENWLPRRVMSAWHIAGILHVLEGWSMHECGDSMMDIEKTWSAATRHGFVPLTKA

SEQ ID NO: 17847 - protein, 619 aa, Secale cereale
MATRPGPLTEWPWQRMGNFKYLVMAPVVVHGAYRVMKKGWGDIDVAYALILPSLLLRMIHNQIWISLSRYQTARSKHRIVDRGIEFDQVDRERGWDDQIVFNGLLFYVGYLAMPSVRRFPLWRTDGAVATALLHAGPVEFLYYWFHRALHHHFLYSRYHSHHHASIVTEPITSVIHPFGEHIVYFTLFAIPMLSTVYMGNGSALVFVLYIVYIDFMNNMGHCNFELVPKWMFQVFPPLKYLMYTPSFHSLHHTQFRTNYSLFMPFYDYIYSTMDKASDELYESSLKGTEEIPDLVHLTHMTNLQSAYHLRVGFASIASKPSDNSEWYMWTLWPLAWLSMVVAWIYGSSAFVVERIKLKKMRMQTWVVPRYNFQYGLTWDRESINDLIEKAILDADVRGVKVLSLGLLNQATQLNGNGELFRQKYPKLGLRIVDGSGLATGVVLKSIPSDAKQVFLHTGTSKIARAVAMALCGRGIQVIMNRKKEYDMLKSQMPENRASYLKCSSNDITKIWLVERIDDKEQRMAPKGTVFIPISQFPLKKVRKDCTYLSTPAMKIPDTMQNIHSCENWLPRRVMSAWHIAGILHVLEGWSAHECGDDMMDSEKAWSAAIRHGFVPLTNA

SEQ ID NO: 17848 - protein, 619 aa, Triticum aestivum
MATRPGPLTEWPWQRMGNFKYLVMAPVVVHGAYRVMNKGWGDIDLAYSLILPSLALRMIHNQIWISLSRYQTARSKHRIVDRGIEFDQVDRERGWDDQIVFNGLLFYVGYLAMPSVRRFPLWRTDGAVATALLHAGPVEFLYYWFHRALHHHFLYSRYHSHHHASIVTEPITSVIHPFGEHIVYFTLFAIPMLSTVYMGNGSALVFVLYIVYIDFMNNMGHCNFELVPKWMFQVFPPLKYLMYTPSFHSLHHTQFRTNYSLFMPFYDYIYSTMDKASDELYENSLKGTEETPDLVHLTHMTNLQSAYHLRVGFASIASKPSDNSEWYMWTLWPLAWLSMVVAWIYGSSAFVVERIKLKKMKMQTWVVPRYNFQYGLTWDRESINDLIEKAILDADVRGVKVLSLGLLNQAKQLNGNGELFRQKYPKLGVRIVDGSGLAIGVVLKSIPSDAKQVFLHTGTCKIARAVAMALCGKGIQVIMNRKKEYDMLKSQMPENRASYLKCSSNDITKIWLVERIDDKEQRMAPKGTVFVPISQFPLKKVRKDCTYLSTPAMKIPDTMQNIHSCENWLPRRVMSAWHIAGILHVLEGWSEHECGDHMMDSEKAWSAAIRHGFIPLTKA

SEQ ID NO: 17849 - protein, 619 aa, Triticum aestivum
MATRPGPLTEWPWQRTGNFKYLVMAPVVVHGAYRVMTKGWGDIDLAYSLILPSLALRMIHNQIWISLSRYQTARSKHRIVDRGIEFEQVDRERGWDDQIVFNGLLFYAGYLAMPSVRRFPLWRTDGAVATALLHAGPVEFLYYWFHRALHHHFLYSRYHSHHHASIVTEPITSVIHPFGEHIVYFTLFAIPMLSTVYMGNGSALVFVLYIVYIDFMNNMGHCNFELVPKWMFQVFPPLKYLMYTPSFHSLHHTQFRTNYSLFMPFYDYIYSTMDKASDELYENSLKGTEETPDLVHLTHMTNLQSAYHLRVGFASIASKPSDNSEWYMWTLWPLAWLSMVVAWIYGSSAFVVERIKLKKMKMQTWVVPRYNFQYGVTWDRESINDLIEKAILDADVRGVKVLSLGLLNQAKQLNGNGELFRQKYPKLGVRIVDGSGLATGVVLKSIPSDAKQVFLHTGTSKVARAIAMALCGRGIQVIMNRKKEYDMLKSQMPEDGASYLKCSSNDITKIWLVERIDDKEQRMAPKGTVFIPISQFPLKKVRKDCTYLSTPAMKIPDTMQNIHSCENWLPRRVMSAWHIAGILHVLEGWSVHECGDDMMDSEKAWSVAIRHGFVPLTKA

SEQ ID NO: 17850 - protein, 619 aa, Triticum aestivum
MATRPGPLTEWPWQRMGNFKYLVMAPVVVHGAYRVMNKGWGDIDLAYSLILPSLALRMIHNQIWISLSRYQTARSKHRIVDRGIEFDQVDRERGWDDQIVFNGLLFYVGYLAMPSVRRFPLWRTDGAVATALLHAGPVEFLYYWFHRALHHHFLYSRYHSHHHASIVTEPITSVIHPFGEHIVYFTLFAIPMLSTVYMGNGSALVFVLYIVYIDFMNNMGHCNFELVPKWMFQVFPPLKYLMYTPSFHSLHHTQFRTNYSLFMPFYDYIYSTMDKASDELYENSLKGTEETPDLVHLTHMTNLQSAYHLRVGFASIASKPSDNSEWYMWTLWPLAWLSMVVAWIYGSSAFVVERIKLKKMKMQTWVVPRYNFQYGVTWDRESINDLIEKAILDADVRGVKVLSLGLLNQAKQLNGNGELFRQKYPKLGVRIVDGSGLAIGVVLKSIPSDAKQVFLHTGTCKIARAVAMALCGKGIQVIMNRKKEYDMLKSQMPENRASYLKCSSNDITKIWLVERIDDKEQRMAPKGTVFVPISQFPLKKVRKDCTYLSTPAMKIPDTMQNIHSCENWLPRRVMSAWHIAGILHVLEGWSEHECGDHMMDSEKAWSAAIRHGFIPLTKA

SEQ ID NO: 17851 - protein, 619 aa, Hordeum vulgare
MATRPGPLTEWPWQRMGNFKYLVMAPVVVHGAYRVMNKGWGDIDLAYALILPSLALRMIHNQIWISLSRYQTARSKHRIVDRGIEFDQVDRERGWDDQIVFNGLLFYVGYLAIPNVRGLPLWRTDGAVATALLHAGPVEFLYYWFHRALHHHFLYSRYHSHHHASIVTEPITSVIHPFGEHIVYFTLFAIPMLSTLYMGNGSALVFVMYIVYIDFMNNMGHCNFELVPKWMFQVFPPLKYLMYTPSFHSLHHTQFRTNYSLFMPFYDYIYSTMDKASDELYENSLKGTEETPDLVHLTHMTNLQSAYHLRVGFASIASKPSDNSEWYMWTLWPLAWLSMVVAWIYGSSAFVVERIKLKKLKMQTWVVPRYNFQYGLTWDRESINDLIEKAILDADVRGVKVLSLGLLNQEKQLNGNGELFRQKYPKLGLRIVDGSGLATGVVLKSIPSDAKQVFLHTGTSKVARAVAMALCGKGIQVIMNRKKEYDMLKSQMPENRASYLKCSSNDITKIWLVERMDDKEQRMAPKGTVFIPISQFPLKKVRKDCTYLSTPAMKIPDTMQNIHSCENWLPRRVMSAWHIAGILHVLEGWSVHECGDDMMDSEKAWSAAIRHGFVPLTKA

SEQ ID NO: 17852 - protein, 619 aa, Hordeum vulgare
MATRPGPLTEWPWQRMGNFKYLVMAPVVVHGAYRVMNKGWGDIDLAYALILPSLALRMIHNQIWISLSRYQTARSKHRIVDRGIEFDQVDRERGWDDQIVFNGLLFYVGYLAIPNVRGLPLWRTDGAVATALLHAGPVEFLYYWFHRALHHHFLYSRYHSHHHASIVTEPITSVIHPFGEHIVYFTLFAIPMLSTLYMGNGSALVFVMYIVYIDFMNNMGHCNFELVPKWMFQVFPPLKYLMYTPSFHSLHHTQFRTNYSLFMPFYDYIYSTMDKASDELYENSLKGTEETPDLVHLTHMTNLQSAYHLRVGFASIASKPSDNSEWYMWTLWPLAWLSMVVAWIYGSSAFVVERIKLKKLKMQTWVVPRYNFQYGLTWDRESINDLIEKAILDADVRGVKVLSLGLLNQEKQLNGNGELFRQKYPKLGLRIVDGSGLATGVVLKSIPSDAKQVFLHTGTSKVARAVAMALCGKGIQVIMNRKKEYDMLKSQMPENRASYLKCSSNDITKIWLVERMEDKEQRMAPKGTVFIPISQFPLKKVRKDCTYLSTPAMKIPDTMQNIHSCENWLPRRVMSAWHIAGILHVLEGWSVHECGDDMMDSEKAWSAAIRHGFVPLTKA

SEQ ID NO: 17853 - protein, 620 aa, Setaria italica
MATRPGPLTEWPWQRLGNFKYVVMAPVVVHGSRRVAGAGGWGELDLAFALILPSLLLRMVHNQIWISAARYQTARSKHRIVDRGIDFDQVDRERGWDDQIILNGLLFYVAYLLIPSARHMPAWRTDGAVAMALLHAGPVEFLYYWFHRALHHHFLYSRYHSHHHSSIVTEPITSVIHPFAEHIVYYILFAIPMLTTIYMGNGSVLGIVLYIAYIDFMNNMGHCNFELVPKWMFQVFPPLKYLMYTPSFHSLHHTQFRTNYSLFMPFYDYIYNTMDKSSDQLYESSLKGTEETPDLVHLTHMTNLQSAYHLRIGFASIASKPSDSSMWYMWTLWPLAWLSMVLAWVYGSSAFVVERIKLNKLKMQTWAVPRYNFQYGLNWERESINDLIEKAILDADARGVKVLSLGLLNQAKQLNGGGELFRQKYPKLRVRLVDGSGLATAVVLKSIPHDAKQVFLHAGPSKIAYATAFALCEKGVKVIMNPNNKYDMLKSQIADSRASYLKHSSNHMPQIWLVDNIDDKEQKMAPEGAIFIPISQFPIKKIRKNCTYLSTPAMKIPETMQNVHACENWLPRKVMSAWRIAGILHALEGWTKHECGDAMMDAEKAWSAAIRHGFVPLNKA

SEQ ID NO: 17854 - protein, 619 aa, Sorghum bicolor
MATRPGPLTEWPWQRLGNFKYLVMGPVVVDGARRVVARGWGDIDLAFALILPSLLLRMAHNQIWISAARYQTARSKHRIVDRGIEFEQVDRERGWDDQIILNGLLFYAGYLAIPSARHLPAWRTDGAAVMALLHAGPVEFLYYWFHRALHHHFLYSRYHSHHHSSIVTEPITSVIHPFAEHMVYYVLFAIPMLSTVYIGNASVLGIVVYIAYIDFMNNMGHCNFELVPKWMFQVFPPLKYLMYTPSFHSLHHTQFRTNYSLFMPFYDYIYNTMDKSSDQLYESSLRGTEETPDLVHLTHMTDLQSAYHLRIGFASIASRPSDSSMWYMWVLWPVAWLSMVLAWVYGSSTFVVERIKLGKLKMQTWAVPRYNFQYGLSWERESINDLIEKAILDADARGVKVLSLGLLNQAKQLNGGGELFRQKYPKLTVRLVDGSGLATAVVLKSIPHDAKQVFLHAGPSKIACATAFALCERGVQVIMNPKKEYDMLKSQIADSKASYLKHSSNHTPQIWLVDNIDDKEQKMAPQGAIFVPISQFPIKKIRKDCTYLSTPAMKIPETMQNIHACENWLPRRVMSAWRIGGILHALEGWTMHECGDAMMHTEKAWSAAIRHGFIPLTKA

SEQ ID NO: 17855 - protein, 619 aa, Panicum virgatum
MATRPGPLTEWPWQRLGNFKYVVMAPVVVHGARRVAGGGWGDIDLAFALILPSLLLRMVHNQIWISAARYQTARSKHRIVDRGIEFDQVDRERGWDDQIILNGLFFYVGYLLIPSARHLPAWRADGAAAMALLHAGPVEFLYYWFHRALHHHFLYSRYHSHHHSSIVTEPITSVIHPFAEHMVYYFLFAIPMLTTVYMGNASVLGFVLYIAYIDFMNNMGHCNFELVPKWVFQLFPPLKYLMYTPSFHSLHHTQFRTNYSLFMPFYDYIYNTMDKSSDQLYQSSLRGTEETPDLVHLTHMTDLQSAYHLRIGFASIASKPSNRSMWYMWTLWPLAWLSMVFAWVYGSSAFVVERIKLKKLTMQTWAIPRYNFQYGLNWERESINDLIEKAILDADARGVKVLSLGLLNQAKQLNGGGELFRQKYPKLRVRLVDGSGLATAVVLKSIPHDAKQVFLQAGPSKIACATASALCEKGVKVIMNPKKEYDMLKSQIADSRASYLKNSSNHMPQIWLVDSIDDKEQKMAPQGTIFIPISQFPIKKIRKDCTYLSTPAMKIPETMQNIHACENWLPRKVMSAWRIAGILHALEGWTMHECGDAMMDAEKAWSAAISHGFVPLTKA

SEQ ID NO: 17856 - protein, 619 aa, Saccharum officinarum
MATRPGPLTEWPWQRLGNFKYLVMGPVVVHGARRVLARGWGDIDLAFALILPSLLLRMVHNQIWISAARYQTARSKHRIVDRGIEFEQVDRERGWDDQIILNGLLFYVGYLTIPSARHLPAWRTDGAAVMALLHAGPVEFLYYWFHRALHHHFLYSRYHSHHHSSIVTEPITSVIHPFAEHMAYYFLFAIPMLSTIYIGNASVLGIVVYIAYIDFMNNMGHCNFELVPKWMFQVFPPLKYLMYTPSFHSLHHTQFRTNYSLFMPFYDYIYNTMDKSSDQLYENSLKGTEETPDLVYLTHMTDLQSAYHLRIGFASIASRPSDSSMWYMWVLWPVAWLSMVLAWVYGSSTFVVERIKLRKLKMQTWAVPRYNFQYGLSWERESINDLIEKAILDADARGVKVLSLGLLNQAKQLNGGGELFRQKYPKLGVRLVDGSGLTTAVVLKSIPHDTKQVFLHAGPSKIACAMAFALCERGVQVIMNPKKEYDMLKSQIADSKASYLKHSSNHTPQIWLVDSIDDKEQKMAPQGAIFVPISQFPIKKIRKDCAYLSTPAMKIPETMQNIHACENWLPRRVMSAWRIGGILHALEGWTMHECGDAMMHTEKAWSAAIRHGFIPLTKA

SEQ ID NO: 17857 - protein, 349 aa, Zea mays
MMPVAAVDDWSERGFSLTCEEDCADLGNGVVDDDEFLPLYNAGEEEEEEYLEQLVFKETSLCSSSDSAADCDGDGEGDEEYPSLASEEWFRQARLAAVKWILETRGCFGFGHRTAYLAIAYFDSFLLRRRVDREAMPWAAQLLSVACVSVAAKMEECQVPALSEFHAGGYDFDSASIRRMELLVLSTLGWRMGAVTPLDFLPCFSSRVHPHGGAGAGGHVAHKAIGFIFATAEAGSVLDHRPSTVAAAAILAATYGPLLTKEALDSKMSYLSPSCLIEKEHVHACYSMMVGDNNRRGSKRSLPCSVSNEIATSTYHSVLVDDVTDTAAAFATAVSARNKRIRLELTGIS

SEQ ID NO: 17858 - protein, 345 aa, Zea mays
MMPVEEAAADDWSECAFSLTCEEDCADLGDGELFPLYSAGDEEEDEYLEQLVFKETSFCSSSDSAADCDGDEEGDEEYSSLTSEEWFRQARLAAVKWILETRGCFGFGHRTAYLAISYFDSFLLRRRIDRETMPWAAQLLSVACVSVAAKMEECQAPALSEFHAGGFDFDSASIRRMELLVLSTLGWRMGAVTPLDFLPCFSSRVHPHGGAGAGAGGRVAIGFIFATAEAGSVLDHRPSTVAAAAILAATYGPLLTKEALSSKMSCLSPSYLIEKEHVHACYSMMVGDMSRRGSKRSLPCSGPDEIATSTYHSVLVDDATDTAAFASAVAAARSKQIRLELTGIH

SEQ ID NO: 17859 - protein, 350 aa, Setaria italica
MMPVEAAAAEDWSACAFSLTCEEDGADLGDGSVDDGVLFSPYNAGDEEEEEEYLEQLVFKEASFCCSSSDSAADCDGDGDVDGECQSVVSEEWFRQARLAAVKWILETRGYFGFGHRTAYLAIAYFDSFLLRRRVDREAMPWAARLLSVACVSVAAKMEECQAPALSEFDAGGYDFCPASIRRMELLVLSTLGWRMGAVTPLDFLPCFSSRLHPHGGAGAGAALKAIGFIFATAQAGSVLDHRPSTVAAAAILAATYGPLLTKEALDSKMRYLSPSRLIEKEHVHACYSVMVGGMNRRGNKRSLPCSGSDEVATSTYDSVLVDDVTDTAAFATVVAARNKRIRLELPGIR

SEQ ID NO: 17860 - protein, 349 aa, Panicum virgatum
MMPVEAAAEDWPACAFSLTCEEDGADLGDGSVDDGELFSPYNARDEEEEEYLEQLVFKEASFCCSSDSAPDCDGDGDVDGDHQLVFSEEWFRQARLAAVKWILETRGFFGFGHRTAYLAIAYFDSFLLRRRVDREAMPWAARLLSVACVSVAAKMEECRVPALSEFDAGDYDFCSASIRRMELLVLSTLGWRMGAVTPFDFLPCFSSRLHPHGGAGAGGRVALKAIGFIFATAEAGSVLDHRPSTVAAAAILAATYGPLLTKEALDSKMSYLPPSCLIEKEHVHACYSMMVGDMNRRGNKRSLPCSGSNEVASSTYDSVLVDDVTDTAAFATAVAARNKRIRLELPGIS

SEQ ID NO: 17861 - protein, 664 aa, Zea mays
MAGGGLQGAKKRKREHAEGKAKPRKQVKGGGDGAKRKSHSAAGGYTAHGGAGEVVARKKTPVTPKEKRLAAKEMSEARKMKRRQHYSLEKELTKLWEKMRCHDVSKEERSKAVSQAIHKMDGKYLDIATSHVTARVLQTCVKWCSESERDAIFDVLQPHLLTLSCKKYAVFLVKKLIELASKKQFASFISSLHGRVANLLHHTIGAAVVDYAFQRGTQRQKRQLLVELYSPELQLFKDLTVQSSSCLIDTISKLGLQISSVLLHMTIVIDKILEKGTVEYLIVHTAILEYFTIADKTSASDAICQLIPLLTQGALIIDGDEPTNAPELPKKAKAKKKRSKEPLIVRIMQTREGLKLGISCVKYGSAKDRKKIIKSLKGHIMKLALSDFGCLFLICIISIVDDTKLVSKIVIQELVKHLKQLIFDKNGRRPLLQLLHPFCSRYLSPNDLACLNYNVPSLSSTEVETSESAIGVITENKLDDVIAQDPNGLEGKQIVFESKKDPLQRRHELLIKSELAEALVQSCIENVGELLRTNFGKEVLYEMAVGGKDNVLDGLTDRIHMLHDAIASDAAQPKTEDMEHAFENFFSSRVIRRMVIDCPAFAVTLWRKALQGKCKIWAEGHSSKVVASFLESPSTEVKDLAKPELQPLVDAGILKVPDPKVVQK

SEQ ID NO: 17862 - protein, 666 aa, Setaria italica
MAGAGSDLQSPKKRKREHAEGKIKPRPQVKGGGDGAKRKKHPGAGGYAAHGGAGEAPAKKRPVTPKEKRLAAKEMSEARKMKRKRHYSLEKELAKLWEKMRCHDVSKEERSKLVSQAIRKMDGKYLDIAGSHVTARVLQTCVKWCSQSERDAIFDDLQPHLLTLSRKKYAVFLVKKLIELATKKQFASFISSLHGHVAKLLPHTIGAAVVDYAFQRATPPQKRQLLLELYSTELQLFKDLTVQSSFSLLETISKLGLQKSSVLQYMTIEIQKILEKGTVEYSIVHTAILEYFTIADKTSAMDVIHQLIPLLTQGASIIDGDEPSIATELPNKTKAKKKRLSEPLIVRIMQTREGLKLAISCLKHGSAKDRKKIIKSLKGQIMKLALNDFGCLFLISIISIVDDTKLVSKIVIQELAKHLKELIFDKNGRRPLLQLLHPLCSRYLSPADLACLSYNVPSLSAKEGEASEGATEVISENKVDAMTDKEPDDLEGMQIVSESKKDPSRRRHELLIKSDLAEALVQSCIENVGELLRSNFGKELLYEVAVGGKDNVLEGVTDRIHMLHDAIASDAAQPKTEDIEHAFENFFSSRVIRRMIIDCPAFAVTLWRKALKGKCKIWAEGHSSKVVAAFLESPSSEVRNLAKPELQPLIDTGILKVPDHKGAVEK

SEQ ID NO: 17863 - protein, 661 aa, Echinochloa colona
GGGSDLKKRKREHAEGKGKPRPQVKGSGDGEKRKKHSAAGGYAAHGGAGEAAPKKKLPVTHKEKRLAAKEMSEARKMKRKRHYSLEKELTKLWEKIRCHDVSKEDRSKLVSEAIRKMDGKYLDIAGSHVTARVLQTCVKWCSQSERDAIFDELQPHLLTLSRKKYAVFLVKKLIELATKKQFASFISSLHGHVAKLLPHTIGAAVVDYAFQRATPPQKRQLLLELYSTELQLFKDLTVQSSFSLLETISKLGLQKSSVLQYMTIEIQKILEKGTVEYSIVHTAMLEYFTIADKTSASDVIRQLIPLLTQGASIIDGDEPSISPELPKKTKAKKKRSKEPLIARIMQTREGLKLAISCLKYGSAKDRKKIIKSLKGHIMKLALNDFGCLFLICIISIVDDTKLVSKIVIQELAKHLKELIFDKNGRRPLLQLLHPLCSRYLSPTDLACLSYSVPSLSSREGDAAESATEAISENKVDAVTDKEPDGSEGMKIVSESKKDPSQRRHELLIKSELAEALVQSCVENVGELLRTNFGKELLYEVAVGGKDNVLEGVTDRIHLLHNAIASDAAEPKIEDIEHAFENFFSSRVIRRMIIDCPAFAVTLWKKALEGKCKIWAEGHSSKVVAAFLESPSAKVRDLAKSELQPLIDSGILKVPDHKAVEK

SEQ ID NO: 17864 - protein, 658 aa, Panicum virgatum
MAAGGSDLQSPKKRKREQVEGKTKPRPQVKGGGDGVKRKKHSGAGGYAAHGGGAGEAAAKKKRPATPKEKRLAAKEISEARKMKRKRHYSLEKELTKLWEKMRCHDVSKEERSKLVSEAIRKMDGKYLDIVGSHVTARVLQTCVKWCSQSERDAIFDNLQPHLLSLSRKKYAVFLVKKLIELATKKQFASFISSLHGQVAKLLPHTIGAAVVDYAFQRATQPQKRQLLLELYSTELQLFKDLTVQSSCSLLETISKLGLQKSSVLQYMTIEIQKILEKGTVEYSIVHTAILEYFTIADKTSALDVIRQLIPLLTQGASIIDGDEPSLATELPKKTKAKMKRLSEPLIVQIMHTKEGLKLAISCLKYGSAKDRKKIIKSLKGHIMKLALNDFGCLFLISIISIVDDTKLVSKIVIQELAKNLKQLILDKNGRRPLLQLLHPLCSRYLSPADLACLSYNVPSLSSREGEASDSATEVISENKVDAVTDKIVSESKKDPSQRRHELLIKSELAEALVQSCIENVGELLRTNFSKELLYQVAVGGKDNVLEGVTDMVHKLHDAIASDAAQPKTEDIEHAFENFFSSRVIRRMIIDCPAFAVTLWSKALKGKCKTWAEGHSSKVVAAFLESPSSEVKDLAKDELQSLIDTGILKVPDHKAMEK

SEQ ID NO: 17865 - protein, 690 aa, Setaria italica
MAPSWWGRDARANGGGGGGGTPVVVKMENPNWSISEVSASEVAAPDSPAGGGGGKAGRGKNARQITWVLLLKAHRAAGRLTGAASAALAVAAAARRRVAAGRTDSDVAPGENTALRARFYGCIRVFLVLSLLLLAVEVAAWLQGWHLEVDAGLLAVDGLFAAAYAGWMRARLDYLAPPLQFLTNACVVLFMIQSVDRLVLCLGCFWIRLKGIKPVPLAADKEDVEAGAEDFPMVLVQMPMCNEREVYQQSIGAVCSLDWPRSNFLVQVLDDSDDATTSALIKEEVEKWQREGVRIIYRHRVIRDGYKAGNLKSAMNCSYVKDYEFVVIFDADFQPQPDFLKRTVPHFKGKDDVGLVQARWSFVNKDENLLTRLQNINLCFHFEVEQQVNGAFLNFFGFNGTAGVWRIKALEDSGGWMERTTVEDMDIAVRAHLKGWKFVFLNDVECQCELPESYEAYRKQQHRWHSGPMQLFRLCFVDIIKSKIGFWKKFNLIFLFFLLRKLILPFYSFTLFCVILPMTMFVPEAELPAWVVCYIPATMSILNILPAPKSFPFIVPYLLFENTMSVTKFNAMISGLFQLGSAYEWVVTKKSGRSSEGDLVALVEKHSKQQRVGSAPNLDALTKEESNPKKDLKKKKHNRIYRKELALSFLLLTAAARSLLSAQGIHFYFLLFQGVSFLVVGLDLIGEQVE

SEQ ID NO: 17866 - protein, 688 aa, Oryza sativa
MAPSWWGRSGGGGVGNGGGTPVVVKMENPNWSISEVEAAEVAPGSPAGAGKAGRGKNARQITWVLLLKAHRAAGRLTGAASAALAVASAARRRVASGRTDADAAPGESTALRARSYGCIRVSLVLSLLLLAVEVAAYLQGWHLEEVASLLAVDGLFAASYAGWMRLRLDYLAPPLQFLTNACVALFMVQSIDRLVLCLGCFWIRFKGIKPVPQAAAAGKPDVEAGAGDYPMVLVQMPMCNEREVYQQSIGAVCNLDWPKSNFLVQVLDDSDDATTSALIKEEVEKWQREGVRIIYRHRVIRDGYKAGNLKSAMNCSYVKDYEFVVIFDADFQPQADFLKRTVPHFKGKDDVGLVQARWSFVNKDENLLTRLQNVNLCFHFEVEQQVNGAFLNFFGFNGTAGVWRIKALEDSGGWMERTTVEDMDIAVRAHLKGWKFVFLNDVECQCELPESYEAYRKQQHRWHSGPMQLFRLCFVDIIKSKIGFWKKFNLIFLFFLLRKLILPFYSFTLFCVILPMTMFVPEAELPAWVVCYIPATMSILNILPAPKSFPFIVPYLLFENTMSVTKFNAMISGLFQLGSAYEWVVTKKSGRSSEGDLVGLVEKHSKQQRVGSAPNLDALTKEESNPKKDSKKKKHNRIYRKELALSFLLLTAAARSLLSAQGIHFYFLLFQGVSFLVVGLDLIGEQVE

SEQ ID NO: 17867 - protein, 702 aa, Zea mays
MAPSWWGRDARANGVVGGGTPVVVRMENPNWCISEVAAAASEVDAPPPAAAGGGKAGRRGKNARQITWVLLLRAHRAAGRLTGAASAALSVAAAARRRVAAGRTDSDADADAAPGESAALRARSYGCIRLFLALSLLLLAVEVAAYLRGWHLEVDVGAGILAVDGLFAAAYAAWMRARLDYLAPPLQFLTNACVLLFLVQSVDRLVLCLGCFWIKLKGVRPVPPLPADKEDVEAGPDGVPMVLVQMPMCNEREVYQQSIGAVCSLDWPRSNFLVQVLDDSDDATTSALIKEEVEKWQREGVRIVYRHRVIRDGYKAGNLKSAMNCSYVKDYEFVVIFDADFQPQADFLKRTVPHFKGKDDVGLVQARWSFVNKDENLLTRLQNINLCFHFEVEQQVNGAFLNFFGFNGTAGVWRIKALEESGGWMERTTVEDMDIAVRAHLKGWKFLFLNDVECQCELPESYEAYRKQQHRWHSGPMQLFRLCFVDIIKSKIGFWKKFNLIFLFFLLRKLILPFYSFTLFCVILPMTMFVPEAELPAWVVCYIPATMSILNILPSPKSFPFIVPYLLFENTMSVTKFNAMVSGLFQLGSAYEWVVTKKSGRSSEGDLVALVEKHSKQQRVGSAPNLDALTKESKGTEEEKNKKKRKKKHNRIYRKELALSFLLLTAAARSLLSAQGVHFYFLLFQGVSFLVVGLDLIGEQVD

SEQ ID NO: 17868 - protein, 687 aa, Brachypodium distachyon
MAPSWWGREQQPARANGGGTPVVVKMENPNWSISEVEPELGPGSPAGLAGGKAGRGKNARQITWVLLLKAHRAAGRLTGAATAALAVAAAARRRVAAGRTDSDAAPGENTALRARFYGCIRVFLALSLLLLAVEVAAYLQGWHLEMPGLDAMDGLFAAAYAGWMRVRLRYLAPPLQFLTNSCVVLFLIQSVDRLVLCLGCFWIKLKGIRPVPQASDKEDVEAGAEDFPMVLVQMPMCNEREVYQQSIGAICNLEWPRSNFLVQVLDDSDDPTTSALIKEEVEKWQREGVHIVYRHRVIRDGYKAGNLKSAMNCSYVKDYEYVVIFDADFQPQADFLKRAMPHFKGKDDVGLVQARWSFVNNDENLLTRLQNINLCFHFEVEQQVNGAFLNFFGFNGTAGVWRIKALEDSGGWMERTTVEDMDIAVRAHLKGWKFLYLNDVECQCELPESYEAYRKQQHRWHSGPMQLFRLCFVDIIKSEIGFWKKCNLIFLFFLLRKLILPFYSFTLFCVILPMTMFVPEAELPAWVVCYIPVTMSILSVLPSPKSFPFIVPYLLFENTMSVTKFNAMISGLFQLGSAYEWVVTKKSGRSSEGDLVALVEKHSMQQQRVGSAPNLDALAKEESLPKKDSKKKKHNRIYRKELALSFLLLTAAARSVLSAQGIHFYFLLFQGVSFLVVGLDLIGEQVE

SEQ ID NO: 17869 - protein, 686 aa, Brachypodium distachyon
MAPWWGQEARGGGGGGTPVVVKMESPDWSISEVAAPGSPAAGAKAGRGKNARQITWVMLLKAHRAAGKLTGAASAALSVAAAARRRVAAGRTDSDAATTAGESPVLRTRFYACLRAFLLFSMLLLAVDVAAHAQGWHLAAVPDLEAVEGLFAAAYASWMRARVAYLAPALQFLTNACVVLFLIQSADRLILCLGCLWIRLRGIKPVPNTTGGKASDDIETGVEEFPMVLVQIPMCNEKEVYQQSIGAVCNLDWPRSNFLVQVLDDSDDAATSALIKEEVEKWQLEGVRILYRHRVIRDGYKAGNLKSAMNCSYVKDYEFVVIFDADFQPQEDFLKKTVPHFKGNEDVGLVQARWSFVNKDENLLTRLQNINLCFHFEVEQQVNSVFLNFFGFNGTAGVWRIKALEDSGGWMERTTVEDMDIAVRAHLKGWKFLYLNDVECQCELPESYEAYRKQQHRWHSGPMQLFRLCFVDIIKSKIGFWKKFNLIFLFFLLRKLILPFYSFTLFCVILPMTMFAPEAELPAWVVCYIPATMSLLNILPAPKSFPFIVPYLLFENTMSVTKFNAMISGLFQLGSAYEWVVTKKSGRSSEGDLVALVENEKQSKQQRVGSAPNLDCLAKEESRPKEDSKKKKHNRLYRKELALSFLLLTAAARSLLSVQGIHFYFLLFQGVSFLVVGLDLIGEQVK

SEQ ID NO: 17870 - protein, 690 aa, Oryza sativa
MARWWGGEGRGGSGTPVVVKMESPEWAISEVEAGAAAPGSPAAGGKAGRGKNARQITWVLLLKAHRAAGKLTGAASAALSVAAAARRRVAAGRTDSDDAAAAPPGESPALRARFHGFLRAFLLLSVLLLAVDVAAHAQGWHAVVPDLLAVEGLFAAAYASWLRVRLEYLAPGLQFLANACVVLFLIQSADRLILCLGCLWIKLKGIKPVPKASGGGGGGKGSDDVEAGADEFPMVLVQIPMCNEKEVYQQSIGAVCNLDWPRSNFLVQVLDDSDDAATSALIKEEVEKWQREGVRILYRHRVIRDGYKAGNLKSAMNCSYVKDYEFVVIFDADFQPQADFLKRTVPHFKGNEDVGLVQARWSFVNKDENLLTRLQNINLCFHFEVEQQVNGVFLNFFGFNGTAGVWRIKALEDSGGWMERTTVEDMDIAVRAHLKGWKFLYINDVECQCELPESYEAYRKQQHRWHSGPMQLFRLCFVDIIKSKIGVWKKFNLIFLFFLLRKLILPFYSFTLFCIILPMTMFVPEAELPAWVVCYIPATMSLLNILPAPKSFPFIVPYLLFENTMSVTKFNAMISGLFQLGSAYEWVVTKKSGRSSEGDLVSLVEKQPKQQRVGSAPNLDSLAKESHPKKDSKKKKHNRIYQKELALSFLLLTAAARSLLSVQGIHFYFLLFQGVSFLVVGLDLIGEQVE

SEQ ID NO: 17871 - protein, 686 aa, Setaria italica
MEQWLGREARGGGGSGTSVVVKMESPDWAVPRSEAAAGAGAAGGKAGRGKNARQITWVLLLKAHRAAGKLTGAASAALSVAAAARRRVAAGRTDADAGAAPPGESPALRTRFYGFLRAFLLLSMLLLAVDVAAHLQGWHLAVDVPDLLTVEGLFASGYASWVRIRLEYLAPALQFLANACVVLFLIQSADRLILCLGCLWIKLRGVKPVAKAGGKGSDDVESGAGEFPMVLVQIPMCNEKEVYQQSIGAVCSLDWPRSNFLVQVLDDSDDAATSALIKEEVEKWQREGVRILYRHRVIRDGYKAGNLKSAMNCSYVKDYEFVVIFDADFQPQPDFLKRTVPHFKGNEDVGLVQARWSFVNKDENLLTRLQNINLCFHFEVEQQVNGIFLNFFGFNGTAGVWRIKALEDSGGWMERTTVEDMDIAVRAHLKGWKFLFLNDVECQCELPESYEAYRKQQHRWHSGPMQLFRLCFVDIIKSKIGFWKKFNLIFLFFLLRKLILPFYSFTLFCIILPMTMFIPEAELPAWVVCYIPATMSLLNILPAPKSFPFIVPYLLFENTMSVTKFNAMISGLFQLGSAYEWVVTKKSGRSSEGDLIALVEKQSKQQRVGSAPNLDSLTKESSNLKKDFRKKKHNRIYRKELALSFLLLTAAARSLLSVQGIHFYFLLFQGVSFLVVGLDLIGEQVE

SEQ ID NO: 17872 - protein, 689 aa, Sorghum bicolor
MAQWWGREARGGGGGGGTSVVVKMESPDWAVPGSAAAGGKAGRGKNARQITWVLLLKAHRAAEKLTGAASAALSVAAAARRRVAAGRTDDDVDADEAGAAATPGESPALRARLYGFLRVFLLLSMLLLAVDVAAHLQGWHLAVDVPDLLAVEGLFAAGYASWVRVRLEYLAPALQFMANACVVLFLIQSADRLILCLGCLWIKLKGIKPVPKAAGKGSDDDVEADTTGEFPMVLVQIPMCNEKEVYQQSIGAVCGLDWPRPNFLVQVLDDSDDAATSALIKEEVEKWQREGVRILYRHRVIRDGYKAGNLKSAMNCSYVKDYEFVVIFDADFQPQPDFLKRTVPHFKGNEDVGLVQARWSFVNKDENLLTRLQNINLCFHFEVEQQVNGIFLNFFGFNGTAGVWRIKALEDSGGWMERTTVEDMDIAVRAHLKGWKFMFLNDVECQCELPESYEAYRKQQHRWHSGPMQLFRLCFVDIIKSKIGFWKKFNLIFLFFLLRKLILPFYSFTLFCIILPMTMFIPEAELPAWVVCYIPATMSLLNILPAPKSFPFIVPYLLFENTMSVTKFNAMVSGLFQLGSAYEWVVTKKSGRSSEGDLIALVEKQSKQQRVGSAPNLDSLTKESSNLKKDSKKKKHNRIYRKELALSFLLLTAAARSLLSVQGIHFYFLLFQGVSFLVVGLDLIGEQVE

SEQ ID NO: 17873 - protein, 669 aa, Panicum virgatum
GGGTSVVVKMESPDWAVPQSEAGAASGKAGRGKNARQITWVLLLKAHRAAGKLTGAASAALSVAAAARSRVAAGRTDADAGAAPPGESPALRTRFYGFLRAFLLLSLLLLAVDVAAHLQGWHIAVDVPDLLAVEGLLAAGYASWVRIRLEYLAPALQFLANACVVLFLIQSADRLILCLGCLWIKLRGIKPVPKAGGKGSDDVEAGAGEFPMVLVQIPMCNEKEVYQQSIGAVCSLDWPRSNFLVQVLDDSDDAATSALIKEEVEKWQREGLRILYRHRVIRDGYKAGNLKSAMNCSYVKDYEFVVIFDADFQPQPDFLKRTVPHFKGNEDVGLVQARWSFVNKDENLLTRLQNINLRFHFEVEQQVNGIFLNFFGFNGTAGVWRIKALEDSGGWMERTTVEDMDIAVRAHLKGWKFLFLNDVECQCELPESYEAYRKQQHRWHSGPMQLFRLCFVDIIKSKIGFWKKFNLIFLFFLLRKLILPFYSFTLFCIILPMTMFIPEAELPAWVVCYIPATMSLLNILPAPKSFPFIVPYLLFENTMSVTKFNAMISGLFQLGSAYEWVVTKKSGRSSEGDLVALVEKQSKQQRVGSAPNLDSLTKESAHPKKDSVKKKHNRIYRKELALSFLLLTAAARSLLSVQGIHFYFLLFQGVSFLVVGLDLIGEQIE

SEQ ID NO: 17874 - protein, 688 aa, Zea mays
MPQWWGREARGGGGGGGTSVVVKMESPDWAVREPEAARGKAGRGKNARQITWVLLLKAHRAAGKLTGAASAALSVAAAARRRVAAGRTDADADAGAGAGAAPHGESPALRTRLYGFLRASLVLSMLLLAADVAAHLQGWHLLAVDVPDLLAVEGLFAAGYASWVRVRLQYLAPALQFLANACVLLFLVQSADRLILCLGCLWIKLRGIKPVPNAAGKGPDDVEAGTGEFPMVLVQIPMCNEKEVYQQSIGAVCGLDWPRPNFLVQVLDDSDDAATSALIKEEVERWQREGVRILYRHRVIRDGYKAGNLKSAMNCSYVKDYEFVVIFDADFQPQPDFLKRTVPHFKGNEDVGLVQARWSFVNKDENLLTRLQNINLCFHFEVEQQVNGIFLNFFGFNGTAGVWRIKALEDSGGWMERTTVEDMDIAVRAHLKGWKFLFLNDVECQCELPESYEAYRKQQHRWHSGPMQLFRLCFVDIIKSKIGFWKKFNLIFLFFLLRKLILPFYSFTLFCIILPMTMFIPEAELPAWVVCYIPATMSLLNILPAPKSFPFIVPYLLFENTMSVTKFNAMVSGLFQLGSAYEWVVTKKSGRSSEGDLIALVEKQPKQQRVGSAPNLESLTKESSSLKRDSKRKKHNRIYRKELALSFLLLTAAARSLLSVQGIHFYFLLFQGVSFLVVGLDLIGEQVE

SEQ ID NO: 17875 - protein, 683 aa, Zea mays
MVQWWGREAPGGRGTSVVVKMESPDWTIPAESEVAAGGKAGRGKNARQITWVLLLKAHRTAGKLTGAASAVLSIAGAAWRRVAAGRTDEDEDEDAGAAPPGESPALRSRFYGFLRASLVLSVLLLAADVAAHLQGWHLAVDVPDLLAVEGLFAAGYASWARVRLEYLAPALQFLANACVVLFLVQSADRLILCLGCLWIKHRGIRPVPKAGGKGSDDVEAGTGNFPMVLVQIPMRNEKEVYQQSIGAVCGLDWPRPNFLVQVLDDSDDAATSTLIKEEVEKWQREGVRILYRHRLIRDGYKAGNLKSAMNCSYVKDYEFVVIFDADFQPQPDFLKRTVPHFKGNEDVGLVQARWSFVNKDENLLTRLQNINLCFHFEVEQQVNGIFLNFFGFNGTAGVWRIKALEDSGGWMERTTVEDMDIAVRAHLKGWKFLFLNDVECQCELPESYEAYRKQQHRWHSGPMQLFRLCFVDIIKSKIGFWKKFNLIFLFFLLRKLILPFYSFTLFCIILPMTMFIPEAELPAWVVCYIPATMSLLNILPAPKSFPFIVPYLLFENTMSVTKFNAMVSGLFQLGSAHEWVVTKKSGRSSEGDLVVEKQPRQQRAGSASNLGSLAKEPSSSLRKDSQRKKHNRIYRKELALSFLLLTAAARSLISVQGIHFYFLLFQGVSFLVVGLDLIGEQVE

SEQ ID NO: 17876 - protein, 934 aa, Setaria italica
MASDKAKVAKKGGEDPGLPPASREGENSHEPQRQRSLNGRTTGPTRRSTKGNWTPEEDSILSRAVQTYQGKNWKKIAECFPDRTDVQCLHRWQKVLNPELVKGPWSKEEDEIIVQMVNKYGPKKWSTIAQALPGRIGKQCRERWHNHLNPAINKEAWTQEEEITLIHAHRMYGNKWAELTKFLPGRTDNAIKNHWNSSVKKKVDSYISSGLLSQVPCLPLIECPSQCNSLSTMNLQNNGDSGCNAQNTNLALSCDLQENMDANKSEAQDSHSSMCQGTCYTSTEAVGSALPDGHHHLSSSFSQRLDLQMDVHEGSGNSMFVDEQTLCSTSNQENSMVPFGVAQEMPVSVLSSVSDAEQKLHLISDADSLKSELWKDVSLQTLISGDTVDAASSGLNQLPDTSKTDTNFLAQPYPLHTSNPSSVMETVYERSTLVTVSSSFLCLDSLPGVPGNRSEPMDMLDSEAEMITCSNNSFCDAEQSAKPGSSDDRPGDFTMIENTTNCRSQQSTDAEEAVASTAKEQLPKDIETVPDEKKGEGALFYEPPRFPGVDVPFISCDLVTSADLQEFSPLGIRQWMRSTMNVPTPLRLWGSPTHDESPDALKTAAESFPCTPSIMKKRHRGLLSPTPDKRIEKKSGIAKEMTDISYMITATCSVNTTKDEATVTESLVCAEQSSFKHLDKKLEFSDGNKENSDGAPEQARDAQNAGNKQLVDEGGQRCSSPNVANPNADLPDNSQPVGILVEHEHNCNDLIATDHGAKPESLSFCKEAVNSKSKPADLVVEKSSPCINADYEYVNLLADTPGVKRGLESPSAWKSPWYIDMHMSFQGFVSPADRTYDALGLVKQISKHSAAAAVEACEVLASGSRPSDAENKENTDDKEPGTRKSQTKIMAEARVLDFDEYSTPARTADKRLSSCLGRSVSSPILSSPNLRSFR

SEQ ID NO: 17877 - protein, 926 aa, Panicum virgatum
MASDKAKVAKKGGEDPGLPPASREGENSHEPQRQRSLNGRTTGPTRRSTKGNWTPEEDAILSRAVQTYQGKNWKKIAECFPDRTDVQCLHRWQKVLNPELVKGPWSKEEDEIIVQMVNKYGPKKWSTIAQALPGRIGKQCRERWHNHLNPAINKEAWTQEEEITLIHAHRMYGNKWAELTKFLPGRTDNAIKNHWNSSVKKKVDSYISSGLLSQVPCLPVIECPAQCNSLSAMNLQNIGDSGCNAHNTNVALSCELQVNVDDNKGEAHDSHSSMCQGACYTSVEAVGSALPDGHHHLSSSFSQRMDLQMDVNEGSGNSVFADDQTLCSTSNQEKSMVPYGVAEEMPVSVLSTVSDAEQKLHLNSDADSLKSELWRDVSLQTLISGDTIDGDSSSGLNQLPDTSEMDTNLLAQPYPLHSSNPSSVMETVYEQNSLPTVSPSFICLDSLSDAPKNRSEPVEMPDSEADMITCSNSSFCDVEQSAKPGSSDDRPGAFTISESITNCRSQQSTDAEEPVASTAKEQLPKDMDIVPDEKKGGGALFYEPPRFPGLDVPFISCDLVTSADMQEFSPLGIRQWMRSTMNVPTPLRLWGSPTHDESPGVLKSAAESFPCTPSIMKKRQRGLLSPTPDKRIEKKSGIAKEMTDISYMIAATCSMNATKDEATSPESVACAEQHSSFKHLDEKLEFSDGNRENFNGAPEQVRDAQNGGNKQGGQKCSSLNVANPNTDLPDNLQPVGILVEHNCNDIIAADPESLSSCKEAVSSKPKPAALVVEKSSPCINADYEYVNLLADTPGVKRGLESPSAWKSPWYIDMHMHFQGFVSPADRTYDALGLVKQISKRSAAAAVEACEVLASGSRISDKENKENRDDKEPGTRQSQTKIMAEARVLDFDEYSTPAKAADKRLGSCLGKSVSSPILSSPNMRCFR

SEQ ID NO: 17878 - protein, 925 aa, Panicum virgatum
MASDKAKVAKKGGEDPGPPPASREGENSHEPQRQRSLNGRTTGPTRRSTKGNWKPEEDAILSRAVQTYQGKNWKKIAECFPDRTDVQCLHRWQKVLNPELVKGPWSKEEDEIIVQMVNKYGPKKWSTIAQALPGRIGKQCRERWHNHLNPAINKEAWTQEEEITLIHAHRMYGNKWAELTKFLPGRTDNAIKNHWNSSVKKKVDSYISSGLLSQVPCLPVIECPAQCNSLSALNLQNNGDSGCNAHNTNVALSCELQVNVDANKGEAHDSHSSMCQVACYTSIEAVGSALPDGHHHLSSSFSQRMDLQMDVNEGSGNSVFADDQTLCSTSNQEKSMVPYGVAQEMPFSVLSSVSDAEQKLHLISDADSLKSELWKDVSLQTLISGDTIDGDSSSGLNQPPDTSETDTNFLAQPYTLHTSNPSSMMETVYEQSTLATISPSFISLDGLSDAPENRSEPIEMRDSEAEIITCSNNSFCDAEQSVKPGSSDDRPGAFTMTESITNCKSQQSTDAEEPVASTVKEQLPKDMDIGPDEKKGEGALFYEPPRFPGLDVPFISCDLVTSADMQEFSPLGIRQWMRSTMNVPTPLRLWGSPTHDESPGVLKSAAESFPCTPSIMKKRQRGLLSPTPDKRIEKKSGIAKEMTDISYMIAATCSMNATKDEATAPESVACAEQHLDEKLKFSDGNRENFNGAPEQARDAQNGGNKQGGQHCSSLNVANPNTDLPDNLQPVGVLVEHNCNDIIAADHGAKPESLSSCKEAVSSKPKPAELVVEKSSPCINANYEYVNLLADTPGVKKGLESPSAWKSPWYIDMHMHFQGFVSPADRTYDALGLVKQISKQSAAAAVEACEVLASGSRIFDKENKENRDDKEPGTRKSQTKIMAEARVLDFDEYSTPAKAADKRLGSCLGRSVSSPILSSPNLRSFR

SEQ ID NO: 17879 - protein, 858 aa, Zea mays
MPSDKAKAPKKKGEEDPGIPPAPCEGEISHEPHRQRSLNGWQKVLNPELVKGPWSKEEDEIIVQMVNKYGPKKWSAIAQALPGRIGKQCRERWHNHLNPAINKEAWTQEEEITLIHAHRMYGNKWAELTKFLPGRTDNAIKNHWNSSVKKKVDSYISSGLLSQVPCLSLIECPAQCDSLSAMDQQNNGGTDCNDQNTSVVLSSDLQVNVDANKKEAHDSHSSLCQGVCYPSTETVGSVLPDDLEMDMDEGSGNSIFADDQTLCSTSNQEQSMVPFVVAQEMPVSVLSSVSSAEQKRHLISDAKSLKSELWKDVCLQTLITGDTDDPDASSRLNNPDSSKMDTNFLKEAYPLHTPNPSSVIETVYEPMALVTISPPFICSDGLSFAPENRSKPGEMSDCEAEMVTCSNNFFGNAEQSAKLASSDDRPEAFTMTESTTNCGGEQLTDAKEPVASTAKERLSKDIETMPDKKKGEGALFYEPPRFPGLDVPFISCDLVTSADLQEFSPLGIRQWMRSTMNVPTPLRLWGSPTHDESPDALKTAAESFPCTSSIMKKRQRSLLSPTPDERIEKKSGIAKGVTDISYMITATCSMNATNDEDIVTESAVCAKQPSLKHLDKKLEFSDINKENSDGASEQAKDAQNTQLVDEQHSSPNVVNPNTDLQDNIQPVQILVEQSSNNLISSDHGAKPSCKEVISSKSKPTKLLVEKSSPCINVDYEYVNLLADTPGIKRGLESPSAWKSPWYIDMHMHFQGFVSPADRTYDALGLVNRLSKHSAAAAVEACEMLASGNTTSDKENKDNTDGKELVTRKSQIKIMAEARVLDFDESPAPARTADKKLGSCHRRSVSSPILPSPNLRSFR

SEQ ID NO: 17880 - protein, 400 aa, Zea mays
MATAVSTPADLSPTPAPRRRGRPPKNPAPAEAPGSPADQAEVIGDYERERDARIRENMERMQKLGILDLAHTLSHCAAASGLGTGSGRWRRKPVEPGSAGGARVKPASPAPSRRSLRLKDVEPVTYREIEPKKEKRSEGGKTVLMEVGAKEEIYTEEHDKLLGTCNTPWTLFVDGYGKDGKRIYDQVRGQTCHQCRQKTLGHHTSCCKCQIVQGQFCGDCLYMRYGENVLEVKKNPNWICPVCRGICNCSLCRTKKGWFPTGSAYRKAIGLGYKSVAHFLIATHRASSVNSSSVDNNKLPSAKSETSCISDHANESPEDGETTSKAKQNKATRRRVRKSSDGDNDSRSGSVVTSDCQDDQANKDAGCVTPSSKPASTKRKYVERSPDCIASRLRSRLNMP

SEQ ID NO: 17881 - protein, 595 aa, Solanum phureja
MEGRHSHPSTPIPDDFVQKRGKKRGSYNCGRCGLPKKGHVCDLTKEISEVPTPTSSDAKSFVLPSPLSVVRTKPTPPLPPPRQAVPQLRRALSFDDIGVTDESPGSDDDEGVDEGEFLDFESELDLGGSGKLPANCLWEVFKRLPPSSLLSSAKVCKGWRDVSRRIWKSAEELRLEVPVKAQIGLVGSVLQKCPGLVKLSLRMKSDVDATMLACIAFSCPNLDSLEILTSETSVNRITGDELGRFVADKRCLANLKMEGCSNLGGFTLSSTSLSTLCLSELFCHSKMVFNCPNLKEISLIFSRQENENTDLTAMVNGLGRSCPRLQNIHVASVRLTHAVVLALTAANLRGLRMLSLVLGSEITDASVAAIASSYSRLELLDLSGSSISDSGIGMICNVFPETLLKLLLALCPNITSSGIQFAAAQLPNLELMDCGMSICDPDLDSPAAQENDTVELQRTPSSKLHLIYQKLIIKHSHLKKFSLWGCSGLDALYLNCPELSDLNLNSCMNLNPGRLLLQCPNLESVHASGCQDTLVETLQNQVCGDFMAEDDHYPCKRLPDGSKRIRVPHSYSPQPFDDGKRKRRLSKQHCAVLVY

SEQ ID NO: 17882 - protein, 603 aa, Capsicum annuum
MKGRLSHPSTPIPNDFVRKTGKKRGGYNCGRCGLPKKGHVCDFTKDSINEVPTPTSGDAKSFVSPSMSSVIRPQPPPPPPPRQAVPQLRRALSFDDIGVTDESPGSDDDDDEREELLDLESELDISGSGKLPANCLWEVLKRLPPSSLLSSAKVCKGWRDVSRRIWRSAEELRLGVPVNAQIGLVGSVLKKCPGLVKLSLRMKSDVDATMLACIAFSCPNLDSLEILTSDTSVNRITGDELGRFVAEKRCLTNLKMEGCSNLGGFTLSSTSLSALCLSDLFCHSKMVFNCPNLKEISLEFSRQENDNTDLTAMVDGLGKSCPRLQNIHVASVRLTHAVVLALTAANLRGLRMLSLVLGSEITDASVAAISSSYSWLELLDLSGSSITDSGIGMICNVFPETLSNLLLALCPNITSSGIQFAAAQLPNLELMDCGMSICNPDLDSPTSQKNDNVELQRTPSSKLHLIYQKLIIKHSRLKKLSLWGCSSLDSLYLNCPELNDLNLNSCINLNPERLLLQCPNLESVHASGCEDTLVETLKNQVSDDFTAEDYFPCKRLPDGSKRIRVPLLYSPQVIPRSLHHYKPFDDAKRKRRISKQRSAVLVY

SEQ ID NO: 17883 - protein, 204 aa, Arabidopsis lyrata
MGRVDYLAMKTDDVDTVAALVNSDMEELKVAAKKLFSDVSKLGGLGFGVSFLKFIASFAAIYLLILDRTNWKTKMLTSLLIPYIFLSLPSVIFNFLSGEVGKWIAFVAVVLRLFFPKHFPDWLEMPGSLILLLVVAPHFLAHHIRGTWIGTVISLFIGCYLLQEHIRASGGFRNSFTQPRGVSNTLGIILLLVYPVWALIVRVM

SEQ ID NO: 17884 - protein, 204 aa, Raphanus sativus
MGRVDYLAMKSDDVDTVALVNSDVEELKIAAKKLFSDVSKLGGSAFGVSFVKWMACFAAIYLLILDRTNWRSKMLTSLLIPYIFLSLPGVIFNFLSGDVGKWIAFVAVVLRLFFPKHFPDWLEMPGSLILLLVVSPHFLAHHIRGTWIGSVIGLFIGCYLLQEHIRVSGGFRNSFTQPRGVSNTLGIILILVYPVWALIVRVTK

SEQ ID NO: 17885 - protein, 202 aa, Eutrema halophilum
  Sequence also found in Organisms: Eutrema parvulum
MGRVDYLAMKTDVDTVALVNSDLEELKIAAKKLVSDVSKLGGLAFGVSFVKWIASFAAIYLLILDRTNWRTKMLTALLIPYIFLSLPGVIFNFLSGDVGKWIAFVAVVLRLFFPKHFPDWLEMPGSLILLLVVSPHFLVHHIRGTWIGSVISLFIGCYLLQEHIRVTGGFRSSFTQPRGISNTLGIILLLVYPVWALIVRVS

SEQ ID NO: 17886 - protein, 202 aa, Brassica napus
  Sequence also found in Organisms: Brassica oleracea
MGRVDYLAMKTDVDKVALVNSDVEELKIAAKKLLTDVSKLGGLAFGVSFVKWIASFSAIYLLILDRTNWRTKMLTSLLIPYIFLTLPGVIFNFLSGDVGKWIAFVAVVLRLFFPKHFPDWLEMPGSLILLLVVSPHFLVHHIRGGWIGSVISLFIGCYLLQEHIRVSGGFRNSFTQPRGVSNTLGIILLLVYPVWALIIRVS

SEQ ID NO: 17887 - protein, 203 aa, Brassica napus
  Sequence also found in Organisms: Brassica oleracea
MGRVDYLAMKTDVDTVALVNSDVEELKIAAKKLLSDVTKLGGAAFGVSFVKWLACFAAIYLLILDRTNWRSKMLTSLLIPYIFLSLPGVLFNFLSGDVGKWIAFVAVVLRLFFPKHFPDWLEMPGSLILLLVVSPHFLAHHIRGTWIGSIISLFIGCYLLQEHIRVSGGFRHSFTQPRGVSNTLGIILILVYPVWALIVRVLK

SEQ ID NO: 17888 - protein, 203 aa, Brassica rapa
MGRVDYLAMKTDVDKVALVNSDVEELKIAAKKLFRDVTKLGGAAFGVSFVKWLACFAAIYLLILDRTNWRSKMLTSLLIPYIFLSLPGVIFNFLSGDVGKWIAFVAVVLRLFFPKHFPDWLEMPGSLILLLVVSPHFLAHHIRGTWIGSIICLFIGCYLLQEHIRVSGGFRNSFTQPRGVSNTLGIILILVYPVWALIVRVTK

SEQ ID NO: 17889 - protein, 202 aa, Brassica napus
  Sequence also found in Organisms: Brassica juncea
MGRVDYLAMKTDLDKVALVNSDVEELKIAAKKLLTDVSNLGGLAFGVSFVKWIASFSAIYLLILDRTNWRTKMLTSLLIPYIFLTLPGVIFNFLSGDVGKWIAFVAVVLRLFFPKHFPDWLEMPGSLILLLVVSPHFLVHHIRGGWIGSVISLFIGCYLLQEHIRVSGGFRNSFTQPRGVSNTLGIILLLVYPVWALIIRVS

SEQ ID NO: 17890 - protein, 202 aa, Brassica rapa
MGRVDYLAMKTDVDKVALVSSDVEELKIAAKKLLTDVSNLGGLAFGVSFVKWIASFSAIYLLILDRTNWRTKMLTSLLIPYIFLTLPGVIFNFLSGDVGKWIAFVAVVLRLFFPKHFPDWLEMPGSLILLLVVSPHFLVHHIRGGWIGSVISLFIGCYLLQEHIRVSGGFRNSFTQPRGVSNTLGIILLLVYPVWALIIRVS

SEQ ID NO: 17891 - protein, 203 aa, Brassica napus
MGRVDYLAMKTDVDKVALVNSDVEELKIAAKKLFRDVTKLGGAAFGVSFVKWMACFAAIYLLILDRTNWRSKMLTSLLIPYIFLSLPGVIFNFLSGDVGKWIAFVAVVLRLFFPKHFPDWLEMPGSLILLLVVSPHFLAHHIRGTWIGSIICLFIGCYLLQEHIRVSGGFRNSFTQPRGVSNTLGIILILVYPVWALIVRVTK

SEQ ID NO: 17892 - protein, 202 aa, Raphanus sativus
MGRVDYLAMKTDVDTAALVNSDVEELKIAAKKLLTDVSNLGGLAFGVSFVKWIASFSAIYLLILDRTNWRTKMLTSLLIPYIFLTLPGVIFNFLSGDVGKWIAFVAVVLRLFFPKHFPDWLEMPGSLILLLVVSPNFLVHHIRGGWIGSVISLFIGCYLLQEHIRVSGGFRNSFTQPRGVSNTLGIILLLVYPVWALIIRVS

SEQ ID NO: 17893 - protein, 202 aa, Raphanus sativus
MGRVDYLAMKTDVDTAALVNSDVEELKIAAKKLLNDVSNLGGLAFGVSFVKWIASFSAIYLLILDRTNWRTKMLTSLLIPYIFLTLPGVIFNFLSGDVGKWIAFVAVVLRLFFPKHFPDWLEMPGSLILLLVVSPNFLVHHIRGGWIGSVISLFIGCYLLQEHIRVSGGFRNSFTQPRGVSNTLGIILLLVYPVWALIIRVS

SEQ ID NO: 17894 - protein, 198 aa, Brassica juncea
MGRVDYLAMKTDVDKVALVNSDVEELKIAAKKLLTDVSNLGGLAFGVSFVKWIASFSAIYLLILDRTNWRTKMLTSLLIPYIFLTLPGVIFNFLSGDVGKWIAFVAVVLRLFFPKHFPDWLEMPGSLILLLVVSPHFLAHHIRGTWIGSVITLFIGCYLLQEHIRVSGGFRNSFTQPRGVSNTLGIILILVYPVWALI

SEQ ID NO: 17895 - protein, 374 aa, Secale cereale
MAIPLVLVLLPLGLLFLLSGLVVNTVQAVLFLTIRPFSKRLYRQINVFLAELLWLQLIWLVDWWAGIKVQVYADPETWKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAVSQGLTAPRNVLIPRTKGFVSAVSIMRDFVPAIYDTTVIIPEDSPKPTMLRILQGQSSVVHVRIKRHSMSDMPNSDEDVSKWCKDIFVAKDALLDKHIATGTFDEEIIPIGRPVKSLMVVLSWSCLLLYGAHRFLQWTQLLSTWKGVILFATGLAMVTAVMHVFIMFSQAERSSSAKAARDRVKRD

SEQ ID NO: 17896 - protein, 374 aa, Triticum aestivum
MAIPLVLVLLPLGLLFLLSGLVVNTVQAVLFLTIRPFSKRLYRQINVFLAELLWLQLIWLVDWWAGIKVQVYADPETWKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAVSQGLTAPRNVLIPRTKGFVSAVSIMRDFVPAIYDTTVIIPEDSPKPTMLRILQGQSSVVHVRIKRHSMSDMPNSDEDVSKWCKDIFVAKDALLDKHIATGTFDEEIIPIGRPVKSLMVVLSWSCLLLYGAHRFLQWTQLLSTWKGVILFASGLAMVTAVMHVFIMFSQAERSSSAKAARDRVKKD

SEQ ID NO: 17897 - protein, 374 aa, Triticum aestivum
MAIPLVLVLLPLGLLFLLSGLVVNTVQAVLFLTIRPFSKRLYRQINVFLAELLWLQLIWLVDWWAGIKVQVYADPATWKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAISQGLTAPRNVLIPRTKGFVSAVSIMRDFVPAIYDTTVIIPEDSPKPTMLRILQGQSSVVHVRIKRHSMSDMPNSDEDVSKWCKDIFVAKDALLDKHIATGTFDEEIIPIGRPVKSLMVVLSWSCLLLYGAHRFLQWTQLLSTWKGVILFASGLAMVTAVMHVFIMFSQAERSSSAKAARDRVKKD

SEQ ID NO: 17898 - protein, 374 aa, Triticum aestivum
MAIPLVLVLLPLGLLFLLSGLVVNTVQAVLFLTIRPFSKRLYRQINVFLAELLWLQLIWLVDWWAGIKVQVYADPATWKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAVSQGLTAPRNVLIPRTKGFVSAVSIMRDFVPAIYDTTVIIPEDSPKPTILRILQGQSSVVHVRIKRHSMGDMPNSDEDVSKWCKDIFVAKDALLDKHIATGTFDEEIIPIGRPVKSLMVVLSWSCFLLYGAHRFLQWTQLLSTWKGVILFASGLAMVTAVMHVFIMFSQAERSSSAKAARDRVKKD

SEQ ID NO: 17899 - protein, 374 aa, Festuca arundinacea
MAIPLVLVLLPLGLLFLLSGLVVNTVQAVLFLTIRPISKRLYRQINVFLAELLWLQLIWLVDWWAGVKVKLYGDPETFKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAVSQGLTAPRNVLIPRTKGFVSAVSIMRDFVPAIYDTTVIIPEDSPKPTMLRILQGQSSVVHVRIKRHAMSDMPKSDEDVSKWCKDIFVAKDALLDRHLATGTFDEEIIPIGRPVKSLVVVLSWSCLLLFGAHRFLQWTQLLSTWKGVIIFSTGLAMVTAVMHVFITFSQAERSSSAKAARDRAKRD

SEQ ID NO: 17900 - protein, 374 aa, Avena sativa
MAIPLVLVLLPLGLLFLLSGLVVNAFQAVLFLTIRPLSKRLYRQINVFLAELLWLQLIWLVDWWAGVKVQLHGDPETFKLMGKEHALLISNHRSDIDWLVGWILAQRSGCLGSAIAIMKKSSKFLPVIGWSMWFAEYLFLERSWAKDEKTLKWGLQRLKDFPRSFWLALFVEGTRFTPEKLLAAQEYAVSQGLTAPRNVLIPRTKGFVSAVSIMRDFVPAIYDTTVIIPEDSPKPTMLRILQGQSSVVHVRIKRHAMNDMPKSDEDVSKWCKDIFVQKDALLDRHIATGTFDEEIIPIGRPVKSLVVVLSWSCLLLYGAHRFLQWTQLLSTWKGVILFATGLAMVTAVMHVFIMFSQAERSSSAKAARDRVKRD

SEQ ID NO: 17901 - protein, 374 aa, Brachypodium distachyon
MAIPLVLVVLPLGLLFLLSGLVVNAIQAVLFLSIRPFSKRLYRQINVFVAELLWLQLIWLVDWWAGVKVQLHADQETYESMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRYTPAKLLAAQEYAVSQGLTAPRNVLIPRTKGFVSAVSIMRDFVPAIYDTTVIIPEDSPKPTMLRIFQGQSSVVHVRIKRHPMSDMPSSDEDVSRWCKDIFVAKDALLDRHIATGSFDEEIRPIGRPVKSLVVVLSWSCLLLYGAHRFLQWTQLLSTWKGVILFVAGLAMVTAVMHVFIMFSQSERSSSAKAARDRVKKD

SEQ ID NO: 17902 - protein, 374 aa, Setaria italica
MAMPLVLVVLPLGLLFLLSGLIVNAVQAVLFVSIRPLSKSLYRRINRFLAELLWLQLIWLVDWWAGVKVQLHADQETYQLMGKEHALIISNHRSDIDWLTGWILAQRSGCLGSTLAIMKKSSKFLPVIGWSMWFAEYLFLERSWAKDEKTLKWGLKRLKDFPRSFWLALFVEGTRFTPAKLLAAQEYAASQGLPAPRNVLIPRTKGFVSAVSIMRDFVPAIYDTTVIIPKDSPAPTMLCILKGQSSVVHVRIKRHAMSDMPKSDEDVSKWCKDIFVAKDALLDKHIATGTFDEEIRPIGRPIKSLLVVLSWSCLLLYGACRFLQWTQLLSTWKGVILFVAGLTLVTGIMHVFVLFSQSERSSSARAARNRVKKD

SEQ ID NO: 17903 - protein, 374 aa, Saccharum officinarum
MVIPLVLVVLPLGLLFLLSGLIVNAIQAILFVSVRPLSKTLYRRINRFLVELLWLQLIWLVDWWAGVKVQLHADQETYQLMGKEHALIISNHRSDIDWLIGWILAQRSGCLGSTLAIMKKSSKFLPVIGWSMWFAEYLFLERSWAKDEKTLKWGLKRLKDFPRSFWLALFVEGTRFTPAKLLAAQEYAASQGLPAPRNVLIPRTKGFVSAVGIMRDFVPAIYDTTVIIPKDSPAPTMLRILKGQSSVVHVRIKRHAMSDMPKSEEDVSKWCKDIFVAKDALLNKHIAIGTFDEEIRPMGRPMKSLLVVLSWSCLLLYGAYRFLQWTQLLSTWKGIILFASGLALVTGVMHVFIMFSQSERSSTARAARNRVKKD

SEQ ID NO: 17904 - protein, 374 aa, Sorghum bicolor
MVIPLVLVVLPLGLLFLLSGLIVNAIQAILLVSVRPLSKSLYRRINRFLVELLWLQLIWLLDWWAVVKVQLHADQETYQLMGKEHALIISNHRSDIDWLIGWILAQRSGCLGSTLAIMKKSSKFLPVIGWSMWFSEYLFLERSWAKDEKTLKWGLRRLKDFPRSFWLALFVEGTRFTPAKLLAAQEYAASQGLPAPRNVLIPRTKGFVSAVGIMRDFVPAIYDTTVIIPKDSPAPTMLRILKGQSSVVHVHIKRHAMSDMPKFDEDVSKWCKDIFVAKDALLDKHIATGTFDEEIRPIGRPVKSLLVVLSWSCLLLYGAYRFLQWTQLLSTWKGIILLAAGLALVTGVMHVFIMFSQSERSSSARAARNRVKKD

SEQ ID NO: 17905 - protein, 374 aa, Oryza sativa
MAVPLVLVVLPLGLLFLLSGLIINAIQAVLFLSIRPFSKSLYRRINRFLAELLWLQLVWLVDWWAGVKIQLHADDETYKAMGNEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAVSQGLPAPRNVLIPRTKGFVSAVTIMRDFVPAIYDTTVIIPKDSPQPTMLRILKGQSSVVHVRMKRHAMSEMPKSEDDVSKWCKDIFVAKDALLDKHLATGTFDEEIRPIGRPVKSLLVTLFWSCLLLYGAVKLFLWTQLLSTWKGVGFTGLGLALVTAVMHVFIMFSQSERSSSAKAARNRVKKD

SEQ ID NO: 17906 - protein, 374 aa, Brachypodium distachyon
MAVPLVLVLLPLGLLFLLSGLIVNAVQAVLFVSIRPFSKSFYRRINRFLAELLWLQLVWLVDWWAGVKIQLHADEESYQSMGKEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAVSQGLPAPRNVLIPRTKGFVSAVTIMRDFVPAIYDTTVIIPKDSPQPTMLRILKGQSSVVHVRIKRHAMSEMPKSEEDVSKWCKDIFVAKDALLDKHLATGTFDEEIRPIGRPMKSLLVTLFWSCLLLYGVTEFFKWAQLLSTWKGVGFTAVGLALVTGIMHVFIMFSQSERSSSARAARDRVKKD

SEQ ID NO: 17907 - protein, 374 aa, Oryza sativa
MAVPLVLVVLPLGLLFLLSGLIINAIQAVLFLSIRPFSKSLYRRINRFLAELLWLQLVWLVDWWAGVKIQLHADDETYKAMGNEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAVSQGLPAPRNVLIPRTKGFVSAVTIMRDFVPAIYDTTVIIPKDSPQPTMLRILKGQSSVVHVRMKRHAMSEMPKSEDDVSKWCKDIFVAKDALLDKHLATCTFDEEIRPIGRPVKSLLVTLFWSCLLLYGAVKLFLWTQLLSTWKGVGFTGLGLALVTAVMHVFIMFSQSERSSSAKAARNRVKKD

SEQ ID NO: 17908 - protein, 374 aa, Zea mays
MAIPLVLVVLPLGLLFLLSGLIVNTIQAILFVTIRPFSKSLYRRINRFLAELLWLQLVWVVDWWAGVKVQLHADEETYRSMGKEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDDDVSKWCKDIFVAKDALLDKHLATGTFDEEIRPIGRPVKSLLVTLFWSCLLLFGAIEFFKWTQLLSTWRGVAFTAAGMALVTGLMHVFIMFSQAERSSSAKAARNRVKKE

SEQ ID NO: 17909 - protein, 374 aa, Zea mays
MAIPLVLVVLPLGLLFLLSGLIVNAIQAVLFVTIRPFSKSFYRRINRFLAELLWLQLVWVVDWWAGVKVQLHADEETYRSMGKEHALIISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDEDVSKWCKDIFVAKDALLDKHLATGTFDEEIRPIGRPVKSLLVTLFWSCLLLFGAIEFFKWTQLLSTWRGVAFTAAGMALVTGVMHVFIMFSQAERSSSARAARNRVKKE

SEQ ID NO: 17910 - protein, 374 aa, Saccharum officinarum
MAVPLVLVVLPLGLLFLLSGLIVNTIQAILFVTIRPFSKSFYRRINRFLAELLWLQLVWVVDWWAGVKVQLHADDETYRSMGKEHALIISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDEDVSKWCKDIFVAKDALLDKHLATGTFDEEIRPIGRPVKSLLVTLFWSFLLLFGAIKFFKWTQLLSTWRGVAFTAAGMALVTGVMHVFIMFSQAERSSSAKAARNRVKKE

SEQ ID NO: 17911 - protein, 374 aa, Sorghum bicolor
MAVPLVLVVLPLGLLFLLSGLIVNTIQAILFVTIRPFSKSFYRRVNRFLAELLWLQLVWVVDWWAGVKVQLHADEETYRSMGKEHALIISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDEDVSKWCKDIFVAKDALLDKHLATGTFDEEIRPIGRPVKSLLVTLFWSFLLLFGAIKFFKWTQLLSTWRGVAFTAAGMALVTGVMHVFIMFSQAERSSSAKAARNRVKKE

SEQ ID NO: 17912 - protein, 374 aa, Panicum virgatum
MAIPLVLVVLPLGLLFLLSGLIVNTIQAILFVTIRPFSKSFYRRINRFLAELLWLQLVWVVDWWAGVKVQLHADEETYRSMGKEHALIISNHRSDIDWLIGWILAQRSGCLGSALAMMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQPSVIHVRMKRHAMSEMPKSDEDVSKWCKDIFVAKDALLDKHLATGTFDEEIRPIGRPVKSLLVTLFWACLLLFGAIQFFKWTQLLSTWRGVAFTAAGMALVTGVMHVFIMFTQAERSSSARAARNRVKKE

SEQ ID NO: 17913 - protein, 374 aa, Echinochloa colona
MAIPLVLVVLPLGLLFLLSGLIVNTIQAILFVTIRPFSKSFYRRINRFLAELLWLQLVWVVDWWAGVKVQLHADEETYRSMGKEHALIISNHRSDIDWLIGWILAQRSGCLGSTLAVMKKSSKFLPVIGWSMWFAEYLFLERSWAKDEKTLKWGLQRLNDFPRPFWLALFVEGTRFTPAKLLAAQEYAASQGLPAPRNVLIPRTKGFVSAVSIMRDFVPAIYDTTVIVPKDSPQPTMLRILKGQPSVIHVRMKRHAMSEMPKSDEDVSKWCKDIFVAKDALLDKHLASGTFDEEIRPIGRPVKSLLVTLFWACLLLFGAIEFFKWTQLLSTWRGVAFTAAGMALVTGVMHVFIMFSQAERSSSARAARNRVKKD

SEQ ID NO: 17914 - protein, 374 aa, Setaria italica
MAIPLVLVVLPLGLLFLLSGLIVNTIQAILFVTIRPFSKSFYRRINRFLAELLWLQLVWVVDWWAGVKVQLHADEETYRSMGKEHALIISNHRSDIDWLIGWILAQRSGCLGSTLAVMKKSSKFLPVIGWSMWFAEYLFLERSWAKDEKTLKWGLQRLNDFPRPFWLALFVEGTRFTPAKLLAAQEYAASQGLPAPRNVLIPRTKGFVSAVSIMRDFVPAIYDTTVIVPKDSPQPTMLRILKGQPSVIHVRMKRHAMSEMPKSDEDVSKWCKDIFVAKDALLDKHLATGTFDEEIRPIGRPVKSLLVTLFWACLLLFGAIQFFKWTQLLSTWRGVAFTAAGMALVTGVMHVFIMFSQAERSSSARAARNRVKKE

SEQ ID NO: 17915 - protein, 374 aa, Pennisetum glaucum
MAIPLVLVVLPLGLLFLLSGLIVNTIQAILFVTIRPFSKSFYRRINRFLAELLWLQLVWVVDWWAGVKVQLHADEETYRSMGKEHALIISNHRSDIDWLIGWILAQRSGCLGSTLAVMKKSSKFLPVIGWSMWFAEYLFLERSWAKDEKTLKWGLQRLNDFPRPFWLALFVEGTRFTPAKLLAAQEYAASQGLPAPRNVLIPRTKGFVSAVSIMRDFVPAIYDTTVIVPKDSPQPTMLRILKGQPSVIHVRMKRHAMSEMPKSDEDVSKWCKDIFVAKDALLDKHLATGTFDEEIRPIGRPVKSLLVTLFWACLLLFGAIQFFKWTQLLSTWRGVAFTAVGMALVTGVMHVFIMFSQAERSSSARAARNRVKKE

SEQ ID NO: 17916 - protein, 374 aa, Cynodon dactylon
MAIPLVLVVLPLGLLFLLSGLTVNAIQAIMFVTIRPFSKSLYRRINRFVAELLWLQLVWLVDWWAGVKVQLHADEETYRSMGKEHALVVSNHRRHIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIIPKDSPQPTMLRILKGQSSVIHVHIKRRAMSELPESDEDVSKWCKDIFVEKDALLDKHLATGTFDEEIRPIGRPVKSLLVTLFWSCLLLYGATEFFKWTQLLSTWKGVGFTAAGMALVTGVMHIFILFSQAERSSSAKAARNRVKKD

SEQ ID NO: 17917 - protein, 374 aa, Leymus cinereus x Leymus triticoides
MAIPLVLVMLPLGLLFLLSGLIVNTVQAILFVTMRPFSKSFYRRINRFLAELLWLQLVWLVDWWAGIKVQLHADDETYRSMGKVHALIISNHRSDIDWLIGWILAQRSGCLGSTLAVMKKSSKFLPVIGWSMWFAEYLILERSWAKDEKTLKWGLQRLKDFPRPFWLALFVEGTRFTPAKLLAAQEYAASQGLPAPRNVLIPRTKGFVSSVSIMRDFVPAIYNTTVIVPKDSPQPTMLRILKGQPSVIHVRMKRHAMSEMPKSDEDVSKWCKDIFVAKDALLDKHLATGTFDEEIRPIGRPVKSLLVTLFWSCLLLFGAIEFFKWTQLLSTWRGVAFTAAGMGLVTGVMHVFIMFSQAERSSSAKAARNRVKKD

SEQ ID NO: 17918 - protein, 512 aa, Panicum virgatum
MHRLSLTVIDAAAVAMPAALRLGGSPAPRLAAARRQGPRPPPWLRFGWGGGARRGLLCSAEAARRGGDGDDAEAEVEEARRGGGGRAATERRMRSGAAAAAVGTSVELLAIPGVGPRNLRKLVDNGFEGVAQLKQLYRDKFFGKSSEQMVEFLQSSVGIVHKNHAESITSFIKESVDEELKDTDSSKPTQKKRLTFCVEGNISVGKTTFLQRIANETIELRDLVEIVPEPIDKWQDVGPDHFNILDAFYAEPHRYAYTFQNYVFVTRVMQERESQAGIKPLRLMERSVFSDRMVFVRAVHEANWMNEMEISIYDSWFDPVVSSLPGLIPDGFIYLRASPDTCHKRMMHRRRSEEGGVTLDYLQGLHEKHESWLLPSKGSGPGILSVSQLPMHMEGSLPPEIQDRVFYLEGNHMHSSIQKVPALVLDCEPDIDFNKDIEAKRQYARQVAEFFEFVKKKKEEAPSEQSGANKGRMNPQVMLPKRGRLWVPEGNPFAGSPMNLDFRRAMSSYIST

SEQ ID NO: 17919 - protein, 489 aa, Zea mays
MPFALRLGGSPALRPGPRSPSWLRFGGMAGARRALFCSAEDARRCGSDDYAEAEEGRRGGGSRVPSERRIRGGNAAAAVGTSVELLGIPGVGPRNLRKLVDNGFEGVAQLKQLYRDKFFGKSSGQMVEFLQCSVGIVHKNHAESITSFIKESIDEELKDTDSSKPTQKKRLTFCVEGNISVGKTTFLQRIANETIELRDLVEIVPEPIDKWQDVGPDHFNILDAFYAEPHRYAYTFQNYVFVTRVMQERESQAGIKPLRLMERSVFSDRMVFVRAVHEANWMNEMEISIYDSWFDPVVSSLPGLIPDGFIYLRASPDTCHKRMMHRRRSEEGGVTLDYLQGLHEKHESWLLPSKGSGPGVLSVSQLPMHMEGSLPPEIRDRVFYLEGNHMHSSIQKVPALIMDCEPDIDFSKDIEAKRQYARQVAEFFEFVKKKQERAPSGQTSNDKDRMNPQVLLPNSGRLWAPKGNPFAGSPVNLDFKRAMSSYLST

SEQ ID NO: 17920 - protein, 502 aa, Saccharum officinarum
MHRLSLTVIDAASATAAAMPFALWFGGSPALRLAAARRRPGPRPPAWLRFGGGAGARRLLCSTEAARRGGGDEDAEAEAEEGRRGGGSRVPSERRMRGGGNAAAAVGTSVELLEIPGVGPRNLRKLVDNGFEGVAQLKQLYRDKFFGKSSGQMVEFLQCSVGIVHKNHAESITSFIKESVDEELKDTDSSKPTQKKRLTFCVEGNISVGKTTFLQRIANEAIELRDLVEIVPEPIDKWQDVGPDHFNILDAFYAEPHRYAYTFQNYVFVTRVMQERESQTGIKPLRLMERSVFSDRMVFVRAVHEANWMNEMEISIYDSWFDPVVSSLPGLIPDGFIYLRASPDTCHKRMMHRRRSEEGGVTLDYLQGLHEKHESWLLPSKGSGPGVLSVSQLPMHMEGSLPPEIQDRVFYLEGNHMHSSIQKVPALILDCEPDIDFSKDIEAKRQYARQVAEFFEFVKKKQEQSPSEHTSNDKDRMNPQVLLPNSSRLWGSLKATLLQALQ

SEQ ID NO: 17921 - protein, 526 aa, Oryza sativa
MHRLSFLQATIIDAPLLLSSASMATVPALRLGSPAALLAARRPPRWLRCGGGGVGGGGGGVGVARRGMACSVEALARRGGGGESESENEEEEEKRRGRAGERRLRGGGSAAAAAAAAGSGELLSIPGVGPRNQRKLVDNGFEGVAQLKQLYRDKFFGKYSEKMVEFLQSSVGIIHKNHAESITSFIKESVDEELKDADSSKASQKKRLTFCVEGNISVGKSTFLQRIANETIELRDLVEIVPEPVAKWQDIGPDHFNILDAFYAEPHRYAYTFQNYVFVTRVMQERESSGGIKPLRLMERSVFSDRMVFVRAVHEANWMNEMEISIYDSWFDPVVSSLPGLIPDGFIYLRASPDTCHKRMMLRKRAEEGGVTLDYLQGLHEKHESWLLPSKGGGTGVLSVSQLPTHLEGSLPPAIRDRVFYLEGDHMHSSIQKVPALVLDCEPDIDFNKDIEAKRQYAQQVAEFFQFVKKKKEAPSEQTSTDKNRINPQIMLPHKGGLWVPDGRNPFSGSAMNLNFRRAMSSYLST

SEQ ID NO: 17922 - protein, 512 aa, Hordeum vulgare
MHRLSLLPAAASTFIDAATAPFLLPSSSMPSLRLGSPARLLAARRGPPPSLRCAGGARKGTFCTLEAASRRGGDAAGSEEERRGGDGPRAVAERRLRGVGAVAGSGELLAIPGVGPRNLRKLVDNGFEGVAHLKQLYRDKFFGKSSEKMVEFLQSSVGIIHKNHAESITSFIKESVVEELEDTNSSKPPQKKRLTFCVEGNISVGKSTFLQRIANETIELRDLVEIVPEPVAKWQDVGPDHFNILDAFYAEPQRYAYTFQNYVFVTRVMQERESSGGIKPLRLMERSVFSDRMVFVRAVHEANWMNEMEISIYDSWFDPVVSSLPGLIPDGFIYLRASPDTCHKRMMLRKRSEEGGVSLDYLQGLHEKHESWLFPSKGGGSGVLSVSQLPTHMDGSLPPGIRDRVFYLEGDHMHSSIQKVPALVLDCEPDIDFNRDIQAKRKYAQQVAEFFEFVNSKKEAPSEQTSTEKDRMNPKIMFPNRGGLWVPDGVPPFAGSAMNLDFRRAMSSYLPT

SEQ ID NO: 17923 - protein, 516 aa, Brachypodium distachyon
MHRLSLLPAAAAASTFIDAASIATAPLLLPSSMPSLRLGSPAALLAARRGPRPPPWLRCGGGGARRGMFCSVQPARREDGEAEEEKRMGAGARAAAERRLRGGNAVPGSGELLAIPGVGPRNLRKLVDNGFEGVAHLKQLYRDKFFGKSSEKMVEFLQSSVGIIHKNHAESITSFIKESVVQELEDTNSCKPPRKKRLTFCVEGNISVGKSTFLQRIANETIELRDLVEIVPEPVAKWQDVGPDHFNILDAFYAEPQRYAYTFQNYVFVTRVMQERESSGGIKPLRLMERSVFSDRMVFVRAVHEANWMNEMEISIYDSWFDPVVSSLPGLIPDGFIYLRASPDTCHKRMMLRKRSEEGGVSLDYLQGLHEKHESWLFPSKGGGRGVLSVSQLPTHMEGSLPPGIRDRVFYLEGDHMHSSIQKVPALVLDCEPDIDFNKDIQAKRQYAQQVAEFFEFVNSKKEDPSEQTSTEKDRMNPEIMFPNRSGLWVPEGVPPFAGSAMNLDFRRAMSSYLST

SEQ ID NO: 17924 - protein, 506 aa, Panicum virgatum
MHKLLPRAASILDAAAAAPLLLSSPRLPALRLACSPFLAARPGANPSGTRTSQWLRCDGQRRRGLCSTEAARRGGDTEEGEKGRAVPERRQRGRSDALAGSGELLAIPGVGPRNLRKLVDKGFDGVAQLKQLYRDKFFGKSKDRMVEFLQNSVGIIHKNHAESITLFIKESVDEELKGIDTSKLPKRRLTFCVEGNISVGKTTFLQRIANETIELRDLVEIVPEPIAKWQDVGPEHFNILDAFYAEPERYAYTFQNYVFVTRVMQEKESASGIKPLRLMERSVFSDRMVFVRAVHEANWMNEMEISIYDSWFDPVVSSLPGLIPDGFIYLRASPDTCHKRMMVRKRAEEGGVTLDYLRGLHEKHESWLLPSKGGGSGVLSVSQLPVHLEGSLPVDIRDRVFYLEGDHMHSCIQKVPALVLDCEHDIDFNKDIEAKRQYARQVAEFFEFVKKKNESSTETTDGDKSTNKQIMLPKGGGLWVPGNSPLPESALKSFDFRRTMSSFLST

SEQ ID NO: 17925 - protein, 510 aa, Sorghum bicolor
MHKLLPRAASFLDAAAPVLLSSPRMPTLCLVGSPFVPACSGANSGRIRSPPWLRCDAGRRRGLCSAEAARRGGDTEEREKGGGGGAAPQRKQRGRSDALVGSGELLAIPGVGPRNLRKLVDKGFDDVAQLKQFYRDKFFGKSNEKMVEFLQNSVGIIHKNHAESITLFIKESVDEELKGTDTSNLPKNRRLTFCVEGNISVGKTTFLQRIASETIELRDLVEIVPEPIAKWQDVGPEHFNILDAFYAEPQRYAYTFQNYVFVTRVMQEKESACGIKPLRLMERSVFSDRMVFVRAVHEANWMNEMEISIYDSWFDPVVSSLPGLIPDAFIYLRASPDTCHKRMMVRKRSEEGGVTLDYLRGLHEKHESWLLPSKGGGSGVLSVSQLPVHMEGSLPADIRDRVFYLEGDHMHSSIQKVPALVLDCEHDIDFNKDIEAKQQYARQVAEFFEFVKKKKESPTAEMTDGNNKSINKQIVLPHRGGLWVPGGSPLPESALKSFDFRRTMSSFLST

SEQ ID NO: 17926 - protein, 514 aa, Zea mays
MHKLLPRAASFLDAAAAAAAAPLLLSFPRMPTLRLSGSPFVAMRPGGNPSRIRAPPWLHCDAGWRRGLCSAEAARRGGDTEEMEKDGGGRSAPERKQRCRNDALVGRGELLTIPGVGPRNLRKLVDKGFDDVAQLKQLYRDKFFGKSNEKMIEFLQNSVGIIHKNHAESITLFIKESVDEELKGTDTSKLPKNRRLTFCIEGNISVGKTTFLQRIANETIELRDLVEIVPEPIAKWQDVGPEHFNVLDAFYAEPQRYAYTFQNYVFVTRVMQEKESACGIKPLRLMERSVFSDRMVFVRAVHEANWMNEMEISIYDSWFDPVVSSLPGLVPDGFIYLRASPDTCHKRMMVRKRSEEAGVTLDYLRGLHEKHESWLLPSKGGGSGVLSISQLPVHMEGSLHADIRDRVFYLEGDHMHSSIQKVPALILDCEHDIDFNKDIEAKRQYARQVAEFFDFVKKKKESLTAESETADGDKSINKQIVLPHGGGLWVPGSSPLPESALKSFDFRRTMSSST

SEQ ID NO: 17927 - protein, 517 aa, Brachypodium distachyon
MHKILPRAASYLDAAAGQPLLSSHMPALRLAGPFLATCSIPRTGLLRQRQRPWLRCGGGGAVARRGLCSLEAARRGDAAEEGEERVPGGGGGRISPERRQRGRGDAAMGSSGELLAIPGVGPRNQRKLVDKGFDGVAPLKELYRDKFFGKSNEKMVEFLQSSVGIIHKNHAESITLFIKESVDEELKGTDTSKPRGSKRLTFCVEGNISVGKSTFLQRIANETIELRDLVEIVPEPVAKWQDVGPDHFNILDAFYAEPQRYAYTFQNYVFVTRVMQEKESSSGIKPLRLMERSVFSDRMVFVRAVHEAKWMNEMEISIYDSWFDPVVSSLPGLIPDGFIYLRASPNTCHKRMMIRKRSEEGGVSLDYLQGLHEKHESWLLPSKGQGSGVLSVSQLPIHMEGSLHPEIRDRVFFLEGDHMHSSIQKVPALVLDCENDIDFNKDIEAKRQYARQVSEFFEFVRKKNEATVETSDGDKSISQPIKLPSRRDLWVPGGSSLPKSALNSLEFRRAMSSFLST

SEQ ID NO: 17928 - protein, 509 aa, Oryza sativa
MHRLVPRAAASFLGAPPLLTTQAGPLLAARSGPPNPSRLRLRLSPWRLLRSRRGLSCSADAAKRCGDDDAEEDGEQSVAGGGGSRPVVDRRQRSRGDAAMGSGELLAIPGVGPRNLRKLVDKGFDGVAQLKQLYRDKFFGKSNEKMVEFLQSSVGIIHKNHAESITLFIKESVDEELKGTDSPNVSKNKRLTFCVEGNISVGKTTFLQRIANETIELRDLVEIVPEPIAKWQDVGPDHFNILDAFYAEPQRYAYTFQNYVFVTRVMQEKESSSGIKPLRLMERSVFSDRMVFVRAVHEANWMNEMEISIYDSWFDPVVSSLPGLIPDGFIYLRASPDTCHKRMMVRKRSEEGGVTLDYLRGLHEKHESWLLPSKGQGSGVLSVSQVPVHMEGSLPPDIRERVFYLEGDHMHSSIQKVPALVLDCEHDIDFNKDIEAKRQYARQVAEFFEFVKKKKEDPSAESSGGDKSTNKQIMLPHRGGLWVPEGNPLPGSALNSLDFRRAMSSFLSA

SEQ ID NO: 17929 - protein, 509 aa, Oryza sativa
MHRLVPRAAASFLGAPPLLTTQAGPLLAARSGPPNPSRLRLRLSPWRLLRSRRGLSCSADAAKRCGDDDAEEDGEQSVAGGGGSRPVVDRRQRSRGDAAMGSGELLAIPGVGPRNLRKLVDKGFDGVAQLKQLYRDKFFGKSNEKMVEFLQSSVGIIHKNHAESITLFIKESVDEELKGTDSPNVSKNKRLTFCVEGNISVGKTTFLQRIANETIELRDLVEIVPEPIAKWQDVGPDHFNILDAFYAEPQRYAYTFQNYVFVTRVMQEKESSSGIKPLRLMERSVFSDRMVFVRAVHEANWMNEMEISIYDSWFDPVVSSLPGLIPDGFIYLRASPDTCHKRMMVRKRSEEGGVTLDYLRGLHEKHESWLLPSKGQGPGVLSVSQVPVHMEGSLPPDIRERVFYLEGDHMHSSIQKVPALVLDCEHDIDFNKDIEAKRQYARQVAEFFEFVKKKKEDPSAESSGGDKSTNKQIMLPHRGGLWVPEGNPLPGSALNSLDFRRAMSSFLSA

SEQ ID NO: 17930 - protein, 496 aa, Panicum virgatum
MQQEPWNAAAVGLLRPTKSAPCSPIKPAAAAMVRTHSDSFHVAHKVPVGDTPYVRAKRVQLVDKDPEKAIALFWSAINAGDRVDSALKDMAIVMKQQNRAEEAIEAIKSLRSRCSDQAQESLDNILLDLYKRCGRLDDQISLLKHKLQLIHQGHAFNGKRTKTARSQGRKFQVTLEQEATRLLGNLGWALMQKENYTEAEGAYRRALLIGPDNNKMCNLGICLMKQGRVLEAKDVLKQVRPAAVDGLRGADSHLKAYERAQEMLRDLEAKLVGRPRADQLDTSWLFDALLLGSSSSIWQPQPCIDHLLPPPAPVSAPASARRDNFADENAAMSKKLAALQANMLNVDAQPFYSLRMPPLAAKPLNTLPQQQQPHQLQKPAPVHDPLGNLKRTRSGNCMDKAGAVANKEQSTDENSGRRKSLSAEDRWPELPDHSAFDEALVADVLGPVLDEEPAATEGTNGHGKLPAICDTSPVVKEKIGKRLRIFQDITQTVNNF

SEQ ID NO: 17931 - protein, 507 aa, Panicum virgatum
MQQEPWNAAAAGLLRPTKSAPCSPIKPAAAAMARTHSDSFHVAHKVPVGDTPYVRAKRVQLVDKDPEKAIALFWSAINAGDRVDSALKDMAIVMKQQNRAEEAIEAIKSLRSRCSDQAQESLDNILLDLYKRCGRLDDQISLLKHKLQLIHQGHAFNGKRTKTSRSQGRKFQVTLEQEATRLLGNLGWALMQKENYTEAEGAYRRALLIGPDNNKMCNLGICLMKQGRMLEAKDVLKQVRPAAVDGLRGADSHLKAYERAQEMLRDLEAKLVGRPRADQLDTSWLFDALLLGSSSSIWQPQPCIDHLLPPPAPAPVSAPARRDHFADENAVMSKKLAALQANMLNVDAQPFYSLRMPSLAAKPQNTLLQQQQSQQKTQNTLLQQQQPQQKPAPVHDPLGNLKRTRSGNCMDKAGAVADKEHSTDENRGRRKSLSAEDRWPELPDHSAFDEALVAAVLAPVLDDEPAATEGRNGHGKLPASCDTSPVVKEKIGKRLRIFQDITQTVNF

SEQ ID NO: 17932 - protein, 512 aa, Sorghum bicolor
MQQEPWNAAAVGLLRPTKSAPCSPIKPAAAAAMLRTHSDSFHVAHKVPVGDTPYVRAKRVQLVDKDPEKAIALFWSAINAGDRVDSALKDMAIVMKQQNRAEEAIEAIKSLRSRCSDQAQESLDNILLDLYKRCGRLDDQISLLKHKLQLIHQGHAFNGKRTKTARSQGRKFQVTLEQEATRLLGNLGWALMQKENYTEAEGAYRRALLIGPDNNKMCNLGICLMKQGRVLEAKDVLKQVRPAAVDGLRGADSHLKAYERAQEMLRDLETKLVGRPRADQLDTNWLFDALLLGSSSSIWQPQPCIDHLLPPPAPAPASAPAPAPAPRDRFADENASVSKKLAALQANMLNVDAQPFYSLRVPPLAAKPHNTLPQQQPQQKPHNTLSQQQQQQKPAPAHDPLGNLKRTRSGNCMDKAGAVVDKEQEQSIDENSGRRKSLSAEDRWPELPDHSAFDEAIVAAVLGPVLDDEPAAAEGNGHGKLPTSCDTSPAVKEKIGKRLRIFQDITQTVNNF

SEQ ID NO: 17933 - protein, 505 aa, Zea mays
MQQEQWNAAAAGLLRPTKSAPCSPIKPAAAAAMLRTHSDSFHVAHKVPVGDTPYVRAKRVQLVDKDPEKAIALFWSAINAGDRVDSALKDMAIVMKQQNRAEEAIEAIKSLRSRCSDQAQESLDNILLDLYKRCGRLDDQISLLKHKLQRIHQGHAFNGKRTKTARSQGRKFQVTLEQEATRLLGNLGWALMQKENYTEAEGAYRRALLIGPDNNKMCNLGICLMKQGRVLEAKDVLKQVRPAGVDGLRGADSHLKAYERAQEMLRDLETKLVGRPRADQLDTNWLYDALLLGSSSSIWQPQPCIDHLLPPPAPASIPALAPAPRDHFADENAGLSKKLAALQANMLNVDAQPFYSLRVPPLAAKPHNTLPQQKPHSTLPQQQQQKKKPAPVHDPLGNLKRTRSSNCMDKAGAVVDKAQSIDENSGRRKSLSAEDRWPELPDHSAFDEALVADILGPVFDDKPTAAGTNGHGKLPASCDTSPAAKEKISKRLRIFQDITKTVNNF

SEQ ID NO: 17934 - protein, 484 aa, Zea mays
MQQEPWNAAAAMGLLRPTKSAPCSPIKPPPATMLRTHFHVAHKVPVGDTPYVRAKRVQLVDKDPEKAIALFWSAINAGDRVDSALKDMAIVMKQQNRAEEAIEAIKSLRSRCSDQAQESLDNILLDLYKRCGRLDDQISLLKHKLQLINQGHAFNGKRTKTARSQGRKFQVTLEQEATRLLGNLGWALMQKENYTEAEGAYRRALLIGPDNNKMCNLGICLMKQARVLEAKDVLKQVRPAAVDGLRGADSHLKAYERAQEMLRDLETKLIGRPPADQLDTNWLFDALLLGSSSSIWQPQPCTDHLLPPPVPAPATAPRGHFADENAGVSKKLAVLQENMLNVDAQPFYSLRVPSLAAKSHNTLPQRQQQQKPAPVHDPLGNLKRTRSGNCMDKAGAVVFKEQSIDENSGRRKSLSAEDRWPELPDHSAFDEALVAVVLAPVLDDEPTATEVKLPASCDTSPAVKEKIGKRLRIFQDITQTVNSF

SEQ ID NO: 17935 - protein, 472 aa, Echinochloa colona
AAAAAMLRTHSDSFHVAHKVPVGDTPYVRAKRVQLVDKDPEKAIALFWSAINAGDRVDSALKDMAIVMKQQNRAEEAIEAIKSLRSRCSDQAQESLDNILLDLHKRCGRLDDQISLLKHKLQLIHQGHAFNGKRTKTARSQGRKFQVTLEQEATRLLGNLGWALMQKENYTEAEGAYRQALLIGPDNNKMCNLGICLMKQGRVLEAKDVLKQVRPAAVDGLRGADSHLKAYERAQEMLRDLEAKLVGRPRADQLDTSWLFDALLLGSSSSIWQPQPCIDHLLPPPSAPAPAPAPAPARRDHFADENAASVSKKLSFLQANMLNVDAQPFYSHSLRMPPLATKPQNTQPQQQKQQKPAPVHDPLANLKRTRSGNCMDKAAAAVVDKEQSTDENSGRRKSLSAEDRWPELPDHSAFDEALVAAVLAPVLDDEPKATEGGHGKLPASCGASPLVKEKIGKRLRIFQDITQTVNNF

SEQ ID NO: 17936 - protein, 514 aa, Oryza sativa
MQQQQQQETWLAAAAAVGLRPTKSAPCSPIKPAESSASAAAAAAMLRTNSDSFHVAHKVPVGDTPYVRAKRVQLVDKDPEKAIALFWAAINAGDRVDSALKDMAIVMKQQNRAEEAIEAIKSLRSRCSDQAQESLDNILLDLYKRCGRLDDQISLLKHKLQLIHQGHAFNGKRTKTARSQGRKFQVTLEQEATRLLGNLGWALMQKENYTEAEGAYRRALLIGPDNNKMCNLGICLMKQGRVLEAKDVLKQVRPAGVDGLRGADSHLKAYERAQEMLRDLEAKLVGRRLPRAGDQLVDKSWLFDALLLGSSSSIWQPQPCIDHMLPPPPPPPRDQFADENAAAAAANKKAAATALQPNILRVDAQPFYSLRMPPLATKPQNIQQKPPTPQPQVHDPMGNLKRTRSGNAMDKAAAAAAGPVEKEPINDENSGRRKSLSAEERWPELPDHSAFDEALVAAVLAPVLDDSAAAAAERNDNCCKPAPPASCDTSPAMKEKIGKRLRIFQDITQTLNTF

SEQ ID NO: 17937 - protein, 261 aa, Panicum virgatum
MRYGEVAHFSHPQHRLRLEHHDTPFRCDGCREVGIGARFRCPHPGCDHDLHRQCALPLSPPPPPLRHPFYPRCAFAFLARAPGPRYCNACGRDVAGFVYHCRACGFDLHPCCAALPHALDAGGGVRLYLHPDSKAGVACHRCGHRGRSWSYRSHCGSFSLHVACVVDMLVESWHGVGRRKGVYDGGLVVPGAGGYRVPAIRGAAKSVHAGRGGGYASWGRKKGKVRRCCEIAGFAGQVVISAVLGDPTALIAGVIGSLIAL

SEQ ID NO: 17938 - protein, 264 aa, Panicum virgatum
MRYGEVAHFSHRQHRLRLEHHDTPFRCDGCREVGIGARFRCPHPGCDHDLHRQCALPLSPPPPPLRHPFYPRCAFAFLPRAPGPPRYCNACGCGVAGYVYHCRACGFDLHPCCAALPPALDAGGGVRLHLHPDSRAGAACHRCGHRGRSWSYRSHCGSFSLHVACVADMLVESWHGVGRHKGACGGGLVVPGGGGCSRPAPAIRGAAKSIHAGRGGGYAPWGRKKGKVKRCCEIAGFAGQVVISAVLGDPTALIAGAIGSLIAL

SEQ ID NO: 17939 - protein, 274 aa, Oryza sativa
MRYGEVVHFSHPHHRLRLEHADTPFRCDGCREVGIGARFRCPFAGCDHDLHRQCALPLSPPPPPLRHPFYPRCAFVFLARAPGAPGTRYCNACGRDVAGFVYHCRACGFDLHPCCATLPHVLDAAAGAASGGGGGGARLYLHPKATAACHRCGHRGRSWTYRSSCKSYSLHVACVMDMLVESWNGVGRHKGGVAGGGNVYDGVTVAGSGGYRVPVIRGAAKSSHASRGGSYWGRKGKVKRCCEIAGFAAQVVISAVLGDPTALIAGVIGSLIAR

SEQ ID NO: 17940 - protein, 264 aa, Zea mays
MRYGELAHLSHPQHRLRLEHAETPFRCDGCGEVGIGARFRCPHPGCDHDLHRQCALPAPAPLRHPFYPRCAFVFLARAPGGAGARYCNACGRDVAGYVYHCRACGFDLHPCCAALPHALDAGAGVRLHLHPDTGSGAACHRCGHRGRGWSYRSQCRCYSLHVACVMDMLVESWHSVGRQKGDQGMAGHVVVPGSGGYWVPAMIRGAAKSSHASGGGRYSYWGKHKGKAKRCCEIAGFAAQVVISAVLGDPTALIAGAIGSLIAR

SEQ ID NO: 17941 - protein, 1263 aa, Panicum virgatum
MAESAAADGKAANGAGGGGDAAGDGKKRVDQAVAFHELFWFADKWDLMLMAAGSLGALAHGAAMPLFFLLFGDLINGFGKNQTDLRTMTDEVAKYALYFVYLGLVVCVSSYAEIACWMYTGERQVIALRKAYLDAVLRQDVGFFDTDARTGDIVFGVSTDTLLVQDAIGEKVGNFIHYIATFLAGLVVGFVAAWRLALLSVAVIPAIAFAGGLYAYTLTGLTSKSRESYANAGVVAEQAIAQVRTVYSFVGESKALNSYSEAIQNTLKLGYKAGMAKGLGIGCTYGIACMSWALVFWYAGVFIRNGQTDGGNAFTAIFSAIVGGMSLGQAFSNLGAFSKGKIAGYKLLEVIRQKPSIVNDHKDGKWLAEVHGNIEFKEVTFSYPSRPDVMIFRDFSLFFPAGKTVAVVGGSGSGKSTVVALIERFYDPNEGQVLLDNVDIKTLQLRWLRDQIGLVNQEPALFATTILENILYGKPDATIAEVEAAATASNAHSFISLLPNGYNTMVGERGIQLSGGQKQRIAIARAMLKNPKILLLDEATSALDADSESIVQEALDRLMVGRTTVVVAHRLFTIRNVNMIAVIQQGQVVETGTHDELLAKGSTGAYASLVRFQESTWNRDLGGASTRRSRSMHLTSSLSTKSLSLRSGSLRNLSYQYSTGADGRIEMISNADNDRKYPAPRGYFLKLLKLNAPEWPYAVLGAIGSVLSGFIGPTFAIVMGEMLDVFYYRDPNEMEKKTKLYVFIYIGTGIYAVVAYLVQHYFFSIMGENLTTRVRRMMLSAILRNEVGWFDEEENNSSLVAARLAVDAADVKSAIAERISVILQNMTSLMTSFVVGFIIEWRVALLILATFPLLVLANFAQQISMKGFAGDTAKAHAKSSMVAGEGVSNIRTVAAFNAQSKILSLFSHELRIPEQQILRRSQTSGLLFGLSQLCLYSSEALILWYGSHLVRSHGSTFSKVIKVFVVLVVTANSVAETVSLAPEIVRGGESIRSIFGILDRATRIEPDDPESERVTAIRGDIELRHVDFAYPARPDIQIFKDFNLKIQAGRSQALVGASGSGKSTVIALIERFYDPTGGKVSIDGKDIRRLNLKSLRLKIGLVQQEPVLFAASILENIAYGKDGATQEEVIEAAKTANVHGFVSQLPDGYKTAVGERGVQLSGGQKQRIAIARAVLKDPAILLLDEATSALDAESECVLQEALERLMKGRTTVLVAHRLSTIRGVDRIAVVQDGRIVEHGSHSELLTRPEGAYSRLLQLQHHRV

SEQ ID NO: 17942 - protein, 1266 aa, Sorghum bicolor
MAETAAADGKADKVANGGGGGGDAAGEGKKRGDQAVAFHELFSFADKWDLMLMAAGSLGALAHGAAMPFFFLLFGDLINGFGKNQTDLRTMTDEVAKYALYFVYLGLVVCVSSYAEIACWMYTGERQVIALRKAYLDAVLRQDVGFFDTDARTGDIVFGVSTDTLLVQDAIGEKVGNFMHYIATFLAGLVVGFVSAWRLALLSVAVIPAIAFAGGLYAYTLTGLTSKSRESYANAGVVAEQAIAQVRTVYSFVGESKALNSYSEAIQNTLKLGYKAGMAKGLGIGCTYGIACMSWALVFWYAGVFIRNGQTDGGKAFTAIFSAIVGGMSLGQAFSNLGAFSKGKIAGYKLLEVIRQKPSIVNDHKDGKWLAEVHGNIEFKEVTFSYPSRPDVIIFRDFSLFFPAGKTVAVVGGSGSGKSTVVALIERFYDPNEGQVLLDNVDIKTLQLRWLRDQIGLVNQEPALFATTILENILYGKPDATIAEVEAAATASNAHGFISLLPNGYNTMVGERGIQLSGGQKQRIAIARAMLKNPKILLLDEATSALDADSESIVQEALDRLMVGRTTVVVAHRLSTIRNVNMIAVIQQGQVVETGTHDELLAKGTSGAYASLVRFQETARNRDLAGASTRRSRSIHLTSSLSTKSLSLRSGSLRNLSYQYSTGADGRIEMISNADNDRKYPAPRGYFFKLLKLNAPEWPYAVLGAIGSVLSGFIGPTFAIVMGEMLDVFYYRDPNEMEKKTKLYVFIYIGTGIYAVVAYLVQHYFFSIMGENLTTRVRRMMLSAILRNEVGWFDEEENNSSLVAARLAVDAADVKSAIAERISVILQNMTSLMTSFVVGFIIEWRVAILILATFPLLVLANFAQQLSMKGFAGDTAKAHAKSSMVAGEGVSNIRTVAAFNAQSKILSLFSHELRVPEQQILRRSQTSGLLFGLSQLCLYSSEALILWYGSHLVRSHGSTFSKVIKVFVVLVVTANSVAETVSLAPEIIRGGESIRSIFGILNRATRIEPDDPESERVTTIRGDIELRHVDFSYPARPDIQIFKDFNLKIHAGRSQALVGASGSGKSTVIALIERFYDPCGGKVAIDGKDIRTLNLKSLRLKIGLVQQEPVLFASSILENIAYGKEGATEEEVIEAAKTANVHGFVSQLPDGYKTAVGERGMQLSGGQKQRIAIARAVLKDPAILLLDEATSALDAESECVLQEALERLMKGRTTVLVAHRLSTIRGVDRIAVVQDGRIVEHGSHNDLLARPEGAYSRLLQLQHHRV

SEQ ID NO: 17943 - protein, 1266 aa, Zea mays
MAESAATDGKADKVANGGGGGGDAAGEGKKRGDQAVAFHELFSFADKWDLMLMAAGSLGALAHGAAMPFFFLLFGDLINGFGKNQTDLRTMTDEVAKYALYFVYLGLVVCVSSYAEIACWMYTGERQVIALRKAYLDAVLRQDVGFFDTDARTGDIVFGVSTDTLLVQDAIGEKVGNFMHYIATFLAGLVVGFVSAWRLALLSVAVIPAIAFAGGLYAYTLTGLTSKSRESYTNAGVVAEQAIAQVRTVYSFVGESKALNSYSEAIQNTLKLGYKAGMAKGLGIGCTYGIACMSWALVFWYAGVFIRNGQSDGGKAFTAIFSAIVGGMSLGQAFSNLGAFSKGKIAGYKLLEVIRQKPSIVNDHKDGKWLAEVHGNIEFKEVTFSYPSRPDVIIFRDFSLFFPAGKTVAVVGGSGSGKSTVVALIERFYDPNEGQVLLDNVDIKTLQLRWLRDQIGLVNQEPALFATTILENILYGKPDATIAEVEAATTASNAHSFICLLPNGYNTMVGERGIQLSGGQKQRIAIARAMLKNPKILLLDEATSALDADSESIVQEALDRLMVGRTTVVVAHRLSTIRNVNMIAVIQQGQVVETGTHDELLAKGTSGAYASLIRFQETARNRDLGGASSRRSRSIHLTSSLSTKSLSLRSGSLRNLSYQYSTGADGRIEMISNADNDRKYPAPRGYFFKLLKLNAPEWPYAVLGAIGSVLSGFIGPTFAIVMGEMLDVFYYRDPNEMEKKTKLYVFIYIGTGIYAVVAYLVQHYFFSIMGENLTTRVRRMMLSAILRNEVGWFDEEENNSSLVAAHLAVDAADVKSAIAERISVILQNMTSLMTSFVVGFIIEWRVAILILATFPLLVLANFAQQLSMKGFAGDTAKAHAKSSMVAGEGVSNIRTVAAFNAQSKILSLFSHELRVPEQQILRRSQTSGLLFGLSQLCLYSSEALILWYGSHLVRSHGSTFSKVIKVFVVLVVTANSVAETVSLAPEIIRGGESIRSIFGILNRATRIEPDDPESERVTTIRGDIELRHVDFSYPARPDIQIFKDFNLKIQAGRSQALVGASGSGKSTIIALIERFYDPCGGKVAIDGKDIRTLNLKSLRRKIGLVQQEPVLFASSILENIAYGKEGASEEEVVEAAKTANVHGFVSQLPDGYRTAVGERGMQLSGGQKQRIAIARAVLKDPAILLLDEATSALDAESECVLQEALERLMKGRTTVLVAHRLSTIRGVDRIAVVQDGRVVEHGSHSDLLARPEGAYSRLLQLQHHRV

SEQ ID NO: 17944 - protein, 1268 aa, Oryza sativa
MAESAAAAAGDGKVEKAANGGVNGCDAAGEGKKRADQAVAFHELFTFADKWDLVLMAAGSLGALAHGAAMPLFFLLFGDLINGFGKNQTDLRTMTDEVSKYALYFVYLGLVVCASSYAEIACWMYTGERQVIALRKAYLDAVLRQDVGFFDTDARTGDIVFGVSTDTLLVQDAIGEKVGNFIHYIATFLAGLVVGFVAAWRLALLSVAVIPAIAFAGGLYAYTLTGLTSKSRESYANAGVVAEQAIAQVRTVYSFAGESKALNSYSEAIQNTLKLGYKAGMAKGLGIGCTYGIACMSWALVFWYAGVFIRNGQTDGGKAFTAIFSAIVGGMSLGQAFSNLGAFSKGKIAGYKLLEVIRQKPSIVHDHKDGKLLAEVHGNIEFKDVTFSYPSRPDVMIFRDFSLFFPAAKTVAVVGGSGSGKSTVVALIERFYDPNEGQVLLDNVDIKTLQLRWLRDQIGLVNQEPALFATTIHENILYGKPDATMAEVEAAATASNAHSFISTLPNGYNTMVGERGIQLSGGQKQRIAIARAMLKNPKILLLDEATSALDAGSENIVQEALDRLMTGRTTVVVAHRLSTIRNVNMIAVIQQGQVVETGTHDELLAKGSSGAYASLIRFQEMAQNRDLGGASTRRSRSMHLTSSLSTKSLSLRSGSLRNLSYQYSTGANGRIEMISNADNDRKYPAPRGYFFKLLKLNAPEWPYAVLGAVGSVLSGFIGPTFAIVMGEMLDVFYYRDPNEMEKKTKLYVFIYIGTGLYAVVAYLVQHYFFSIMGENLTTRVRRMMLSAILTNEVGWFDEEENNSSLVAARLAVDAADVKSAIAERISVILQNMTSLMTSFIVGFIIEWRVALLILATFPLLVLANFAQQLSMKGFAGDTAKAHAKSSMVAGEGVSNIRTVAAFNAQNKILSLFSYELRIPEQQILRRSQTSGLLFGLSQLCLYSSEALILWYGSHLVRSHGSTFSKVIKVFVVLVVTANSVAETVSLAPEIVRGGESIRSIFGILNRATRIEPDDPESERVTNVRGDIELRHVDFAYPARPDIQIFKDFNLKIQAGRSQALVGASGSGKSTVIALIERFYDPTGGKVTIDGKDIRRLNLKALRLKIGLVQQEPVLFAASILENIAYGKDGATEEEVIQAAKTANVHGFVSQLPNGYKTAVGERGVQLSGGQKQRIAIARAVLKDPAILLLDEATSALDAESECVLQEALERLMKGRTTVLVAHRLSTIRGVDRIAVVQDGRIVEHGSHSDLVSRPEGAYSRLLQLQHHA

SEQ ID NO: 17945 - protein, 1268 aa, Oryza sativa
MAESAAAAAGDGKVEKAANGGVNGCDAAGEGKKRADQAVAFHELFTFADKWDLVLMAAGSLGALAHGAAMPLFFLLFGDLINGFGKNQTDLRTMTDEVSKYALYFVYLGLVVCASSYAEIACWMYTGERQVIALRKAYLDAVLRQDVGFFDTDARTGDIVFGVSTDTLLVQDAIGEKVGNFIHYIATFLAGLVVGFVAAWRLALLSVAVIPAIAFAGGLYAYTLTGLTSKSRESYANAGVVAEQAIAQVRTVYSFAGESKALNSYSEAIQNTLKLGYKAGMAKGLGIGCTYGIACMSWALVFWYAGVFIRNGQTDGGKAFTAIFSAIVGGMSLGQAFSNLGAFSKGKIAGYKLLEVIRQKPSIIHDHKDGKLLAEVHGNIEFKDVTFSYPSRPDVMIFRDFSLFFPAAKTVAVVGGSGSGKSTVVALIERFYDPNEGQVLLDNVDIKTLQLRWLRDQIGLVNQEPALFATTIHENILYGKPDATMAEVEAAATASNAHSFISTLPNGYNTMVGERGIQLSGGQKQRIAIARAMLKNPKILLLDEATSALDAGSENIVQEALDRLMTGRTTVVVAHRLSTIRNVNMIAVIQQGQVVETGTHDELLAKGSSGAYASLIRFQEMAQNRDLGGASTRRSRSMHLTSSLSTKSLSLRSGSLRNLSYQYSTGADGRIEMISNADNDRKYPAPRGYFFKLLKLNAPEWPYAVLGAVGSVLSGFIGPTFAIVMGEMLDVFYYRDPNEMEKKTKLYVFIYIGTGLYAVVAYLVQHYFFSIMGENLTTRVRRMMLSAILTNEVGWFDEEENNSSLVAARLAVDAADVKSAIAERISVILQNMTSLMTSFIVGFIIEWRVALLILATFPLLVLANFAQQLSMKGFAGDTAKAHAKSSMVAGEGVSNIRTVAAFNAQNKILSLFSYELRIPEQQILRRSQTSGLLFGLSQLCLYSSEALILWYGSHLVRSHGSTFSKVIKVFVVLVVTANSVAETVSLAPEIVRGGESIRSIFGILNRATRIEPDDPESERVTNVRGDIELRHVDFAYPARPDIQIFKDFNLKIQAGRSQALVGASGSGKSTVIALIERFYDPTGGKVTIDGKDIRRLNLKALRLKIGLVQQEPVLFAASILENIAYGKDGATEEEVIQAAKTANVHGFVSQLPNGYKTAVGERGVQLSGGQKQRIAIARAVLKDPAILLLDEATSALDAESECVLQEALERLMKGRTTVLVAHRLSTIRGVDRIAVVQDGRIVEHGSHSDLVSRPEGAYSRLLQLQHHA

SEQ ID NO: 17946 - protein, 1270 aa, Hordeum vulgare
MADPAAAEKMEKAANGSAAGGCDAAAPAAGQGKKRADQAVAFHELFSFADRWDLALMSLGTVGALAHGAAMPCFFLLFGDLINGFGKNQTDLRTMTDEVAKYALYFVYLGLVVCVASYAEIACWMYTGERQVIALRKAYLDAVLRQDVGFFDTDARTGDIVFGVSTDTLLVQDAIGEKVGNFMHYLATFFAGLVVGFVSAWRLALLSVAVIPAIAFAGGLYAYTLTGLTSKSRESYANAGVVAEQAIAQVRTVYSFVGESKALNSYSEAIQNTLKLGYKAGMAKGLGIGCTYGIACMSWALVFWYAGVFIRNGQSDGGKAFTAIFSAIVGGMSLGQAFSNLGAFSKGKIAGYKLLEVIRQKPSIVHDHKDGKLLAEVHGNIEFKDVTFSYPSRPDAMIFRDFSLFFPAGKTVAVVGGSGSGKSTVVALIERFYDPNEGQVLLDNVDIKTLQLRWLRDQIGLVNQEPALFATTIIENILYGKPDATIAEVEAAATASNAHSFISLLPNGYNTMVGERGIQLSGGQKQRIAIARAMLKDPKILLLDEATSALDADSENIVQEALDRLMVGRTTVIVAHRLCTIRNVNMIAVLQQGQVVETGTHDELLAKGSSGAYASLIRFQETARNRDLGAASTRRSRSMHLTSSLSTKSLSLRSGSLRNLSYQYSTGADGRIEMISSADNSLKYPAPRGYFFKLLKLNAPEWPYAVLGAIGSVLSGFIGPTFAIVMGEMLDVFYYKDPVEMEKKTKLYVFIYIGTGIYAVVAYLVQHYFFSIMGENLTTRVRRMMLSAILRNEVGWFDEEENNSSLVAARVAVDAADVKSAIAERISVILQNITSLMTSFVVGFIIEWRVAILILATFPLLVLANFAQQLSMKGFAGDTAKAHAKSSMVAGEGVSNIRTVAAFNAQNKVMSLFSHELRIPEEQILRRSQTAGLLYGLSQLCLYCSEALILWYGSHLVRSHGSTFSKVIKVFVVLVVTANSVAETVSLAPEIIRGGESIRSIFGILNRATRIEPDDPEAERVTTVRGDIELRHVDFSYPSRPDIEIFKDFNLKIQAGRSQALVGASGSGKSTVIALIERFYDPTGGKVMIDGKDIRRLNLKSLRRKIGLVQQEPVLFASSILENIAYGKEGATEEEVIDAAKTANVHAFVSQLPDGYRTAVGERGVQLSGGQKQRIAIARAVLKDPAILLLDEATSALDAESESVLQEALERLMKGRTTVLVAHRLSTIRGVDRIAVVQDGRVVEHGGHSELVARPEGAYSRLLQLQNHRN

SEQ ID NO: 17947 - protein, 1214 aa, Zea mays
MAAGSMGALAHGAAMPFFFLLFGDLINGFGKNQTDLRTMTDEVAKYALYFVYLGLVVCVSSYAEIACWMYTGERQVIALRKAYLDAVLRQDVGFFDTDARTGDIVFGVSTDTLLVQDGIGEKVGNFMHYIATFLAGLVVGFVSAWRLALLSVAVIPAIAFAGGLYAYTLTGLTSKSRESYANAGVVAEQAIGQVRTVYSFVGESKALNSYSEAIQNTLKLGYKAGMAKGLGIGCTYGIACMSWALVFWYAGVFIRNGQTDGGKAFTAIFSAIVGGMSLGQAFSNLGAFSKGKIAGYKLLEVIRQKPSIVNDHKDGKWLAEVHGNIEFKEVTFSYPSRPDVIIFRDFSLFFPAGKTVAVVGGSGSGKSTVVALIERFYDPNEGQVLLDNVDIKTLQLRWLREQIGLVNQEPALFATTILENILYGKPDATIAEVEAAATASNAHSFISLLPNGYNTMAGERGIQLSGGQKQRIAIARAMLKNPKILLLDEATSALDADSESIVQEALDRLMVGRTTVVVAHRLSTIRNVNMIAVIQQGQVVETGTHDELIAKGTSGAYASLVRFQETARNRDLGGASSRRSRSIHLTSSLSTKSLSLRSGSLKNLSYQYSTGADGRIEMISNADNDRKYPAPRGYFFKLLKLNAPEWPYAVLGAIGSVLSGFIGPTFAIVMGEMLDVFYYRDPNEIEKKTKLYVFIYIGTGIYAVVAYLVQHYFFSIMGENLTTRVRRMMLSAILRNEVGWFDEEENNSSLVAARLGVDAADVKSAIAERISVILQNMTSLMTSFVVGFIIEWRVAILILATFPLLVLANFAQQLSMKGFAGDTAKAHARSSMVAGEAVSNIRTVAAFNAQSKILSLFSHELRVPEQQILRRSQTSGLLFGLSQLCLYSSEALILWYGSHLVRSHGSTFSKVIKVFVVLVVTANSVAETVSLAPEIIRGGESIRSIFGILNRATRIEPDDPESERVTTIRGDIELRHVDFSYPARPDIQIFKDFNLKIQAGRSQALVGASGSGKSTVIALIERFYDPCGGKVAIDGKDIRTLNLKSLRLKIGLVQQEPVLFASSILENIAYGKEGASEEEVVEAAKTANVHGFVSQLPDGYRTAVGEQGMQLSGGQKQRIAIARAVLKDPAILLLDEATSALDAESECVLQEALERLMKGRTTVLVAHRLSTIRGVDRIAVVQDGRVVEHGSHSDLLARPEGAYLRLLQLQHHRV

SEQ ID NO: 17948 - protein, 1214 aa, Brachypodium distachyon
MAAGSLGALAHGAAMPCFFLLFGDLINGFGKNQTDLRTMTDEVAKYALYFVYLGLVVCVASYSEIACWMYTGERQVIALRKAYLDAVLRQDVGFFDTDARTGDIVFGVSTDTLLVQDAIGEKVGNFIHYLATFFAGLVVGFVSAWRLALLSVAVIPAIAFAGGLYAYTLTGLTSRSRESYANAGVVAEQAIAQVRTVYSFVGESKALNSYSEAIQNTLKLGYKAGMAKGLGIGCTYGIACMSWALVFWYAGVFIRNGQSDGGKAFTAIFSAIVGGMSLGQAFSNLGAFSKGKIAGYKLLEVIRQKPSIVNDHKDGKLLAEVHGNIEFKDVIFSYPSRPDVMIFRDFSLFFPAGKTVAVVGGSGSGKSTVVALIERFYDPNEGQVLLDNVDIKTLQLRWLRDQIGLVNQEPALFATTILENILYGKPDATIAEVEAAATASNAHSFISLLPNGYNTMVGERGIQLSGGQKQRIAIARAMLKDPKILLLDEATSALDADSESIVQEALDRLMVGRTTVVVAHRLSTIRNVNMIAVIQQGQVVETGTHDELVVKGSSGAYASLIRFQEMARNRDLAAASTRRSRSMHLTSSLSTKSLSLRSGSLRNLSYQYSTGADGRIEMISNADNSLKYPAPRGYFFKLLKLNAPEWPYAVLGAIGSVLSGFIGPTFAIVMGEMLDVFYYKDPNEMEKKTKLYVFIYIGTGIYAVVAYLVQHYFFSIMGENLTTRVRRMMLSAILRNEVGWFDEEENNSSLVAARVAVDAADVKSAIAERISVILQNITSLMTSFIVGFVIEWRVALLILATFPLLVLANFAQQLSMKGFAGDTAKAHAKSSMVAGEGVSNIRTVAAFNAQNKIMSLFSHELRIPEEQILRRSQTAGLLYGLSQLCLYCSEALILWYGSHLVRAHGSTFSKVIKVFVVLVVTANSVAETVSLAPEIIRGGESIRSIFGILNRATRIEPDDPESERVTTVRGDIELRHVDFSYPSRPDIEIFKDFNLKIQAGRSQALVGASGSGKSTVIALIERFYDPTGGKVMIDGKDIRRLNLKSLRLKIGLVQQEPVLFASSILENIAYGKEGATEEEVIEAAKTANVHTFVSQLPDGYKTAVGERGVQLSGGQKQRIAIARAVLKDPAILLLDEATSALDAESECVLQEALERLMKGRTTVLVAHRLSTIRGVDRIAVVQDGRIVEHGGHSELVARPEGAYSRLLQLQQHRN

SEQ ID NO: 17949 - protein, 1242 aa, Ananas comosus
GEGEKKRQEQSLAFHELFSFADKWDWMLMAAGSVGAVVHGSAMPVFFLFFGDLVNGFGKNQYNLRKMTDEVSKYALYFVYLGLVVCVSSYAEIACWMYTGERQVIALRKRYLEAVLRQDVGFFDTDARTGDIVFSVSTDTLLVQDAISEKVGNFIHYLSTFLAGLVVGFISAWRLALLSVAVIPGIAFAGGLYAYTLTGLTSKSRESYANAGIIAEQAIAQVRTVYSFVGESKALNSYSEAIQNTLKLGYKAGMAKGLGIGCTYGIACMSWALVFWYAGVFIRNGQTDGGKAFTAIFSAIVGGMSLGQSFSNLGAFSKGKTAGYKLLEIIRQKPSIIQDQEDGKCLAEVHGNIEFKEVTFSYPSRPDVIIFRDFSLFFPAGKTAAVVGGSGSGKSTVVALIERFYDPNQGQVLLDNVDIKTLQLRWLRDQIGLVNQEPALFATTILENILYGKPDATMAEVEAAASASNAHSFIALLPNGYNTQVGERGVQLSGGQKQRIAIARAMLKNPKILLLDEATSALDAGSESIVQEALDRLMVGRTTVVVAHRLSTIRNVDMIAVIQQGQVVETGTHEELLAKGSSGAYASLIRFQEMARNRDFGGPSTRRSRSSRLSHSLSTKSLSLRSGSLRNLSYQYSTGADGRIEMVSNADNDRKYPAPRGYFFKLLKLNAPEWPYTILGAIGSVLSGFIGPTFALVMSNMIEVFYYRDPNAMERKIKKYVFIYIGTGLYAVGAYLVQHYFFSIMGENLTTRVRRMMLAAIFRNEVGWFDEEENNSSLVAARLATDAADVKSAIAERISVILQNMTSLLASFIVGFVVEWRVALLILATFPLLVLANFAQQLSMKGFAGDTAKAHAKTSMIAGEGVSNIRTVAAFNAQDKILSLFRQELHVPQKRSLRRSQTSGLLFGLSQLCLYASEALILWYGAHLVRSHVSTFSKVIKVFVVLVITANSVAETVSLAPEIIRGGESIRSVFSILNRGTRIDPDEPESEPVDSIRGEIELRHVDFAYPSRPDLQIFKDFNLRIRAGQSQALVGASGSGKSTVISLIERFYDPTAGKVMIDGKDIRRLNLKSLRLKIGLVQQEPVLFAASIMENIAYGKDSATEEELIEAAKAANVHGFVSQLPEGYKTAVGERGVQLSGGQKQRIAIARAVLKDPTILLLDEATSALDAESECVLQEALERLMKGRTTVLVAHRLSTIRGVDCIGVVQDGRIVEQGSHSELVARPDGVYSRLLQLQNHHV

SEQ ID NO: 17950 - protein, 1242 aa, Cocos nucifera
LFLEKKRQEQSVAFYELFTFADRYDLALMAAGSLGAVVHGSAMPVFFLLFGDLVNGFGKNQADLGKMTNEVSKYALYFVYLGLIVCLSSYAEIACWMYTGERQVGTFRRRYLEAVLKQDVGFFDTDARTGDIVFSVSTDTLLVQDAISEKVGNFIHYLSTFLAGLVVGFISAWRLALLSVAVIPGIAFAGGLYAYTLTGLTSKGRESYANAGIIAEQAIAQVRTVYSFVGESKALTSYSEAIQNTLKLGYKAGMAKGLGIGCTYGIACMSWALVFWYAGVFIRNGQTDGGKAFTAIFSAIVGGMSLGQAFSNLGAFSKGKIAGYKLMEIIRQKPSITQEPSDGKCLAEVHGNIEFKDVTFSYPSRPDVIIFRDFSLFFPAGKTAAVVGGSGSGKSTVVALIERFYDPNQGQVLLDNADIKTLQLKWLREQIGLVNQEPALFATTILENILYGKPDATIAEIEAAASAANAHSFISLLPNGYNTQAGERGVQLSGGQKQRIAIARAMLKNPKILLLDEATSALDAGSESIVQEALDRLMVGRTTVVVAHRLSTIKNVDMIAVIQQGQVVETGTHEELLAKGSSGAYASLIRFQEMARNRDFGAPSTRRSRSSRLSHSLSTKSLSLRSGSLRNLSYQYSTGADGRIEMVSNADNDRKYPAPRGYFFKLLKLNAPEWPYSILGAIGSVLSGFIGPTFAIVMSNMIEVFYYRDPNAMERKTREYVFIYIGTGLYAVVAYLVQHYFFSIMGENLTTRVRRMMLAAILRNEVGWFDEDENNSSLLAARLATDAADVKSAIAERISVILQNMTSLLTSFIVGFIVEWRVALLILATFPLLVLANFAQQLSLKGFAGDTAKAHAKTSMIAGEGVSNIRTVAAFNAQEKILSLFHHELRVPQRRSLRRSQTSGLLFGVSQLSLYSSEALILWYGAHLVRSGASTFSKVIKVFVVLVITANSVAETVSLAPEIIRGGESIRSVFSILNRATRIDPDDPEAEPVESIRGEIELRHVDFAYPSRPDVPIFKDFNLRIRAGQSQALVGASGSGKSTVVALIERFYDPTAGKVMIDGKDVRRLNLKSLRLKIGLVQQEPALFAASIFENIAYGKDGAAEEEVVEAARAANVHGFVSALPEGYKTAVGERGVQLSGGQKQRIAIARAVLKDPAVLLLDEATSALDAESECVLQEALERLMRGRTTILVAHRLSTIRGVDSIAVVQDGRIVEQGSHSELVARADGAYSRLLQLQHHHV

SEQ ID NO: 17951 - protein, 1258 aa, Setaria italica
MAEDAGKAEAGSCSGGGGCEAVKKRPEQSVAFHELFGFADPLDWLLMAAGSAGAVVHGAAMPVFFLLFGELVNGFGKNQHNLRRMTDEVSKYSLYFVYLGLVVCASSYLEIACWMYTGERQVGALRRRYLEAVLRQDVGFFDTDARTGDVVFSVSTDTLLVQDAIGEKVGNFIHYLATFLAGLVVGFVSAWRLALLSIAVIPGIAFAGGLYAYTLTGLTSKSRDSYANAGIIAEQAIAQVRTVYSYVGETKALNSYSEAIQNTLKLGYKAGMAKGLGIGCTYGIACMSWALVFWYAGVFIRNGQTDGGKAFTAIFSAIVGGLSLGQSFSNLGAFSKGKIAGYKLLEVIRQRPTIVQDTADGRCLDEVHGNIEFKEVAFSYPSRPDVMIFRDFSLFFPAGKTAAVVGGSGSGKSTVVALIERFYDPNQGQVLLDNVDIKTLQLKWLRDQIGLVNQEPALFATTILENILYGKPDATMAEVEAAATSANAHSFIALLPNGYNTHVGERGLQLSGGQKQRIAIARAMLKNPKILLLDEATSALDAGSESIVQEALDRLMVGRTTVVVAHRLSTIRCVDMIAVIQQGQVVETGTHDELLAKGSSGAYAALIRFQETARNRACPSTRKSRSSRLSNSLSTRSLSLRSGSLRNLSYSYSTGADGRIEMVSNADNDRKYPAPRGYFFKLLKLNAPEWPYTILGAIGSILSGFIGPTFAIVMSNMIEVFYYRNPNKMESKTREYVFIYIGTGLYAVVAYLVQHYFFSIMGENLTTRVRRMMLAVILRNDVGWFDQEENNSSLVAARLATDAADVKSAIAERISVILQNMTSLLVSFVVGFIIEWRVALLILITFPLLVLANFAQQLSMKGFAGDTAKAHAKTSMIAGEGVSNIRTVAAFNAQDKILSLFCGELRVPQMYSLRRSQISGALFGLSQLSLYASEALILWFGAHLVRTHVSTFSKVIKVFVVLVITANSVAETVSLAPEIVRGGESIRSVFAILNSRTRIDPDEPDTEQVESVRGEIDFRHVDFAYPTRPDVMVFKDFSLRIRAGQSQALVGASGSGKSTVIALIERFYDPLAGKVMIDGRDIRRLNLKSLRLKIGLVQQEPVLFATSILENIAYGKDGATEEEVVEAAKAANVHGFVSALPDGYRTPVGERGVQLSGGQKQRIAIARAVLKDPAVLLLDEATSALDAESECVLQEALERIMKGRTAVLVAHRLSTIRGVDSIAVVQDGRVVEQGSHGDLVSRPDGAYSRLLQLQLHHG

SEQ ID NO: 17952 - protein, 1276 aa, Musa acuminata
MADAGDGKTAAAAGDGGEKKRQEQSAAFHELFSFADRWDCLLMAAGSVGAVVHGSAMPVFFLLFGDLVNGFGKNQTHLSVMTHEVSKYALYFVYLGLVVCLSSYAEIGCWMYTGERQASALRRRYLEAVLRQDVGFFDTDARTGDIVFSVSTDTLLVQDAISEKVAPPPRLSLCHHDLLLQCEQVGNFIHYLSTFLAGLVVGFISAWRLALLSVAVIPGIAFAGGLYAYTLTGLTSKSRESYANAGIVAEQTIAQVRTVYSFVGENKALNSYSEAIQNTLKLGYKAGMAKGLGIGCTYGIACMSWALVFWYAGVFIRNGQTDGGKAFTAIFSAIVGGMSLGQSFSNLGAFSKGKAAGYKLLEIIRQKPSIIQDQSDGKCLEEVHGNIEFKDVTFSYPSRPDVIIFRDFSLFFPAGKTVAVVGGSGSGKSTVVALIERFYDPNQGLVLLDNVDIKTLQLKWLREQIGLVNQEPALFATTILENILYGKPDATIGEVEAAASAANAHSFISQLPSAYNTQVGERGVQLSGGQKQRIAIARAMLKNPKILLLDEATSALDAGSESIVQEALDRLMVGRTTVVVAHRLSTIRNVDMIAVIQQGQVVETGAHEDLLAKGSSGAYASLIRFQEMARNRDFGGPSTRRSRSSRLSHSLSTKSLSLRSGSLRNLSYQYSTGADGRIEMVSNADNVRKYPAPRGYFFKLLKLNAPEWPYTIMGAIGSVLSGFIGPTFAIVMSNMIEVFYYRDPNAMERKTREYVFIYIGTGLYAVVAYLVQHYFFSIMGENLTTRVRRMMLAAILRNEVGWFDEEENNSSLVAARLANDAADVKSAIAERISVILQNMTSLLTSFIVGFVVEWRVALLILATFPLLVLANFAQQLSLKGFAGDTAKAHAKTSMIAGEGVSNIRTVAAFNAQAKILSLFCNELRIPQRRSFRRSQTSGILYGLSQLSLYASEALILWYGAHLVRSGASTFSKVIKVFVVLVVTANSVAETVSLAPEIVRGGESIRSVFAILNRGTRVEPDDPEAEHVDSVRGEIELRHVDFAYPSRPDVPIFKDFNLRIRAGQSHALVGASGSGKSTVIALIERFYDPTAGKVLIDGKDIKRLNLKSLRLKIGLVQQEPVLFAASIMENIAYGKDGATEEEVIEAARAANVHGFVSALPDGYKTAVGERGVQLSGGQKQRIAIARAVLKDPAVLLLDEATSALDAESECVLQEALERLMKGRTTVLVAHRLSTIRGVDSIGVVQEGRIVEQGSHSELVARPDGAYSRLLQLQHYHV

SEQ ID NO: 17953 - protein, 1259 aa, Oryza sativa
MADESGSCGGGGGGGGGCEAVKKRVDQSVAFHELFGFADPLDWLLMAAGSAGAVVHGAAMPVFFLLFGELINGFGKNQHSLRRMTDEVSKYSLYFVYLGLVVCASSYLEIACWMYTGERQVGALRRRYLEAVLRQDVGFFDTDARTGDVVFSVSTDTLLVQDAIGEKVGNFIHYLSTFLAGLVVGFVSAWRLALLSIAVIPGIAFAGGLYAYTLTGLTSKSRDSYANAGIIAEQAIAQVRTVYSYVGESKALNSYSEAIQNTLKLGYKAGMAKGLGIGCTYGIACMSWALVFWYAGVFIRNGQTDGGKAFTAIFSAIVGGLSLGQSFSNLGAFSKGKIAGYKLLEVIRQRPTIVQDPADGRCLDEVHGNIEFKEVAFSYPSRPDVMIFRDFSLFFPAGKTAAVVGGSGSGKSTVVALIERFYDPNQGQVLLDNVDIKTLQLKWLRDQIGLVNQEPALFATTILENILYGKPDATMAEVEAAATSANAHSFIALLPNGYNTQVGERGLQLSGGQKQRIAIARAMLKNPKILLLDEATSALDAGSENIVQEALDRLMVGRTTVVVAHRLSTIRCVDMIAVIQQGQVVETGTHDELLAKGSSGAYAALIRFQEMARNRDFRGPSTRKSRSSRLSNSLSTRSLSLRSGSLRNLSYSYSTGADGRIEMVSNADNDRKYPAPKGYFFKLLKLNAPEWPYTILGAIGSILSGFIGPTFAIVMSNMIEVFYFRDPNAMERKTREYVFIYIGTGLYAVVAYLVQHYFFSIMGENLTTRVRRMMLAAILRNDVGWFDQEENNSSLVAARLSTDAADVKSAIAERISVILQNMTSLLVSFVVGFIIEWRVAVLILVTFPLLVLANFAQQLSMKGFAGDTAKAHAKTSMIAGEGVSNIRTVAAFNAQDKVLSLFCTELRVPQMHSLRRSQISGALFGLSQLSLYASEALILWYGAHLVRHHVSTFSKVIKVFVVLVITANTVAETVSLAPEIVRGGESIRSVFAILNYRTRIDPDEPETEPVESVRGDIDFRHVDFAYPSRPDVMVFKDFSLRIRAGQSQALVGASGSGKSTVIALIERFYDPLAGKVMIDGKDIRRLNVRSLRLKIGLVQQEPVLFATSIFENIAYGKDGATEEEVIEAAKVANMHGFVSALPEGYKTPVGERGVQLSGGQKQRIAIARAVLKDPAVLLLDEATSALDAESECVLQEALERIMKGRTAVLVAHRLSTIRGVDSIAVVQDGRVVEQGSHGELVSRPDGAYSRLLQLQLHHG

SEQ ID NO: 17954 - protein, 1261 aa, Panicum virgatum
MAEDAGKAESGSCSGGGGGGCEAVKKRPEQSVAFHELFGFADPLDWLLMAAGSAGAVVHGAAMPVFFLLFGELVNGFGKNQHNLRRMTDEVSKYSLYFIYLGLVVCASSYLEIACWMYTGERQVGALRRRYLEAVLRQDVGFFDTDARTGDVVFSVSTDTLLVQDAIGEKVGNFIHYLATFLAGLVVGFVSAWRLALLSIAVIPGIAFAGGLYAYTLTGLTSKSRDSYANAGIIAEQAIAQVRTVYSYVGETKALNSYSEAIQNTLKLGYKAGMAKGLGIGCTYGIACMSWALVFWYAGVFIRNGQTDGGKAFTAIFSAIVGGLSLGQSFSNLGAFSKGKIAGYKLLEVIRQRPTIVQDTADGRCLDEVHGNIEFKEVAFSYPSRPDVMIFRDFSLFFPAGKTAAVVGGSGSGKSTVVALIERFYDPNQGQVLLDNVDIKTLQLKWLRDQIGLVNQEPALFATTILENILYGKPDATMAEVEAAATSANAHSFIALLPNGYNTHVGERGLQLSGGQKQRIAIARAMLKNPKILLLDEATSALDAGSESIVQEALDRLMVGRTTVVVAHRLSTIRCVDMIAVIQQGQVVETGTHDELLAKGSSGAYAALIRFQETARNRACPSTRKSRSSRLSNSLSTRSLSLRSGSLRNLSYSYSTGADGRIEMVSNADNDRKYPAPRGYFFKLLKLNAPEWPYTILGAIGSILSGFIGPTFAIVMSNMIEVFYYRNPSKMESKTREYVFIYIGTGLYAVVAYLVQHYFFSIMGENLTTRVRRMMLAVILRNDVGWFDQEENNSTLVAARLATDAADVKSAIAERISVILQNMTSLLVSFVVGFIIEWRVALLILVTFPLLVLANFAQQLSMKGFAGDTAKAHAKTSMIAGEGVSNIRTVAAFNAQDKVLSLFCGELRVPQAHSLRRSQVSGALFGLSQLALYASEALILWFGAHLVRARASTFSRVIKVFVVLVITANSVAETVSLAPEIARGGESIRSVFAILNSRTRIDPDDPDAEPVEAVRGDIDLRHVDFAYPTRPDVMVFKDFSLRIRAGQSQALVGASGSGKSTVIALIERFYDPLAGKVMLDGKDIRRLNLRSLRRRIGLVQQEPVLFAASIMENIAYGREDGATEEEVVEAAKAANVHGFVSALPDGYRTPVGERGVQLSGGQKQRIAIARAVLKDPAVLLLDEATSALDAESECVLQEALERIMKGRTAVLVAHRLSTIRGVDSIAVVQDGRVVEQGTHGDLVSRPDGAYSRLLQLQLHHG

SEQ ID NO: 17955 - protein, 1264 aa, Zea mays
MAEGDAGKAEAGSCSAAAASGAGGCDAVKKRPEQSVAFHELFGFADPLDWLLMAAGSAGAVVHGAAMPVFFLLFGELVNGFGKNQHNLRRMTDEVSKYSLYFVYLGLVVCASSYLEIACWMYTGERQVGALRRRYLEAVLRQDVGFFDTDARTGDVVFSVSTDTLLVQDAIGEKVGNFIHYLATFLAGLVVGFVSAWRLALLSIAVIPGIAFAGGLYAYTLTGLTSKSRDSYANAGIIAEQAIAQVRTVYSYVGETKALNSYSEAIQNTLKLGYKAGMAKGLGIGCTYGIACMSWALVFWYAGVFIRNGQTDGGKAFTAIFSAIVGGLSLGQSFSNLGAFSKGKIAGYKLLEVIRQRPTIVQDTADGRCLDEVHGNIEFKEVAFSYPSRPDVMIFRDFSLFFPAGKTAAVVGGSGSGKSTVVALIERFYDPNQGQVLLDNVDIKTLQLKWLRDQIGLVNQEPALFATTILENILYGKPDATMAEVEAAATSANAHSFIALLPNGYNTHVGDRGLQLSGGQKQRIAIARAMLKNPKLLLLDEATSALDAGSESIVQEALDRLMVGRTTVVVAHRLSTIRCVDMIAVIQQGQVVETGTHDELLAKGSSGAYAALIRFQETARNRACPSTRKSRSSRLSNSLSTRSLSLRSGSLRNLSYSYSTGADGRIEMVSNADNDRKYPAPRGYFFKLLKLNAPEWPYTILGAVGSVLSGFIGPTFAIVMSNMIEVFYYRNPSKMESKTREYVFIYIGTGLYAVVAYLVQHYFFSIMGENLTTRVRRMMLAVILRNDVGWFDQEENNSNLVAARLSTDAADVKSAIAERISVILQNMTSLLVSFVVGFIIEWRVALLILVTFPLLVLANFAQQLSMKGFAGDTAKAHAKTSMIAGEGVSNIRTVAAFNAQDKILSLFCSELRVPQMHSLRRSQISGALFGLSQLSLYASEALILWFGAHLVRTHVSTFSKVIKVFVVLVITANSVAETVSLAPEIVRGGESIRSVFSVLNSRTRIDPDDPDAEQVESVRGEIDFRHVDFAYPTRPDVMVFKDLSLRIRAGQSQALVGASGSGKSTVIALVERFYDPLAGKVMIDGKDIRRLNLKSLRLRIGLVQQEPVLFATSILENIAYGRDGATEEEVVEAAKVANVHGFVSALPDGYRTPVGERGVQLSGGQKQRIAIARAVLKDPAVLLLDEATSALDAESECVLQEALERIMKGRTAVLVAHRLSTIRGVDSIAVVQDGRVVEQGSHGDLVSRPDGAYSRLLQLQLHHG

SEQ ID NO: 17956 - protein, 1178 aa, Secale cereale
KRADQAVAFHELFSFADRWDLALMSLGTLGAVAHGAAMPCFFLLFGDLINGFGKNQTDLRAMTDEVAKYALYFVYLGLVVCVASYAEIACWMYTGERQVIALRKAYLDAVLRQDVGFFDTDARTGDIVFGVSTDTLLVQDAIGEKVGNFMHYLATFFAGLVVGFVSAWRLALLSVAVIPAIAFAGGLYAYTLTGLTSKSRESYANAGVVAEQAIAQVRTVYSFVGESKALNSYSEAIQNTLKLGYKAGMAKGLGIGCTYGIACMSWALVFWYAGVFIRNGQSDGGKAFTAIFSAIVGGMSLGQAFSNLGAFSKGKIAGYKLLEVIRQKPSIVHDHKDGKLLAEVHGNIEFKDVTFSYPSRPDAMIFRDFSLFFPAGKTVAVVGGSGSGKSTVVALIERFYDPNEGQVLLDNVDIKTLQLRWLRDQIGLVNQEPALFATTIIENILYGKPDATITEVEAAATASNAHYFISLLPNGYNTMVGERGIQLSGGQKQRIAIARAMLKDPKILLLDEATSALDADSENIVQEALDRLMVGRTTVIVAHRLCTIRNVNMIAVLQQGQVIETGTHDELLAKGTSGAYASLIRFQESARNRDLGAASTRRSRSMHLTSSLSTKSLSLRSGSLRNLSYQYSTGADGRIEMISSADNSLKYPAPRGYFFKLLKLNGPEWPYAVLGAIGSVLSGFIGPTFAIVMGEMLDVFYYKDPVDMEKKTKLYVFIYIGTGIYAVVAYLVQHYFFSIMGENLTTRVRRMMLSAILRNEVGWFDEEENNSSLVAARVAVDAADVKSAIAERISVILQNTTSLMTSFIVGFIIEWRVAILILATFPLLVLANFAQQLSMKGFAGDTAKAHAKSSMVAGEGVSNIRTVAAFNAQNKVMSLFSHELRIPEEQILRRSQTAGILYGLSQLCLYCSEALILWYGSHLVRSHGSTFSKVIKVFVVLVVTANSVAETVSLAPEIIRGGESIRSIFGILNRATRIEPDDPEAERVTTVRGDIELRHVDFSYPSRPDIEIFKDFNLKIQAGRSQALVGASGSGKSTVIALIERFYDPTGGKVMIDGKDIRRLNLKSLRRRIGLVQQEPALFASSILENIAYGKEGATEEEVVEAAKTANVHAFVSQLPDGYRTAVGERGVQLSGGRSSASPSPGRCSRTRPSCCWTRRPARWTPSRRACCRRRWSG

SEQ ID NO: 17957 - protein, 1262 aa, Sorghum bicolor
MAEGDAGKAEAGSCSGAGAGGGCDAVKKRPEQSVAFHELFGFADPLDWLLMAAGSAGAVVHGAAMPVFFLLFGELVNGFGKNQHNLRRMTDEVSKYSLYFVYLGLVVCASSYLEIACWMYTGERQVGALRRRYLEAVLRQDVGFFDTDARTGDVVFSVSTDTLLVQDAIGEKVGNFIHYLATFLAGLVVGFVSAWRLALLSIAVIPGIAFAGGLYAYTLTGLTSKSRDSYANAGIIAEQAIAQVRTVYSYVGETKALNSYSEAIQNTLKLGYKAGMAKGLGIGCTYGIACMSWALVFWYAGVFIRNGQTDGGKAFTAIFSAIVGGLSLGQSFSNLGAFSKGKIAGYKLLEVIRQRPTIVQDTADGRCLDEVHGNIEFKEVAFSYPSRPDVMIFRDFSLFFPAGKTAAVVGGSGSGKSTVVALIERFYDPNQGQVLLDNVDIKTLQLKWLREQIGLVNQEPALFATTILENILYGKPDATMAEVEAAATSANAHSFIALLPNGYNTHVGERGLQLSGGQKQRIAIARAMLKNPKLLLLDEATSALDAGSENIVQEALDRLMVGRTTVVVAHRLSTIRCVDMIAVIQQGQVVETGTHDELLAKGSSGAYAALIRFQETARNRACPSTRKSRSSRLSNSLSTRSLSLRSGSLRNLSYSYSTGADGRIEMVSNADNDRKYPAPRGYFFKLLKLNAPEWPYTILGAIGSILSGFIGPTFAIVMSNMIEVFYYRNPNKMESKTREYVFIYIGTGLYAVVAYLVQHYFFSIMGENLTTRVRRMMLAVILRNDVGWFDQEENNSNLVTARLSTDAADVKSAIAERISVILQNMTSLLVSFVVGFIIEWRVALLILVTFPLLVLANFAQQLSMKGFAGDTAKAHAKTSMIAGEGVSNIRTVAAFNAQDKILSLFCSELRVPQMHSLRRSQISGALFGASQLSLYASEALILWFGAHLVRTHVSTFSKVIKVFVVLVITANSVAETVSLAPEIVRGGESIRSVFAILNSRTRIDPDDPDAEQVESVRGEIDFRHVDFAYPTRPDVMVFKDFSLRIRAGQSQALVGASGSGKSTVIALIERFYDPLAGKVMVDGKDIRRLNLKSLRLRIGLVQQEPVLFAASILENIAYGRDGATEEEVVEAAKVANVHGFVSALPDGYRTPVGERGVQLSGGQKQRIAIARAVLKDPAVLLLDEATSALDAESECVLQEALERIMKGRTAVLVAHRLSTIRGVDNIAVVQDGRVVEQGSHGDLVSRPDGAYSRLLQLQLHHG

SEQ ID NO: 17958 - protein, 1263 aa, Triticum aestivum
MAEETGKAEASAGAASCGGGGCEAVKKRAEQSVAFHELFSFADPLDWLLMAAGSAGAVVHGAAMPVFFLLFGELVNGFGKNQHHLRRMTDEVSKYSLYFVYLGLVVCASSYLEIACWMYTGERQVGALRRRYLEAVLRQDVGFFDTDARTGDVVFSVSTDTLLVQDAIGEKVGNFIHYLATFLAGLVVGFVSAWRLALLSIAVIPGIAFAGGLYAYTLTGLTSKSRDSYANAGIIAEQAIAQVRTVYSYVGESKALNSYSEAIQSTLKLGYKAGMAKGLGIGCTYGIACMSWALVFWYAGVFIRSGQTDGGKAFTAIFSAIVGGLSLGQSFSNLGAFSKGKIAGYKLLEVIRQRPTIVQDSTDGRCLDEVHGNIEFKEVSFSYPSRPDVMVFRDFSLFFPAGKTAAVVGGSGSGKSTVVSLIERFYDPNQGQVLLDNADIKSLQLKWLRDQIGLVNQEPALFATTIIDNILYGKPDATMAEVEAAASAANAHSFIALLPNGYNTQVGERGLQLSGGQKQRIAIARAMLKNPKILLLDEATSALDAGSESIVQEALDRIMIGRTTVVVAHRLSTIRSVDMIAVIQQGQVVETGTHDELLAKGSSGAYAALIRFQEMARNRDFRGASTRKNRSSRLSNSLSTRSLSLRSGSLRNLSYSYSTGADGRIEMVSNADNDRKYPAPKGYFFKLLKLNAPEWPYTVLGAIGSIMSGFIGPTFAIVMSNMIEVFYFRDPNAMERKTREYVFIYIGTGFYAVVAYLIQHYFFSIMGENLTTRVRRMMLAVILRNDVGWFDEEENNSSLVAARLNTEAADVKSAIAERISVILQNMTSLLVSFIVGFIIEWRVAILILVTFPLLVLANFAQQLSMKGFAGDTAKAHAKTSMIAGEGVSNIRTVAAFNAQDKILSLFCSELRAPQMHSLRRSQIAGVLYGLSQLSLYASEALILWYGAHLVRHHVSTFSRVIKVFVVLVITANSVAETVSLAPEIVRGGESVRSVFAVLNSRTRIDPDEPEAEQVEKVRGEIELRHVDFAYPSRPDVMVFKEFSLRIRAGQSQALVGASGSGKSTVIALIERFYDPMAGKVMIDGKDIRRLNLKSLRLKIGLVQQEPVLFATSILENIAYGKDGVTEEEVVEAAKVANVHGFVGALPDGYRTPVGERGVQLSGGQKQRIAIARAVLKDPAILLLDEATSALDAESECVLQEALGRIMKGRTTVLVAHRLSTIRCVDSIAVVQDGRVVEQGSHGDLVSRPDGAYSRLLQLQLHHG

SEQ ID NO: 17959 - protein, 1266 aa, Hordeum vulgare
MAEETGKAESSAGAGSCGGGGGGGCEAVKKRAEQSVAFHELFSFADPLDWLLMAAGSAGAVVHGAAMPVFFLLFGELVNGFGKNQHHLRRMTDEVSKYSLYFVYLGLVVCASSYLEIACWMYTGERQVGALRRRYLEAVLRQDVGFFDTDARTGDVVFSVSTDTLLVQDAIGEKVGNFIHYLATFLAGLVVGFVSAWRLALLSIAVIPGIAFAGGLYAYTLTGLTSKSRESYANAGIIAEQAIAQVRTVYSYVGETKALNSYSEAIQSTLKLGYKAGMAKGLGIGCTYGIACMSWALVFWYAGVFIRSGQTDGGKAFTAIFSAIVGGLSLGQSFSNLGAFSKGKIAGYKLLEVIRQRPTIVQDSTDGRCLDEVHGNIEFKEVSFSYPSRPDVMVFRDFSLFFPAGKMAAVVGGSGSGKSTVVSLIERFYDPNQGQVLLDNADIKSLQLKWLRDQIGLVNQEPALFATTIIDNILYGKPDATMAEVEAAASAANAHSFIALLPNGYNTQVGERGLQLSGGQKQRIAIARAMLKNPKILLLDEATSALDAGSESIVQEALDRIMIGRTTVVVAHRLSTIRSVDMIAVIQQGQVVETGTHDELLAKGSSGAYAALIRFQEMAKNRDFRGASTRKNRSSRLSNSLSTRSLSLRSGSLRNLSYSYSTGADGRIEMVSNADNDRKYPAPKGYFFKLLKLNAPEWPYTVLGAIGSIMSGFIGPTFAIVMSNMIEVFYFRDPNAMERKTREYVFIYIGTGFYAVVAYLIQHYFFSIMGENLTTRVRRMMLAVILRNDVGWFDEEENNSSLVAARLNTEAADVKSAIAERISVILQNMTSLLVSFIVGFIIEWRVAILILVTFPLLVLANFAQQLSMKGFAGDTAKAHAKTSMIAGEGVSNIRTVAAFNAQDKILSLFCSELRVPQMHSLRRSQVSGVLYGLSQLSLYASEALILWYGAHLVRHHVSTFSRVIKVFVVLVITANSVAETVSLAPEIIRGGESVRSVFAVLNSRTRIDPDEPEGEPVEKVRGEIELRHVDFAYPSRPDVMVFKEFSLRIRAGQSQALVGASGSGKSTVIALIERFYDPMAGKVMIDGKDIRRLNLKSLRLKIGLVQQEPVLFATSILENIGYGKDGVTEEEVVEAAKVANVHGFVSALPDGYRTPVGERGVQLSGGQKQRIAIARAVLKDPAILLLDEATSALDAESECVVQEALGRIMKGRTTVLVAHRLSTIRCVDSIAVVQDGRVVEQGSHGDLVSRPDGAYSRLLQLQLHHG

SEQ ID NO: 17960 - protein, 1266 aa, Hordeum vulgare
MAEETGKAESSAGAGSCCGGGGGGCEAVKKRAEQSVAFHELFSFADPLDWLLMAAGSAGAVVHGAAMPVFFLLFGELVNGFGKNQHHLRRMTDEVSKYSLYFVYLGLVVCASSYLEIACWMYTGERQVGALRRRYLEAVLRQDVGFFDTDARTGDVVFSVSTDTLLVQDAIGEKVGNFIHYLATFLAGLVVGFVSAWRLALLSIAVIPGIAFAGGLYAYTLTGLTSKSRESYANAGIIAEQAIAQVRTVYSYVGETKALNSYSEAIQSTLKLGYKAGMAKGLGIGCTYGIACMSWALVFWYAGVFIRSGQTDGGKAFTAIFSAIVGGLSLGQSFSNLGAFSKGKIAGYKLLEVIRQRPTIVQDSTDGRCLDEVHGNIEFKEVSFSYPSRPDVMVFRDFSLFFPAGKTAAVVGGSGSGKSTVVSLIERFYDPNQGQVLLDNADIKSLQLKWLRDQIGLVNQEPALFATTIIDNILYGKPDATMAEVEAAASAANAHSFIALLPNGYNTQVGERGLQLSGGQKQRIAIARAMLKNPKILLLDEATSALDAGSESIVQEALDRIMIGRTTVVVAHRLSTIRSVDMIAVIQQGQVVETGTHDELLAKGSSGAYAALIRFQEMAKNRDFRGASTRKNRSSRLSNSLSTRSLSLRSGSLRNLSYSYSTGADGRIEMVSNADNDRKYPAPKGYFFKLLKLNAPEWPYTVLGAIGSIMSGFIGPTFAIVMSNMIEVFYFRDPNAMERKTREYVFIYIGTGFYAVVAYLIQHYFFSIMGENLTTRVRRMMLAVILRNDVGWFDEEENNSSLVAARLNTEAADVKSAIAERISVILQNMTSLLVSFIVGFIIEWRVAILILVTFPLLVLANFAQQLSMKGFAGDTAKAHAKTSMIAGEGVSNIRTVAAFNAQDKILSLFCSELRVPQMHSLRRSQVSGVLYGLSQLSLYASEALILWYGAHLVRHHVSTFSRVIKVFVVLVITANSVAETVSLAPEIIRGGESVRSVFAVLNSRTRIDPDEPEGEPVEKVRGEIELRHVDFAYPSRPDVMVFKEFSLRIRAGQSQALVGASGSGKSTVIALIERFYDPMAGKVMIDGKDIRRLNLKSLRLKIGLVQQEPVLFATSILENIGYGKDGVTEEEVVEAAKVANVHGFVSALPDGYRTPVGEHGVQLSGGQKQRIAIARAVLKDPAILLLDEATSALDAESECVVQEALGRIMKGRTTVLVAHRLSTIRCVDSIAVVQDGRVVEQGSHGDLVSRPDGAYSRLLQLQLHHG

SEQ ID NO: 17961 - protein, 1249 aa, Gossypium raimondii
MAEPTETKAVPEAEKKKEQSLPFYQLFTFADKYDYLLMITGSLGAIIHGSSMPVFFLLFGEMVNGFGKNQSDLPKMTHEVAKYALYFVYLGLIVCLSSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQSDGGKAFTAIFSAIVGGMSLGQSFSNLGAFSKGKAAGYKLMEIINQKPSIIQDHLDGKVLEEVNGNIEFKEVTFSYPSRPDVIIFSNFSIFFPAGKTIAVVGGSGSGKSTVVSLIERFYDPNQGQVLLDNVDIKTLQLKWLRDQIGLVNQEPALFATTILENILYGKPEATMDEVEAAACAANAHSFITLLPNGYNTQVGERGVQLSGGQKQRIAIARAMLKNPKILLLDEATSALDAGSESIVQEALDRLMVGRTTVVVAHRLSTIRNVDSIAVIQQGQVVETGTHEELIAKAGAYASLIRFQEMVGNRDFANPSTRRSRSTRLSHSLSTKSLSLRSGSLRNLSYSYSTGADGRIEMISNAETERKNPAPDGYFCRLLKLNAPEWPYSIMGAVGSVLSGFIGPTFAIVMSNMIEVFYYTNPTSMERKTKEYVFIYIGAGLYAVVAYLIQHYFFSIMGENLTTRVRRMMLGAILRNEVGWFDEEEHNSSLLAAKLATDAADVKSAIAERISVILQNMTSLLTSFIVAFIVEWRVSLLILGTFPLLVLANFAQQLSLKGFAGDTAKAHAKTSMIAGEGVSNIRTVAAFNAQNKILSLFCYELRVPQMQSLRRSQTSGLLFGLSQLALYASEALILWYGAHLVSEGVSTFSKVIKVFVVLVVTANSVAETVSLAPEIVRGGEAVGSVFSILDRSTRIDPDDPEAEPVETIRGEIELRHVDFAYPSRPDVSVFKDLNLRIRAGQSQALVGASGSGKSSVIALIERFYDPTAGKVMINGKDIRRLNLKSLRLKIGLVQQEPALFAASIFDNIAYGKEGATEAEVIEAARAANVHGFVSALPDGYKTPVGERGVQLSGGQKQRIAIARAVLKDPTILLLDEATSALDAESECVLQEALERLMRGRTTVLVAHRLSTIRNVDSIGVVQDGRIVEQGSHSELISRPEGAYSRLLQLQHHHI

SEQ ID NO: 17962 - protein, 1249 aa, Nicotiana benthamiana
MAETTEGKPMPEAEKKKEQSLPFYQLFSFADKYDYLLMISGSIGAIIHGSSMPVFFLLFGEMVNGFGKNQMDLHKMVHEVSKYALYFVYLGLIVCASSYAEIGCWMYTGERQVSALRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQSDGGKAFTAIFSAIVGGMSLGQSFSNLGAFSKGKAAGYKLMEIIKQKPTIVQDLADGKCLSEVNGNIEFKNVTFSYPSRPDVIIFRDFCIFFPAGKTVAVVGGSGSGKSTVVSLIERFYDPNEGQVLLDNVDIKTLQLRWLRDQIGLVNQEPALFATTILENILYGKPDATMAEVEAATSAANAHSFITLLPNGYNTQVGERGVQLSGGQKQRIAIARAMLKNPKILLLDEATSALDAGSESIVQEALDRLMVGRTTVVVAHRLSTIRNVDSIAVIQQGQVVETGTHEELIAKGGAYSSLIRFQEMVGNRDFSNPSTRRTRSSRLSSSLSTKSLSLRSGSLRNLSYSYSTGADGRIEMISNAETERKNPAPQGYFCRLLKLNAPEWPYSIMGAVGSVLSGFIGPTFAIVMSNMIEVFYYRNPASMERKTKEYVFIYIGAGLYAVVAYLIQHYFFSIMGENLTTRVRRMMLAAILRNEVGWFDEEENNSSLLAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQEKIISLFSQELRVPQMQSLRRSQMSGLLFGISQLALYASEALILWYGAHLVSKGVSTFSKVIKVFVVLVITANSVAETVSLAPEIVRGGEAVGSVFSILDRSTRVDPDDTEADPVESIRGDIELRHVDFAYPSRPDVSVFKDFNLRIRAGQSQALVGASGSGKSSVIALIERFYDPTGGKVMIDGKDIRRLNLKSLRLKIGLVQQEPALFAASIFDNIAYGKEGATEAEVVEAARAANVHTFVSGLPEGYKTPVGERGVQLSGGQKQRIAIARAVLKDPSILLLDEATSALDAESECVLQEALERLMRGRTTVLVAHRLSTIRHVDSIGVVQDGRIVEQGSHSELISRPEGAYSRLLQLQHHRI

SEQ ID NO: 17963 - protein, 1214 aa, Brachypodium distachyon
MAAGTAGAVVHGAAMPVFFLLFGELVNGFGKNQHHLRRMTDEVSKYSLYFVYLGLVVCASSYLEIACWMYTGERQVGALRRRYLEAVLRQDVGFFDTDARTGDVVFSVSTDTLLVQDAIGEKVGNFIHYLATFLAGLVVGFVSAWRLALLSIAVIPGIAFAGGLYAYTLTGLTSKSRDSYANAGIIAEQAIAQVRTVYSYVGESKALNSYSEAIQSTLKLGYKAGMAKGLGIGCTYGIACMSWALVFWYAGVFIRSGQTDGGKAFTAIFSAIVGGLSLGQSFSNLGAFSKGKIAGYKLLEVIRQRPTIVQDSADGRCLDEVHGNIEFKEVSFSYPSRPDVMIFRDFSLFFPAGKTAAVVGGSGSGKSTVVSLIERFYDPNQGQVLLDNVDIKTLQLKWLRDQIGLVNQEPALFATTIIENILYGKPDATMAEVEAAASAANAHSFIALLPNGYNTQVGERGLQLSGGQKQRIAIARAMLKNPKILLLDEATSALDAGSESIVQEALDRIMIGRTTVVVAHRLSTIRCVDMIAVIQQGQVVETGTHDELLAKGSSGAYAALIRFQEMARNRDFRGSSTRKNRSSRLSNSLSTRSLSLRSGSLRNLSYSYSTGADGRIEMVSNADNDRKYPAPKGYFFKLLKLNAPEWPYTVLGAIGSIMSGFIGPTFAIVMSNMIEVFYYRDPNAMERKTREYVFIYIGTGLYAVVAYLVQHYFFSIMGENLTTRVRRMMLAVILRNDVGWFDEEENNSSLVAARLATEAADVKSAIAERISVILQNMTSLMVSFVVGFIIEWRVAILILVTFPLLVLANFAQQLSMKGFAGDTAKAHAKTSMIAGEGVSNIRTVAAFNAQDKILSLFCSELRVPQSHSLRRSQISGALYGLSQLSLYASEALILWFGAHLVRHHISTFSKVIKVFVVLVITANSVAETVSLAPEIIRGGESIRSVFAVLNSRTRIDPDEPETEQVESVRGEIELRHVDFAYPSRPDVMIFKDFSLRIRAGQSQALVGASGSGKSTVIALIERFYDPMAGKVMIDGKDIRRLNLKSLRLKIGLVQQEPVLFATSILENIAYGKDGATEEEVIEAAKVANVHGFVSALPDGYRTPVGERGVQLSGGQKQRIAIARAVLKDPAVLLLDEATSALDAESECVLQEALGRIMKGRTAVLVAHRLSTIRCVDSIAVVQDGRVVEQGSHGDLVSRPDGAYSRLLQLQLHHG

SEQ ID NO: 17964 - protein, 1259 aa, Ricinus communis
MAAETAVESNTTSTTKAPLPPEAEKKKEQSLPFYQLFSFADNYDWLLMISGSTGAIIHGSSMPVFFLLFGEMVNGFGKNQSDLTKMTHEVSKYALYFVYLGLVVCLSSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYAQAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIIKQKPTIIQDPSDGKCLPEINGNIEFKDVTFSYPSRPDVIIFRDFSIFFPAGKTVAVVGGSGSGKSTVVSLIERFYDPNQGQVLLDNVDIKTLQLRWLRDQIGLVNQEPALFATTILENILYGKPDATMDEVEAAASAANAHSFITLLPNGYNTQVGERGVQLSGGQKQRIAIARAMLKNPKILLLDEATSALDAGSESIVQEALDRLMVGRTTVVVAHRLSTIRNVDTIAVIQQGQVVETGTHEELISKGAAYASLIRFQEMVRNRDFANPSTRRSRSTRLSHSLSTKSLSLRSGSLRNLSYSYSTGADGRIEMISNAETERKNPAPDGYFCRLLKLNAPEWPYSIMGAIGSVLSGFIGPTFAIVMSNMIEVFYYRNPASMERKTKEYVFIYIGAGLYAVVAYLIQHYFFSIMGENLTTRVRRMMLAAILRNEVGWFDEEEHNSSLVAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQDKILSLFCHELSVPQLRSLRRSQTSGLLFGLSQLALYASEALILWYGAHLVSKGVSTFSKVIKVFVVLVITANSVAETVSLAPEIIRGGEAVGSVFSILDRSTRIDPDDPEAEPVESIRGEIELRHVDFSYPSRPDVPVFKDLNLRIRAGQSQALVGASGCGKSSVIALIERFYDPTAGKVMIDGKDIRRLNLKSLRLKVGLVQQEPALFAASIFDNIAYGKEGATEAEVIEAARAANVHGFVSALPDGYKTPVGERGVQLSGGQKQRIAIARAVLKDPAILLLDEATSALDAESECVLQEALERLMRGRTTVLVAHRLSTIRGVDSIGVVQDGRIVEQGSHAELVSRGDGAYSRLLQLQHHHI

SEQ ID NO: 17965 - protein, 1249 aa, Prunus mume
MAETTEAKTLPEADKKKEQSLPFYQLFSFADKYDWLLMISGSIGAIIHGSSMPVFFLLFGEMVNGFGKNQMDLKKMTAEVAKYALYFVYLGLIVCFSSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIMAEQAIAQVRTVYSYVGESKALNSYSDAIQNTLQLGYKAGMAKGLGLGCTYGIACMSWALVFWYAGVFIRNGQTDGGKAFTAIFSAIVGGMSLGQSFSNLGAFSKGKSAGYKLMEIIKQKPTIIQDPLDGKCLSDVNGNIEFKEVTFSYPSRPDVIIFRNFSIFFPAGKTVAVVGGSGSGKSTVVSLIERFYDPNQGQVLIDSVDIRTLQLKWLRDQIGLVNQEPALFATTILENILYGKPDATMADVEAAASAANAHSFITLLPNGYNTQVGERGVQLSGGQKQRIAIARAMLKNPKILLLDEATSALDASSESIVQEALDRLMVGRTTVVVAHRLSTIRNVDSIAVIQQGQVVETGTHEELIAKAGAYASLIRFQEMVGNRDFRNPSTRCSRSSRLSHSLSTKSLSLRSGSLRNLSYQYSTGADGRIEMISNAETDRKTRAPDGYFFRLLKLNAPEWPYSIMGAIGSVLSGFIGPTFAIVMSNMIEVFYYRNPASMERKTKEYVFIYIGAGLYAVAAYLIQHYFFSIMGENLTTRVRRMMLAAILRNEVGWFDEEEHNSSLLAARLATDASDVKSAIAERISVILQNMTSLLTSFIVAFIVEWRVSLLILATFPLLVLANFAQQLSLKGFAGDTAKAHAKTSMIAGEGVSNIRTVAAFNAQNKILSLFCHELRIPQLGSLRRSQTAGLLFGLSQLALYASEALILWYGAHLVSKGVSTFSKVIKVFVVLVVTANSVAETVSLAPEIIRGGEAVGSVFSILDRQTRIDPDDPEAEIVETIRGEIELRHVDFAYPSRPDIMVFKDFNLRIRTGQSQALVGASGSGKSSVIALIERFYDPIVGKVMIDGKDIRRLNLKSLRLKIGLVQQEPALFAASIFENIAYGKEGATEAEVIEAARTANVHGFVSGLPDGYKTPVGERGVQLSGGQKQRIAIARAVLKDPTILLLDEATSALDAESECVLQEALERLMRGRTTVLVAHRLSTIRGVDSIGVVQDGRIVEHGSHSELVSRPDGAYSRLLQLQHHHI

SEQ ID NO: 17966 - protein, 1249 aa, Solanum phureja
MAETTEGKSMPEAEKKKEQSLPFYQLFSFADKYDYLLMTCGSIGAILHGSSMPVFFLLFGEMVNGFGKNQMDLHKMTHEVSKYALYFVYLGLIVCASSYAEIGCWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGETKALNSYSDAIQNTLKLGYKAGMAKGLGLGCTYGIACMSWALVFWYAGVFIRNGQSDGGKAFTAIFSAIVGGMSLGQSFSNLGAFSKGKAAGYKLMEIIRQKPTIVQDTLDGKCLSEVSGNIEFKNVTFSYPSRPDVIIFRDFNIFFPAGKTVAVVGGSGSGKSTVVSLIERFYDPNDGQVLLDNVDIKTLQLRWLRDQIGLVNQEPALFATTILENILYGKPDATMAEVEAATCASNAHSFITLLPNGYNTQVGERGVQLSGGQKQRIAIARAMLKNPKILLLDEATSALDAGSESIVQEALDRLMVGRTTVVVAHRLSTIRNVDSIAVIQQGQVVETGTHEELISKAGAYASLIRFQEMVGNRDFSNPSTRRTRSTRLSHSLSTKSLSLRSGSLRNLSYSYSTGADGRIEMISNAETDRKNPAPQNYFCRLLKLNAPEWPYSIMGAVGSVLSGFIGPTFAIVMSNMIEVFYYTNPATMERKTKEYVFIYIGAGLYAVVAYLIQHYFFSIMGENLTTRVRRMMLSAILRNEVGWFDEEENNSSLLAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQEKIISLFSQELRVPQMQSLRRSQMSGLLFGISQLALYGSEALILWYGAHLVNNGVSTFSKVIKVFVVLVITANSVAETVSLAPEIIRGGEAVGSVFSILDRSTRVDPDDPEADPVESIRGDIELRHVDFAYPSRPDVSVFKDLNLRIRAGQSQALVGASGSGKSSVIALIERFYDPTGGKVMIDGKDIRRLNLKSLRLKIGLVQQEPALFAASIFENIAYGKEGATEAEVIEAARAANVHTFVSGLPEGYKTPVGERGVQLSGGQKQRIAIARAVLKDPSILLLDEATSALDAESECVLQEALERLMRGRTTVLVAHRLSTIRNVDTIGVVQDGRIVEQGSHSELISRPEGAYSRLLQLQHHRI

SEQ ID NO: 17967 - protein, 1251 aa, Allium cepa
MADPLDQKPEPEKKTQQTQTVPFFTLFSFADRKDYLLMLAGTIGAVVHGSAMPVFFLLFGQLMNGFGKNQTNLAVMTDEVSKYALYFVYLGLVVCASSYAEIACWMYTGERQVSALRRRYLESVLKQDVGFFDTDARTGDIVFSVSTDTLLVQDAISEKVGNFIHYLSTFLAGLVVGFISAWKLALLSVAVIPGIAFAGGLYAYTLTGLTSKSRESYANAGIVAEQAIAQVRTVYSYVGETKALNSYSEAIQNTLKLGYKAGMAKGLGIGCTYGIACMSWALVFWYAGVFIRNGQTDGGKAFTAIFSAIVGGMSLGQSFSNLGAFSKGKAAGFKLMEIIRQKPSIAQDANDGKCLDEVHGNIELKDVTFSYPSRPDVLIFKDFSLFFPAGKTVAIVGGSGSGKSTVVSLIERFYDPNSGQVLLDNVDIRTLQLRWLRDQIGLVNQEPALFATSILENILYGKPDATIAEVEAAATSANAHSFIALLPNGYDTQAGERGVQLSGGQKQRIAIARAMLKNPKILLLDEATSALDAGSESIVQEALDRLMIGRTTVVVAHRLTTIRNVDTIAVIQQGQVVETGTHDELIAKGSSGAYATLIRFQEMARTRDFNIGSTRRSRSSRLSCSLSTKSLSLRSGSLRNLSYQYSTGADGRLEMVSNADNDRKYPAPDGYFFRLLKLNAPEWPYAVLGAVGSILSGFIGPTFAIVMSNMIEVFYYKDPNAMESKTREFVFIYIGAGLYAVVAYLVQHYFFSIMGENLTTRVRRMMLAAILRNEVGWFDEEENNSSLVAARLSTDAADVKSAIAERISVILQNMTSLLTSFIVGFIVEWRVALLILGTFPLLVLANFAQQLSLKGFAGDTAKAHAKTSMIAGEGVSNIRTVAAFNAQDKIISLFCNELRIPRKRSLRKSQTSGLLFGVSQLSLYASEALILWYGAHLVHSGLSTFSKVIKVFVVLVITANSVAETVSLAPEIVRGGESIRSVFSILNRSTRIEPDDPESEPVESVRGEIELRHVDFSYPSRPDVPIFKDFNLRIRAGHSQALVGASGSGKSSIIALIERFYDPSSGKVMIDSKDIRRLNLKSLRRKIGLVQQEPALFATTIFENIAYGKEGPKEEEVVEAAKAANVHAFVSGLPEGYKTMVGERGVQLSGGQKQRIAIARAVLKDPAVLLLDEATSALDAESECVLQEALERLMRGRTTVIVAHRLSTIRNVDNIAVVKDGRIVEQGCHSDLVGRVDGAYYGLLQLQGHRG

SEQ ID NO: 17968 - protein, 1249 aa, Prunus persica
MAETTEAKTLPEADKKKEQSLPFYQLFSFADKYDWLLMISGSIGAIIHGSSMPVFFLLFGEMVNGFGKNQMDLKKMTAEVAKYALYFVYLGLIVCFSSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIMAEQAIAQVRTVYSYVGESKALNSYSDAIQNTLQLGYKAGMAKGLGLGCTYGIACMSWALVFWYAGVFIRNGQTDGGKAFTAIFSAIVGGMSLGQSFSNLGAFSKGKSAGYKLMEIIKQKPTIIQDPLDGKCLSDVNGNIEFKEVTFSYPSRPDVIIFRNFSIFFPAGKTVAVVGGSGSGKSTVVSLIERFYDPNQGQVLIDSVDIRTLQLKWLRDQIGLVNQEPALFATTILENILYGKPDATMADVEAAASAANAHSFITLLPNGYNTQVGERGVQLSGGQKQRIAIARAMLKNPKILLLDEATSALDASSESIVQEALDRLMVGRTTVVVAHRLSTIRNVDSIAVIQQGQVVETGTHEELIAKAGAYASLIRFQEMVGNRDFRNPSTRCSRSSRLSHSLSTKSLSLRSGSLRNLSYQYSTGADGRIEMISNAETDRKTRAPDGYFFRLLKLNAPEWPYSIMGAIGSVLSGFIGPTFAIVMSNMIEVFYYSNPASMERKTKEYVFIYIGAGLYAVAAYLIQHYFFSIMGENLTTRVRRMMLAAILRNEVGWFDEEEHNSSLLAARLATDASDVKSAIAERISVILQNMTSLLTSFIVAFIVEWRVSLLILATFPLLVLANFAQQLSLKGFAGDTAKAHAKTSMIAGEGVSNIRTVAAFNAQNKILSLFCHELRIPQLGSLRRSQTAGLLFGLSQLALYASEALILWYGAHLVSKGVSTFSKVIKVFVVLVVTANSVAETVSLAPEIIRGGEAVGSVFSILDSQTRIDPDDPEAEIVETIRGEIELRHVDFAYPSRPDIMVFKDFNLRIRTGQSQALVGASGSGKSSVIALIERFYDPIVGKVMIDGKDIRRLNLKSLRLKIGLVQQEPALFAASIFENIAYGKEGATEAEVIEAARTANVHGFVSGLPDGYKTPVGERGVQLSGGQKQRIAIARAVLKDPTILLLDEATSALDAESECVLQEALERLMRGRTTVLVAHRLSTIRGVDSIGVVQDGRIVEHGSHSELVSRPDGAYSRLLQLQHHHI

SEQ ID NO: 17969 - protein, 1249 aa, Solanum lycopersicum
MAETTEGKSMPEAEKKKEQSLPFYQLFSFADKYDYLLMTCGSIGAILHGSSMPVFFLLFGEMVNGFGKNQMDLHKMTHEVSKYALYFVYLGLIVCASSYAEIGCWMYTGERQVSALRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGETKALNSYSDAIQNTLKLGYKAGMAKGLGLGCTYGIACMSWALVFWYAGVFIRNGQSDGGKAFTAIFSAIVGGMSLGQSFSNLGAFSKGKAAGYKLMEIIKQKPTIVQDTLDGKCLSEVSGNIEFKNVTFSYPSRPDVIIFRDFCIFFPAGKTVAVVGGSGSGKSTVVSLIERFYDPNDGQVLLDNVDIKTLQLRWLRDQIGLVNQEPALFATTILENILYGKPDATMAEVEAATCASNAHNFITLLPNGYNTQVGERGVQLSGGQKQRIAIARAMLKNPKILLLDEATSALDAGSESIVQEALDRLMVGRTTVVVAHRLSTIRNVDSIAVIQQGQVVETGTHEELISKAGAYASLIRFQEMVGNRDFSNPSTRRTRSTRLSHSLSTKSLSLRSGSLRNLSYSYSTGADGRIEMISNAETDRKNPAPQNYFCRLLKLNAPEWPYSIMGAVGSVLSGFIGPTFAIVMSNMIEVFYYTNPATMERKTKEYVFIYIGAGLYAVVAYLIQHYFFSIMGENLTTRVRRMMLAAILRNEVGWFDEEENNSSLLAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQEKIISLFSQELRVPQMQSLRRSQMSGLLFGISQLALYGSEALILWYGAHLVNNGVSTFSKVIKVFVVLVITANSVAETVSLAPEIIRGGEAVGSVFSILDRSTRVDPDDPEGDPVESIRGDIELRHVDFAYPSRPDVSVFKDLNLRIRAGQSQALVGASGSGKSSVIALIERFYDPTGGKVMIDGKDIRRLNLKSLRLKIGLVQQEPALFAASIFENIAYGKEGATEAEVIEAARAANVHTFVSGLPEGYKTPVGERGVQLSGGQKQRIAIARAVLKDPSILLLDEATSALDAESECVLQEALERLMRGRTTVLVAHRLSTIRNVDTIGVVQDGRIVEQGSHSELISRPEGAYSRLLQLQHHRI

SEQ ID NO: 17970 - protein, 1250 aa, Fragaria vesca
MAESTEPTKTLPEAEKKKEQSLPFYQLFSFADKYDCLLMVSGSIGAIIHGSSMPVFFLLFGEMVNGFGKNQMDLHKMTAEVAKYALYFVYLGLIVCVSSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIMAEQAIAQVRTVKSYVGESKALNSYSDAIQNTLQLGYKAGMAKGLGLGCTYGIACMSWALVFWYAGVFIRNGQTDGGKAFTAIFSAIVGGMSLGQSFSNLGAFSKGKSAGYKLMEIIKQKPTIIQDQLDGKCLSEVNGNIELKEVTFSYPSRPDVIIFRNFSIFFPAGKTIAVVGGSGSGKSTVVSLIERFYDPNHGQVLLDGVDIRTLQLKWLRDQMGLVNQEPALFATTILENILYGKADATMDEVEAAASAANAHSFITLLPNGYNTQVGERGVQLSGGQKQRIAIARAMLKDPKILLLDEATSALDASSESIVQEALDRLMVGRTTVVVAHRLSTIRNVDSIAVIQQGQVVETGTHEELIAKAGAYSSLIRFQEMVGNRDFRNPSTRCSRSSRLSHSLSTKSLSLRSGSLRNLSYSYSTGADGRIEMISNAETDRKTRAPRGYFFRLLKLNAPEWPYSIMGAIGSVLSGFIGPTFAIVMSNMIEVFYYRNPASMERKTKEYVFVYIGAGLYAVVAYLIQHYFFSIMGENLTTRVRRMMLAAILRNEVGWYDEEENNSSLLASKLATDAADVKSAIAERISVILQNMTSLLTSFIVAFIVEWRVSLLILATFPLLVLANFAQQLSLKGFAGDTAKAHAKTSMIAGEGVSNIRTVAAFNAQDKILSLFCHELRIPQLGSLRRSQTAGLLFGLSQLALYASEALILWYGAHLVSKGVSTFSKVIKVFVVLVVTANSVAETVSLAPEIIRGGEAVGSVFSILDRQTRIDPDDPEAEVVETIRGEIELRHVDFAYPSRPDIMIFKDFNLRIRTGQSQALVGASGSGKSTVIALIERFYDPIVGKVMIDGKDIRRLNLKSLRLKIGLVQQEPALFAASIFDNIAYGKEGATEAEVIEAARTANVHGFVSGLPDGYKTPVGERGVQLSGGQKQRIAIARAVLKDPTILLLDEATSALDAESECVLQEALERLMRGRTTVLVAHRLSTIRGVDSIGVVQDGRIVEHGSHSELVSRPDGAYSRLLQLQNHRI

SEQ ID NO: 17971 - protein, 1249 aa, Theobroma cacao
MAETTETKAVPEAEKKKEQSLPFYQLFSFADKYDYFLMISGSLGAIIHGSSMPVFFLLFGEMVNGFGKNQSDLSKMTHEVAKYALYFVYLGLIVCLSSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKTAGYKLMEIIKQKPSIIQDHSDGKVLPEVNGNIEFKDVTFSYPSRPDVIIFRNFSIFFPAGKTVAVVGGSGSGKSTVVSLIERFYDPNQGQVLLDNMDIKTLQLKWLRDQIGLVNQEPALFATTILENILYGKPDATMDEVEAATSAANAHSFITLLPNGYNTQVGERGVQLSGGQKQRIAIARAMLKNPKILLLDEATSALDASSESIVQEALDRLMVGRTTVVVAHRLSTIRNVDSIAVIQQGQVVETGTHEELIAKAGAYASLIRFQEMVGNRDFANPSTRRSRSSRLSHSLSTKSLSLRSGSLRNLSYSYSTGADGRIEMISNAETDRKNPAPDGYFCRLLKLNAPEWPYSIMGAVGSVLSGFIGPTFAIVMSNMIEVFYYTNPTSMERKTKEYVFIYIGAGLYAVIAYLIQHYFFSIMGENLTTRVRRMMLGAILRNEVGWFDEEEHNSSLLAARLATDAADVKSAIAERISVILQNMTSLLTSFIVAFIVEWRVSLLILGTFPLLVLANFAQQLSLKGFAGDTAKAHAKTSMIAGEGVSNIRTVAAFNAQNKILSLFCYELRVPQKRSLGRSQTSGLLFGLSQLALYASEALILWYGAHLVSKGVSTFSKVIKVFVVLVVTANSVAETVSLAPEIIRGGEAVGSVFSILDRSTKIDPDDPEGEPVESIRGEIELRHVDFAYPSRPDVSVFKDLNLRIRAGQNQALVGASGSGKSSVIALIERFYDPIAGKVMIDGKDIRRLNLKSLRLKIGLVQQEPALFAASIFDNIAYGKEGATEAEVIEAARAANVHGFVSALPDGYKTPVGERGVQLSGGQKQRIAIARAVLKDPTILLLDEATSALDAESECVLQEALERLMRGRTTVLVAHRLSTIRNVDSIGVVQDGRIVEQGSHAELISRAEGAYSRLLQLQHHHV

SEQ ID NO: 17972 - protein, 1250 aa, Cicer arietinum
MAEVSEVKASLPEAEKKKEQSLPFYQLFSFADKYDWILMISGSIGAIIHGSSMPVFFLLFGQMVNGFGKNQMDLKKMTDEVSKYALYFVYLGLVVCISSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIIRQKPTIVEDLLDGKTLAEVNGNIEFKDVTFSYPSRPDVIIFRKFSIFFPAGKTVAVVGGSGSGKSTVVSLIERFYDPNEGQVLLDNVDIKTLQLKWLRDQIGLVNQEPALFATTILENILYGKPDATIDEVEAATSAANAHSFITLLPNGYNTQVGERGVQLSGGQKQRIAIARAMLKNPKILLLDEATSALDAGSESIVQEALDRLMIGRTTVVVAHRLSTIRNVDTIAVIQQGLVVETGTHEELFAKGGTYASLIRFQEMVGNRDFSNPSTRRTRSSRLSHSLSTKSLSLRSGSLRNLSYQYSTGADGRIEMISNAETDKKNPAPDGYFFRLLKMNAPEWPYSIMGAVGSILSGFIGPTFAIVMSNMIEVFYYRNYASMERKTKEYVFIYIGAGIYAVGAYLIQHYFFSIMGENLTTRVRRMMLAAILRNEVGWFDEEEHNSSLVAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQNKMLSIFCHELRVPQSLSLRRSLTSGLLFGLSQLALYASEALILWYGAHLVSKGVSTFSKVIKVFVVLVITANSVAETVSLAPEIIRGGEAVGSVFSILDRSTRIDPDDPDAEQVESVRGEIELRHVDFAYPSRPDVMVFKDFSLRIRAGQSQALVGASGSGKSSVIALIERFYDPIVGKVMIDGKDIRKLNLKSLRLKIGLVQQEPALFAASILENIAYGKEGATEAEVIEAARSANVHAFVSGLPEGYKTPVGERGVQLSGGQKQRIAIARAVLKDPTILLLDEATSALDAESECVLQEALERLMRGRTTVLVAHRLSTIRGVDCIGVVQDGRIVEQGSHSELISRPEGAYSRLLQLQHHHI

SEQ ID NO: 17973 - protein, 1212 aa, Vitis vinifera
MVSGSVGAVIHGSSMPVFFLLFGEMVNGFGKNQTDLSKMTEEVAKYALYFVYLGVVVCISSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIIRQKPSIVQDPSDGKCLAEVNGNIEFKDVTFSYPSRPDVIIFRDFSIFFPAGKTVAVVGGSGSGKSTVVSLIERFYDPNQGQVLLDNVDIKTLQLRWLRDQIGLVNQEPALFATTILENILYGKPDATAAEVEAAASAANAHSFITLLPNGYNTQVGERGTQLSGGQKQRIAIARAMLKNPKILLLDEATSALDAGSESIVQEALDRLMVGRTTVVVAHRLSTIRNVDTIAVIQQGQVVETGTHEELSAKAGAYASLIRFQEMVRNRDFANPSTRRSRSSRLSHSLSTKSLSLRSGSLRNLSYQYSTGADGRIEMVSNAETDKKNPAPDGYFYRLLNLNAPEWPYSIMGAVGSVLSGFIGPTFAIVMSNMIEVFYYRNPASMERKTKEYVFIYIGAGLYAVIAYLIQHYFFSIMGENLTTRVRRMMLAAILRNEVGWFDEEENNSSLLAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQEKILSLFCYELRVPQMQSLRRSQTSGLLFGLSQLALYASEALILWYGSHLVSKGASTFSKVIKVFVVLVITANSVAETVSLAPEIIRGGEAVGSVFSILDRSTKIDPDDSDAEPVESIRGEIELRHVDFSYPSRSDITVFKDLNLRIRAGQSQALVGASGSGKSSVIALIERFYDPTAGKVMIDGKDVRRLNLKSLRLKIGLVQQEPALFAASILDNIAYGKDGATEAEVIEAARAANVHGFVSGLPDGYKTPVGERGVQLSGGQKQRIAIARAVLKDPTILLLDEATSALDAESECVLQEALERLMRGRTTVLVAHRLSTIRGVDSIGVVQDGRIVEQGSHSELISRPEGAYSRLLQLQHHHI

SEQ ID NO: 17974 - protein, 1250 aa, Nicotiana benthamiana
MAETTEGKPMTEAEKKKEQSLPFYQLFSFADKYDYLLMITGSIGAIVHGSSMPVFFLLFGEMVNGFGKNQMDLHKMVHEVSKYALYFVYLGLIVCASSYAEIGCWMYTGERQVSALRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGENKALNSYSDAIQNTLKLGYKAGMAKGLGLGCTYGIACMSWALVFWYAGVFIRNGQSDGGKAFTAIFSAIVGGMSLGQSFSNLGAFSKGKAAGYKLMEIIKQKPTIVQDLADGKCLSEVNGNIEFKNVTFSYPSRPDVIIFRDFCIFFPAGKTVAVVGGSGSGKTTVVSLIERFYDPNEGQVLLDNVDIKTLQLRWLRDQIGLVNQEPALFATTILENILYGKPDATTAEVEAATSAANAHSFITLLPNGYNTQVGERGVQLSGGQKQRIAIARAMLKNPKILLFDEATSALDAGSESIVQEALDRLMVGRTTVVVAHRLSTIRNVDSIAVIQQGQVVETGTHEELIAKAGAYSSLIRFQVMVGNRDFSNPSTRRTRSSRLSSSLSTKSLSLRSGSLRNLSYSYSTGADGRIEMISNAETERKNPAPQGYFCRLLKLNAPEWPYSIMGAIGSVLSGFIGPTFAIVMSNMIEVFYYRNPASMERKTKEYVFIYIGAGLYAVVAYLIQHYFFSIMGENLTTRVRRMMLAAILRNEVGWFDEEENNSSLLAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQEKIISMFSQELRVPQMQSLRRSQISGLLFGISQLALYASEALILWYGAHLVSKGVSTFSKVIKVFVVLVITANSVAETVSLAPEIVRGGEAVGSVFSILDRSTRVDPDDTEADPVESIRGDIELRHVDFAYPSRPDDVSVFKDFNLRIRAGQSQALVGASGSGKSSVIALIERFYDPTGGKVMIDGKDIRRLNLKSLRLKIGLVQQEPALFAASIFENIAYGKEGATEAEVVEAARAANVHTFVSGLPEGYKTPVGERGVQLSGGQKQRIAIARAVLKDPSILLLDEATSALDADSECVLQEALERLMRGRTTVLVAHRLSTIRHVDSIGVVQDGRIVEQGSHSELISRPEGAYSRLLQLQHHRI

SEQ ID NO: 17975 - protein, 1251 aa, Populus trichocarpa
MAETTEANRPSLPEAEKKKEQSLPFYQLFSFADKYDWLLMISGSIGAIIHGSSMPVFFLLFGEMVNGFGKNQSDLYKMTHEVSKYALYFVYLGIVVCLSSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYAQAGIIAEQAIAQVRTVYSFVGESKALSSYTDAIQNTLKLGYKAGMAKGLGLGCTYGIACMSWALVFWYAGVFIRNGQTDGGKAFTAIFSAIVGGMSLGQSFSNLGAFSKGKAAGYKLMEIIKQRPSITQDAVDGKCLAEVNGNIEFKSVTFSYPSRPDVIIFRDFSIFFPAGKTVAVVGGSGSGKSTVVSLIERFYDPNQGQVLLDNVDIKTLQLRWLRDQIGLVNQEPALFATTILENIRYGKPDATMDEVEAATSAANAHSFITLLPNGYNTQVGERGVQLSGGQKQRIAIARAMLKNPKILLLDEATSALDASSESIVQEALDRLMIGRTTVVVAHRLSTIRNVDTIAVIQQGLVVETGTHEELIAKAGAYASLIRFQEMVRNRDFANPSTRRSRSSRLSHSLSTKSLSLRSGSLRNLSYSYSTGADGRIEMISNAETDRKNPAPDGYFCRLLKLNAPEWPYSIMGAVGSVLSGFIGPTFAIVMSNMIEVFYYRNPASMERKTKEYVFIYIGAGLYAVVAYLIQHYFFSIMGENLTTRVRRMMLAAILRNEVGWFDEEEHNSSLVAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQGKVLSLFCHELRVPQLHSLRRSQTSGLLFGLSQLALYGSEALILWYGAHLVSKGVSTFSKVIKVFVVLVITANSVAETVSLAPEIIRGGEAVGSVFSILERSTKIDPDDSEAEPVESLRGEIELRHVDFAYPSRPDVPVFKDLNLRIRAGQSQALVGASGCGKSSVISLIERFYDPMAGKVMIDGKDIRRLNLKSLRLKIGLVQQEPALFAASIFDNIAYGKDGATEAEVIEAARAANVHGFVSALPDGYKTPVGERGVQLSGGQKQRIAIARAVLKDPAILLLDEATSALDAESECVLQEALERLMRGRTTVLVAHRLSTIRGVDSIGVVQDGRIVEQGSHSELVSRPDGAYFRLLQLQHHHI

SEQ ID NO: 17976 - protein, 1252 aa, Citrus clementina
MAEPTTEAAKTLPPEAEKKKEQSLPFFQLFSFADKYDWCLMIFGSLGAVIHGSSMPVFFLLFGEMVNGFGKNQTDIHKMTHEVCKYALYFVYLGLIVCFSSYAEIACWMYTGERQVSTLRKKYLEAVLKQDVGFFDTDARTGDIVFSVSTDTLLVQDAISEKVGNFIHYLSTFLAGLVVGFVSAWRLALLSIAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGVTDGGKAFTAIFSAIVGGMSLGQSFSNLGAFSKGKAAGYKLMEIIKQKPSIIQDPTNGRCLDEVNGNIEFKNVTFSYPSRPDVIIFRDFSIYFPAGKTVAVVGGSGSGKSTVVSLIERFYDPNAGQVLLDNVDIKTLQLRWLRDQIGLVNQEPALFATTILENILYGKPEATMAEVEAAASAANAHSFITLLPNGYSTQVGERGVQLSGGQKQRIAIARAMLKNPKILLLDEATSALDAGSESIVQEALDRLMVGRTTVVVAHRLSTIRNVDTVAVIQQGQVVETGTHEELIAKAGAYASLIRFQEMVRNRDFANPSTRRSRSTRLSHSLSTKSLSLRSGSLRNLSYSYSTGADGRIEMVSNAETDRKNPAPDGYFLRLLKLNAPEWPYSIMGAIGSVLSGFIGPTFAIVMACMIEVFYYRNPASMERKTKEFVFIYIGAGLYAVVAYLIQHYFFSIMGENLTTRVRRMMLAAILRNEVGWFDEEEHNSSLVAARLATDAADVKSAIADRISVILQNMTSLLTSFIVAFIVEWRVSLLILGTYPLLVLANFAQQLSLKGFAGDTAKAHAKTSMIAGEGVSNIRTVAAFNAQNKILSLFCHELRVPQSQTLRRSLTAGILFGISQFALHASEALILWYGVHLVGKGVSTFSKVIKVFVVLVVTANSVAETVSLAPEIIRGGESVGSVFSILDRSTRIDPDDPDAEPVETIRGEIELRHVDFAYPSRPDVVVFKDFNLRIRAGQSQALVGASGSGKSSVIALIERFYDPTAGKVMIDGKDIRRLNLKSLRLKIGLVQQEPALFAASIFDNIAYGKEGATEAEVVEAARAANVHGFVSALPNAYKTPVGERGVQLSGGQKQRIAIARAVLKNPAILLLDEATSALDAESECVLQEALERLMRGRTTVLVAHRLSTIRGVDCIGVVQDGRIVEQGSHSELVSRPDGAYSRLLQLQHHHI

SEQ ID NO: 17977 - protein, 1249 aa, Capsicum annuum
MAEHTEGKTMPEAEKKKEQSLPFYQLFSFADKFDYFLMITGSIGAILHGSSMPVFFLLFGEMVNGFGKNQMDLHKMTHEVSKYALYFVYLGLIVCASSYAEIGCWMYTGERQASALRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGIAKGLGLGCTYGIACMSWALVFWYAGVFIRNGQSDGGKAFTAVFSAIVGGMSLGQSFSNLGAFSKGKAAGYKLMEIINQKPTIVQDPLDGKCLSEVSGNIEFKNVTFSYPSRPDVIIFRDFCIFFPAGKTVAVVGGSGSGKSTVVSLIERFYDPNEGQVFLDNVDIKTLQLRWLRDQIGLVNQEPALFATTILENILYGKTDATMAEVEAATCASNAHGFITLLPNGYNTQVGERGVQLSGGQKQRIAIARAMLKNPKILLLDEATSALDASSESIVQEALDRLMVGRTTVVVAHRLSTIRNVDSIAVIQQGQVVETGTHEELIAKAGAYSSLIRFQEMVGNRDFSNPSTRRTRSTRLSHSLSTKSLSLRSGSLRNLSYSYSTGADGRIEMISNAETDRKNPAPQNYFCRLLKLNAPEWPYSIMGAIGSVLSGFIGPTFAIVMSCMIEVFYYTNPAIMERKTKEYVFIYIGAGLYAVVVYLIQHYFFSIMGENLTTRVRRMMLAAILRNEVGWFDDEENNSSLLAARLATDAADVKSAIAERISVILQNMTSLLTSFIVAFIIEWRVSLLILATFPLLVLANFAQQLSLKGFAGDTAKAHAKTSMIAGEGVSNIRTVAAFNAQEKIISLFSHELRVPQMQSLRCSQMSGILFGISQLALYGSEALILWYGAHLVNNGVSTFSKVIKVFVVLVVTANSVAETVSLAPEIIRGGEAVGSVFSILDRSTRIDPDDPEGDPVESIRGDIELRHVDFSYPSRPDVSVFKDLNLRIRAGQSQALVGASGSGKSSVIGLIERFYDPTGGKVMIDGKDIRRLNLKSLRLKIGLVQQEPALFAASIFDNIAYGKEGATEAEVIEAARAANVHTFVSGLPEGYKTPVGERGVQLSGGQKQRIAIARAVLKDPSILLLDEATSALDAESECVLQEALERLMRGRTTVLVAHRLSTIRNVDSIGVVQDGRIVEQGSHSELISRPEGAYSRLLQLQHHRI

SEQ ID NO: 17978 - protein, 1252 aa, Vinca minor
MAETTEGGKAMPAEAEKKKKEQSLPFYQLFSFADKYDYVLMISGSIGAIIHGSSMPVFFLLFGQMVNGFGKNQSDLHKMTHEVAKYALYFVYLGLVVCFSSYAEIACWMYTGERQAGALRKKYLEAVLKQDVGFFDTDARTGDIVFSVSTDTLLVQDAISEKVGNFIHYLSTFLAGLVVGFVSAWKLALLSVAVIPGIAFAGGLYAYTLTGLTSKSRESYANAGIIAEQAIAQVRTVYSYVGESKALNAYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIIKQKPTIVQDHADGKCLDEVNGNIEFKNVTFSYPSRPDVIIFRDFSIFFPAGKTIAVVGGSGSGKSTVVSLIERFYDPNQGEILLDNVDIKTLQLRWLRDQIGLVNQEPALFATTILENILYGKPDASTAEVEAAASAANAHSFITLLPNGYNTQAGERGVQLSGGQKQRIAIARAMLKNPKILLLDEATSALDAGSESIVQEALDRLMVGRTTVVVAHRLSTIRNVDSIAVIQQGQVVETGTHVELVAKAGAYASLIRFQEMVGNRDFSNPSTRRTRSTRLSHSLSTKSLSLRSGSLRNLSYSYSTGADGRIEMVSNAETDGKHPAPHGYFCRLLKLNAPEWPYSIMGAVGSVLSGFIGPTFAIVMSNMIEVFYYRNPASMERKTKEYVFIYIGAGLYAVVAYLIQHYFFSIMGENLTTRVRRMMLAAILRNEVGWFDEEEHNSTLLAARLATDAADVKSAIAERISVILQNMTSLLTSFIVAFIIEWKVSLLILATFPLLVLANFAQQLSLKGFAGDTAKSHAKTSMIAGEGVSNIRTVAAFNAQEKVLSLFSQELHVPQLHSLRRSQTSGLLFGLSQLALYSSEALILWYGSHLVSKGASTFSKVIKVFVVLVITANSVAETVSLAPEIIRGGEAVGSVFSVLDRSTRIDSDDPEAEPVESMRGDIEFRHVDFAYPSRPDVIIFKDFNLRIRAGQSQALVGASGSGKSSVIALIERFYDPISGKVMIDGKDIRRLNLKSLRLKIGLVQQEPALFAASIFDNIAYGKDSATEAEVIEAARAANMHAFVSSLPEGYKTPVGERGVQLSGGQKQRIAIARAVLKDPTILLLDEATSALDAESECVLQEALERLMRGRTTVLVAHRLSTIRGVDCIGVVQDGRIVEQGSHGELISRPDGAYSRLLQLQHNHI

SEQ ID NO: 17979 - protein, 1249 aa, Glycine max
MAEASEPKALPEAEKKKEQTLPFYKLFSFADKCDWMLMISGSIGAIVHGSSMPVFFLLFGEMVNGFGKNQMDLKKMTEEVSKYALYFVYLGLVVCISSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIINQKPTIVEDPSEGKCLAEVNGNIEFKDVTFSYPSRPDMFIFRNFSIFFPAGKTVAVVGGSGSGKSTVVSLIERFYDPNEGQVLLDNVDIKTLQLKWLRDQIGLVNQEPALFATTILENILYGKPDATMAEVEAATSAANAHSFITLLPNGYNTQVGERGVQLSGGQKQRIAIARAMLKNPKILLLDEATSALDAGSESIVQEALDRLMVGRTTVVVAHRLSTIRNVDTIAVIQQGQVVETGTHEELIAKAGTYASLIRFQEMVGNRDFSNPSTRRTRSSRLSHSLSTKSLSLRSGSLRNLSYQYSTGADGRIEMISNAETDKKNPAPDGYFFRLLKMNAPEWPYSIMGAVGSVLSGFIGPTFAIVMSNMIEVFYFRNYASMERKTKEYVFIYIGAGLYAVGAYLIQHYFFSIMGENLTTRVRRMMLAAILRNEVGWFDEEEHNSSLVAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQNKMLSVFCHELRVPQSQSLRRSQTSGFLFGLSQLALYASEALILWYGAHLVSKGVSTFSKVIKVFVVLVITANSVAETVSLAPEIIRGGEAVGSVFSILDRSTRIDPDDPDADPVESLRGEIELRHVDFAYPSRPDVMVFKDLNLRIRAGQSQALVGASGSGKSSVIALIERFYDPIAGKVMVDGKDIRKLNLKSLRLKIGLVQQEPALFAASIFENIAYGKEGATEAEVIEAARAANVHGFVSGLPEGYKTPVGERGVQLSGGQKQRIAIARAVLKDPTILLLDEATSALDAESECVLQEALERLMRGRTTVLVAHRLSTIRGVDCIGVVQDGRIVEQGSHSELVSRPEGAYSRLLQLQHHHI

SEQ ID NO: 17980 - protein, 1250 aa, Medicago truncatula
MAEASDVKASLPEAEKKKEQSLPFFQLFSFADKYDWILMISGSIGAIIHGSSMPVFFLLFGQMVNGFGKNQMDLKKMTDEVSKYALYFVYLGLVVCISSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIIKQKPTIVEDLSDGKCLAEVNGNIEFKDVSFSYPSRPDVMIFQNFSIFFPAGKTVAVVGGSGSGKSTVVSLIERFYDPNDGQVLLDNVDIKTLQLKWLRDQIGLVNQEPALFATTILENILYGKPDATMDEVESATSAANAHSFITLLPNGYNTQVGERGVQLSGGQKQRIAIARAMLKNPKILLLDEATSALDAGSESIVQEALDRLMVGRTTVVVAHRLSTIRNVDSIAVIQQRVVVETGTHEELFAKGGTYASLIRFQEVVGNRDFSNPSTRRNRSSRLSHSLSTKSLSLRSGSLRNLSYQYSTGADGRIEMISNAETDKKNPAPDGYFFRLLKMNAPEWPYSIMGAVGSVLSGFIGPTFAIVMSNMIEVFYYRNYASMEKKTKEYVFIYIGAGIYAVGAYLIQHYFFSIMGENLTTRVRRMMLAAILRNEVGWFDEEEHNSSLVAARLATDAADVKSAIAERISVILQNMTSLLTSFIVAFIVEWRVSLLILGTFPLLVLANFAQQLSLKGFAGDTAKAHAKTSMIAGEGVSNIRTVAAFNAQNKMLSIFCHELRVPQSQSLRRSLTSGLLFGLSQLALYASEALILWYGAHLVSKGLSTFSKVIKVFVVLVITANSVAETVSLAPEIIRGGEAVGSVFSILDRSTRIDPDDPDAEMVESVRGEIELRHVDFAYPSRPDMMVFKDFSLRIRAGQSQALVGASGSGKSSVIALIERFYDPLVGKVMIDGKDIRRLNLKSLRLKIGLVQQEPALFASSIFDNIAYGKEGATEAEVIEAARAANVHGFVSGLPEGYKTPVGERGVQLSGGQKQRIAIARAVLKDPAILLLDEATSALDAESECVLQEALERLMRGRTTVLVAHRLSTIRGVDCIGVVQDGRIVEQGSHSELISRPEGAYSRLLQLQHHHI

SEQ ID NO: 17981 - protein, 1252 aa, Citrus sinensis
MAEPTTEAAKTLPPEAEKKKEQSLPFFQLFSFADKYDWCLMIFGSLGAVIHGSSMPVFFLLFGEMVNGFGKNQTDIHKMTHEVCKYALYFVYLGLIVCFSSYAEIACWMYTGERQVSTLRKKYLEAVLKQDVGFFDTDARTGDIVFSVSTDTLLVQDAISEKVGNFIHYLSTFLAGLVVGFVSAWRLALLSIAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGVTDGGKAFTAIFSAIVGGMSLGQSFSNLGAFSKGKAAGYKLMEIIKQKPSIIQDPTNGRCLDEVNGNIEFKNVTFSYPSRPDVIIFRDFSIFFPAGKTVAVVGGSGSGKSTVVSLIERFYDPNAGHVLLDNVDIKTLQLRWLRDQIGLVNQEPALFATTILENILYGKPEATMAEVEAAASAANAHSFITLLPNGYSTQVGERGVQLSGGQKQRIAIARAMLKNPKILLLDEATSALDAGSESIVQEALDRLMVGRTTVVVAHRLSTIRNVDTVAVIQQGQVVETGTHEELIAKAGAYASLIRFQEMVRNRDFANPSTRRSRSTRLSHSLSTKSLSLRSGSLRNLSYSYSTGADGRIEMVSNAETDRKNPAPDGYFLRLLKLNAPEWPYSIMGAIGSVLSGFIGPTFAIVMACMIEVFYYRNPASMERKTKEFVFIYIGAGLYAVVAYLIQHYFFSIMGENLTTRVRRMMLAAILRNEVGWFDEEEHNSSLVAARLATDAADVKSAIADRISVILQNMTSLLTSFIVAFIVEWRVSLLILGTYPLLVLANFAQQLSLKGFAGDTAKAHAKTSMIAGEGVSNIRTVAAFNAQNKILSLFCHELRVPQSQTLRRSLTAGILFGISQFALHASEALILWYGVHLVGKGVSTFSKVIKVFVVLVVTANSVAETVSLAPEIIRGGESVGSVFSTLDRSTRIDPDDPDAEPVETIRGEIELRHVDFAYPSRPDVVVFKDFNLRIRAGQSQALVGASGSGKSSVIALIERFYDPTAGKVMIDGKDIRRLNLKSLRLKIGLVQQEPALFAASIFDNIAYGKEGATEAEVVEAARAANVHGFVSALPNAYKTPVGERGVQLSGGQKQRIAIARAVLKNPAILLLDEATSALDAESECVLQEALERLMRGRTTVLVAHRLSTIRGVDCIGVVQDGRIVEQGSHSELVSRPDGAYSRLLQLQHHHI

SEQ ID NO: 17982 - protein, 1249 aa, Phaseolus vulgaris
MADAAEPKALPEAEKKKEQTLPFYKLFSFADKCDWMLMISGSLGAIVHGSSMPVFFLLFGEMVNGFGKNQMDLKKMTEEVSKYALYFVYLGLVVCLSSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQARTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIINQKPTIVEDSSEGKCLADVNGNIEFKDVTFSYPSRPDVFIFRSFSIFFPAGKTVAVVGGSGSGKSTVVSLIERFYDPNEGQVLLDNVDIKSLQLKWLRDQIGLVNQEPALFATTILENILYGKADATMAEVEAATSAANAHSFITLLPNGYNTQVGERGVQLSGGQKQRIAIARAMLKNPKILLLDEATSALDAGSESIVQEALDRLMVGRTTVVVAHRLSTIRNVDTIAVIQQGQVVETGTHEELIAKTGTYASLIRFQEMVGNRDFSNPSTRRTRSSRLSHSLSTKSLSLRSGSLRNLSYQYSTGADGRIEMISNAETDKKNPAPDGYFFRLLKLNAPEWPYSIMGAVGSVLSGFIGPTFAIVMSNMIEVFYFRNYASMERKTKEYVFIYIGAGLYAVGAYLIQHYFFSIMGENLTTRVRRMMLAAILRNEVGWFDEEEHNSSLVAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQTKMLSVFCNELRVPQRQSLRRSLTSGFLFGLSQLALYASEALILWYGAHLVSRGASTFSKVIKVFVVLVITANSVAETVSLAPEIIRGGEAVGSVFSILDRSTRIDPDDPDADPVETLRGEIELRHVDFAYPSRPDVMVFKDLSLRIRAGQSQALVGASGSGKSSVIALIERFYDPIAGKVMVDGKDIRKLNLKSLRLKIGLVQQEPALFAASIFENIAYGKDGASEGEVIEAARAANVHGFVSGLPEGYKTPVGERGVQLSGGQKQRIAIARAVLKDPAILLLDEATSALDAESECVLQEALERLMRGRTTVLVAHRLSTIRGVDCIGVVQDGRIVEQGSHAELVSRPEGAYSRLLQLQHHHI

SEQ ID NO: 17983 - protein, 1249 aa, Eucalyptus grandis
MAESGDGKALPDAEKKKDQSLPFYQLFSFADKYDWLLMISGSLGAIIHGSSMPVFFLLFGEMVNGFGKNQSDLKKMTQEVSKYALYFVYLGLVVCLSSYAEIACWMYTGERQASTLRKKYLEAVLRQDVGFFDTDARTGDIVFSVSTDTLLVQDAISEKVGNFIHYLSTFLAGLVVGFVAAWRLALLSVAVIPGIAFAGGLYAYTLTGLTSKSRESYANAGIIAEQAIAQVRTVYSYVGECKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEVIRQKPSIGHDPSNGKTLPEINGNIEFKDVTFSYPSRPDVIIFRNFSIFFPAGKTVAVVGGSGSGKSTVVSLIERFYDPNQGQVLLDNVDLKALQLKWLRDQIGLVNQEPALFATTILENIIYGKPDATMAEVEAAATAANAHSFITLLPKGYSTQVGERGVQLSGGQKQRIAIARAMLKNPKVLLLDEATSALDAGSESIVQEALDRLMVGRTTVVVAHRLSTIRNVDSIAVIQQGLVVETGTHEELIAKAGAYASLIRFQEMVGNRDFSNPSTRRCRSSRLSHSLSTKSLSLRSGSLRNLSYSYSTGADGRIEMVSNAETERRNPAPDGYFCRLLKLNAPEWPYSIMGAAGSVLSGFIGPTFAIVMSNMIEVFYYRNPASMERKTKEYVFIYIGAGLYAVVAYLIQHYFFSIMGENLTTRVRRMMLAAILRNEVGWFDEEEHNSSLVAARLATDAADVKSAIAERISVILQNMTSLLTSFIVAFIIEWRVSLLILATFPLLVLANFAQQLSLKGFAGDTAKAHAKTSMIAGEGVSNIRTVAAFNAQNRILSLFCHELRLPQMRSLGRSQTAGLLFGVSQLALYASEALILWYGAHLVSRGMSTFSKVIKVFVVLVITANSVAETVSLAPEIIRGGEAVGSVFSILDRQTRIDPDDPEAEQVGSLRGEIELRHVDFAYPSRPDVVVFKDLNLRIRAGHSQALVGASGSGKSSVIALIERFYDPIAGKVMIDGKDIRRLNLKSLRLKIGLVQQEPALFAANILDNIAYGKEGATEAEVIEAARTANVHGFVSALPDGYKTPVGERGVQLSGGQKQRIAIARAVLKDPAILLLDEATSALDPESECVLQEALERLMRGRTTVLVAHRLSTIRGVDSIGVVQDGRIVEQGSHAELVSRPEGAYSRLLQLQLHHI

SEQ ID NO: 17984 - protein, 1249 aa, Tabernaemontana elegans
MAETTEGKVMPEAEKKKEQSLPFYQLFSFADKYDYLLMISGSLGAIVHGSSMPVFFLLFGEMVNGFGKNQTDLHKMTHEVSKYALYFVYLGLVVCFSSYAEIACWMYTGERQAGALRRKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQTIAQVRTVYSYVGESKALKAYSDAIQNTLKLGYKAGMAKGLGLGCTYGIACMSWALVFWYAGVFIRNGQTDGGKAFTAIFSAIVGGMSLGQSFSNLGAFSKGKAAGYKLVEIIKQKPTIVQDHTDGKCLTEVNGNIEFKNVTFSYPSRPDVIIFRDFSIFFPAGKTVAVVGGSGSGKSTVVSLIERFYDPNQGEILLDNVDIKTLQLRWLRDQIGLVNQEPALFATTILENILYGKPDATMAEVEAAASAANAHGFVTLLPNGYNTQVGERGVQLSGGQKQRIAIARAMLKNPRILLLDEATSALDAGSESIVQEALDRLMVGRTTVVVAHRLSTIRNVDGIAVIQQGQVVETGTHEELVAKAGAYASLIRFQEMVGNRDFSNPSTRRSRSSRLSHSLSTKSLSLRSGSLRNLSYSYSTGADGRIEMVSNAETDRKNPAPDGYFCRLLKLNAPEWPYSIMGAVGSVLSGFIGPTFAIVMSNMIEVFYYKNPASMERKTKEYVFIYIGAGLYAVVAYLIQHYFFSIMGENLTTRVRRMMLAAILRNEVGWFDEEEHNSNLLAARLATDAADVKSAIAERISVILQNMTSLLTSFIVAFIIEWKVSLLILATFPLLVLANFAQQLSVKGFAGDTAKAHAKTSMIAGEGVSNIRTVAAFNAQEKILSLFCQELRVPQLRSLRRSQTSGLLFGLAQLALYSSEALILWYGAHLVSKGASTFSKVIKVFVVLVITANSVAETVSLAPEIIRGGEAVGSVFSILDRPTRIDADDPEAEPVESIRGDIELRHVDFTYPSRPDVSVFKDLNLRIRAGQSQALVGASGSGKSSVIALIERFYDPIAGKVMIDGKDIRRLNLKSLRLKIGLVQQEPALFAASIFDNIAYGKDGATEAEVIEAARAANMHTFVSGLPEGYKTPVGERGVQLSGGQKQRIAIARAVLKDPTILLLDEATSALDAESECVLQEALERLMRGRTTVLVAHRLSTIRGVDSIGVVQDGRIVEQGSHGELISRPDGAYSRLLQLQHNHI

SEQ ID NO: 17985 - protein, 1249 aa, Gossypium raimondii
MAETTETKTVPEAEKKKEQSLPFYQLFTFADRYDYMLMISGSLGAIIHGSSMPVFFLLFGEMVNGFGKNQSDLPKMTHEVAKYALYFVYLGLIVCLSSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKTAGYKLMEIIKQKPSITEDHLDGKVLPEVNGNIEFKDVTFSYPSRPDVIIFRNFSIFFPAGKTMAVVGGSGSGKSTVVSMVERFYDPNEGQVLLDNVDIKILQLKWLRSQIGLVNQEPALFATTILENILYGKPDATMDEVEAAASAANAHSFITLLPNGYSTQVGERGVQLSGGQKQRIAIARAMLKNPKILLLDEATSALDASSESIVQEALDRLMVGRTTVVVAHRLSTIRNVDSIAVIQQGQVVEIGTHEELISKAGAYASLIRFQEMVGNRDFANPSTHRSRSSRLSHSLSTKSLSLRSGSLRNLSYSYSTGADGRIEMISNAETERKNPAPHGYFCRLLNLNAPEWPYSIMGAVGSVLSGFIGPTFAIVMSNMIEVFYYTNPTSMERKTKEYVFIYIGAGLYAVVAYLIQHYFFSIMGENLTTRVRRMMLGAILRNEVGWFDEEEHNSSLLAAKLAADAADVKSAIAERISVILQNMTSLLTSFIVAFIVEWRVSLLILGTFPLLVLANFAQQLSLKGFAGDTAKAHAKTSMIAGEGVSNIRTVAAFNAQNKILSLFCHELRVPQMQSLRRSQVSGLLFGLSQLALYASEALILWYGAHLVNKGASTFSKVIKVFVVLVVTANSVAETVSLAPEIIRGGEAVGSVFSILDRSTRIDPDDPEAEPVESIRGEIELRHVDFAYPSRPDVIVFKDLNLRIRAGQSQALVGASGSGKSSVIALIERFYDPTAGKVMIDGKDIRRLNLKSLRLKIGLVQQEPALFAASIFDNIAYGKEGATEAEVIEAARAANVHGFVSALPDGYKTPVGERGVQLSGGQKQRIAIARAVLKDPTILLLDEATSALDAESECVLQEALERLMRGRTTVLVAHRLSTIRNVDSIGVVQDGRIVEQGSHSELIAQPEGAYSRLLQLQHHHI

SEQ ID NO: 17986 - protein, 1249 aa, Cajanus cajan
MAEVAEPRALPEAEKKKEQSLPFYKLFSFADKYDWMLMASGTIGAIVHGSSMPFFFLLFGQMVNGFGKNQMDLKKMTDEVSKYSLYFVYLGLVVCISSYAEIACWMYTGERQVSTLRKKYLEAVLKQDVGFYDTDARTGDIVFSVSTDTLLVQDAISEKVGNFIHYLSTFLAGLVVGFVSAWRLALLSVAVIPGIAFAGGLYAYTLTGLTSKSRESYANAGTIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIIKQKPTIVEDPLQGKCLAEVNGNIEFKDVAFSYPSRPDVFIFRSFSIFFPAGKTVAVVGGSGSGKSTVVSLIERFYDPIEGQVLLDNVDIKTLQLKWLRDQIGLVNQEPALFATTILENILYGKPDATIAEVEAATSAANAHSFITLLPNGYNTQVGERGVQLSGGQKQRIAIARAMLKNPKILLLDEATSALDAGSESIVQEALDRLMVGRTTVVVAHRLSTIRNVDTIAVIQQGQVVETGTHEELIAKAGTYASLIRFQEMVGNRDLSNPSTRRTRSSRLSHSLSTKSLSLRSGSLRNLSYQYSTGADGRIEMISNAETDKRNPAPDGYFLRLLKLNAPEWPYSIMGAVGSILSGFIGPTFAIVMSNMIEVFYFRNYASMERKTKEYVFIYIGAGIYAVGAYLIQHYFFSIMGENLTTRVRRMMLAAILRNEVGWFDEEEHNSSLVAARLATDAADVKSAIAERISVILQNMTSLLTSFIVAFIVEWRVSLLILGTFPLLVLANFAQQLSLKGFAGDTAKAHAKTSMIAGEGVSNIRTVAAFNAQNKMLSVFCHELRVPQSQSLRRSQISGLLFGLSQLALYGSEALILWYGSHLVSKGASTFSKVIKVFVVLVITANSVAETVSLAPEIIRGGEAVGSVFAILDRSTRIDPDDPDAEPVESLRGEIELRHVDFAYPSRPDVMVFKDFNLRIRAGQSQALVGASGSGKSSVIALIERFYDPIAGKVMVDGKDIRKLNLKSLRRKIGLVQQEPALFAASIFENIAYGKEGATEAEVMEAARAANAHAFVSSLPEGYKTSVGERGVQLSGGQKQRIAIARAVLKDPTILLLDEATSALDAESECVLQEALERLMRGRTTVLVAHRLSTIRGVDCIGVVQDGRIVEQGSHAELFSRPEGAYSRLLQLQNHHI

SEQ ID NO: 17987 - protein, 1250 aa, Citrullus lanatus
MAEPAAEPKALPEPEKKKEQSLPFYQLFSFADKYDWFLMILGSFGAIVHGSSMPVFFLLFGEMVNGFGKNQSNFHKMTAEVSKYALYFVYLGLIVCFSSYAEIACWMYTGERQVSTLRKKYLEAVLKQDVGFFDTDARTGDVVFSVSTDTLLVQDAISEKVGNFIHYLSTFLAGLVVGFVSAWRLALLSIAVIPGIAFAGGLYAYTLTGLTSKSRESYANAGIIAEQAIAQVRTVYSYVGESKALNSYSDSIQNTLKIGYKAGMAKGLGLGCTYGIACMSWALVFWYAGVFIRNGQSDGGKAFTAIFSAIVGGMSLGQSFSNLGAFSKGKAAGYKLMEIIKQRPTIIQDPLDGKCLGEVNGNIEFKDVTFSYPSRPDVMIFRDFSIFFPAGKTVAVVGGSGSGKSTVVSLIERFYDPNQGQVLLDNVDIKTLQLKWLRDQIGLVNQEPALFATTIYENILYGKPDATMAEVEAAAAAANAHSFITLLPNGYDTQVGERGLQLSGGQKQRIAIARAMLKNPKILLLDEATSALDAGSESIVQEALDRLMVGRTTVVVAHRLSTIRNVDSIAVIQQGQVVETGTHEELIAKSGAYSSLIRFQEMVRNREFSNPSTRRTRSSRLSHSLSTKSLSLRSGSLRNLSYSYSTGADGRIEMVSNAETDRKNPAPDGYFIRLLKLNGPEWPYSIMGAVGSVLSGFISPTFAIVMSNMIEVFYYRNSSAMERKIKEFVFIYIGIGVYAVVAYLIQHYFFTIMGENLTTRVRRMMLAAILRNEVGWFDEEEHNSSLVAARLATDAADVKSAIAERISVILQNMTSLFTSFIVAFIVEWRVSLLILAAFPLLVLANMAQQLSLKGFAGDTAKAHAKTSMIAGEGVSNIRTVAAFNAQDKILSLFRHELRVPQRQSLRRSQTAGVLFGISQLALYASEALVLWYGVHLVSNGGSTFSKVIKVFVVLVVTANSVAETVSLAPEIIRGGESIGSVFSILDRPTRIDPDDPEAETVETLRGEIELRHVDFAYPSRPDVMVFKDLNLRIRAGQSQALVGASGSGKSSVIALIERFYDPLAGKVMIDGKDIRRLNLQSLRLKIGLVQQEPALFAASIFDNIAYGKDGATEAEVIEAARAANVHGFVSGLPDGYKTPVGERGVQLSGGQKQRIAIARAVLKDPTILLLDEATSALDAESECVLQEALERLMRGRTTVVVAHRLSTIRGVDCIGVVQDGRIVEQGSHNELLSRAEGAYSRLLQLQHQHI

SEQ ID NO: 17988 - protein, 1250 aa, Cucumis sativus
MAEPVTEPKALPEPEKKKEQSLPFHQLFSFADKYDWFLMILGSFGAIIHGSSMPVFFLLFGEMVNGFGKNQSNFHKMTAEVSKYALYFVYLGLIVCFSSYAEIACWMYTGERQVSTLRKKYLEAVLKQDVGFFDTDARTGDVVFSVSTDTLLVQDAISEKVGNFIHYLSTFLAGLVVGFLSAWRLALLSIAVIPGIAFAGGLYAYTLTGLTSKSRESYANAGIIAEQAIAQVRTVYSYVGESKALNSYSDSIQNTLKIGYKAGMAKGLGLGCTYGIACMSWALVFWYAGVFIRNGQTDGGKAFTAIFSAIVGGMSLGQSFSNLGAFSKGKAAGYKLMEIIKQKPTIIQDPLDGKCLGEVNGNIEFKDVTFSYPSRPDVMIFRDFSIFFPAGKTVAVVGGSGSGKSTVVSLIERFYDPNQGQVLLDNVDIKTLQLKWLRDQIGLVNQEPALFATTIYENILYGKPDATTAEVEAAAAAANAHSFITLLPNGYDTQVGERGLQLSGGQKQRIAIARAMLKNPKILLLDEATSALDAGSESIVQEALDRLMVGRTTVVVAHRLSTIRNVDSIAVIQQGQVVETGTHDELITKSGAYSSLIRFQEMVRNREFSNPSTRRTRSSRLSHSLSTKSLSLRSGSLRNLSYSYSTGADGRIEMVSNAETDRKNPAPDGYFLRLLKLNGPEWPYSIMGAVGSVLSGFISPTFAIVMSNMIEVFYYRNSSAMERKIKEFVFIYIGIGVYAVVAYLIQHYFFTIMGENLTTRVRRMMLAAILRNEVGWFDEEEHNSSLVAARLATDAADVKSAIAERISVILQNMTSLFTSFIVAFIVEWRVSLLILAAFPLLVLANMAQQLSLKGFAGDTAKAHAKTSMIAGEGVSNIRTVAAFNAQDKILSLFCHELRIPQRQSLRRSQTAGILFGISQLALYASEALVLWYGVHLVSNGGSTFSKVIKVFVVLVVTANSVAETVSLAPEIVRGGESIGSVFSILDRPTRIDPDDPEAETVETLRGEIELRHVDFAYPSRPDVMVFKDLNLRIRAGQSQALVGASGSGKSSVIALIERFYDPLTGKVMIDGKDIRRLNLQSLRLKIGLVQQEPALFAASIFDNIAYGKDGATESEVIEAARAANVHGFVSGLPDGYNTPVGERGVQLSGGQKQRIAIARAVLKDPTILLLDEATSALDAESECVLQEALERLMRGRTTVVVAHRLSTIRSVDSIGVVQDGRIVEQGSHNELLSRAEGAYSRLLQLQHQHI

SEQ ID NO: 17989 - protein, 1250 aa, Glycine max
MAEAAEPNKALPEAEKKKEQTLPFYKLFSFADKCDWMLMISGSIGAIIHGSSMPVFFLLFGEMVNGFGKNQMNLKKMTEEVSKYALYFVYLGLVVCISSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIINQKPTIVEDPSEGKCLAEVNGNIEFKDVTFSYPSRPDMFIFRNFSIFFPAGKTVAVVGGSGSGKSTVVSLIERFYDPNEGQVLLDNVDIKTLQLKWLRDQIGLVNQEPALFATTILENILYGKPDATMAEVEAATSAANAHSFITLLPNGYNTQVGERGVQLSGGQKQRIAIARAMLKNPKILLLDEATSALDAGSENIVQEALDRLMVGRTTVVVAHRLSTIRNVDTIAVIQQGQVVETGAHEELIAKAGTYASLIRFQEMVGNRDFSNPSTRRTRSSRLSHSLSTKSLSLRSGSLRNLSYQYSTGADGRIEMISNAETDKKNPAPDGYFFRLLKMNAPEWPYSIMGAVGSVLSGFIGPTFAIVMSNMIEVFYFSNYASMERKTKEYVFIYIGAGLYAVGAYLIQHYFFSIMGENLTTRVRRMMLAAILRNEVGWFDEEEHNSSLVAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQNKMLSVFCHELRVPQSQSLRRSLTSGFLFGLSQLALYASEALILWYGAHLVSKGVSTFSKVIKVFVVLVITANSVAETVSLAPEIIRGGEAVGSVFSILDRSTRIDPDDPDADPVESLRGEIELRHVDFAYPSRPDVMVFKDFNLRIRAGQSQALVGASGSGKSSVIALIERFYDPIAGKVMVDGKDIRKLNLKSLRLKIGLVQQEPALFAASIFENIAYGKEGATEAEVIEAARAANVHGFVSGLPEGYKTPVGERGVQLSGGQKQRIAIARAVLKDPTILLLDEATSALDAESECVLQEALERLMRGRTTVLVAHRLSTIRGVDCIGVVQDGRIVEQGSHSELVSRHEGAYSRLLQLQHHHI

SEQ ID NO: 17990 - protein, 1243 aa, Manihot esculenta
MAAESVDTTNNTNTKGSLPEAEKKKEQSLPFYQLFSFADKYDWLLMISGSIGAIIHGSSMPVFFLLFGEMVNGFGKNQSDLEKMTHEVSKYALYFVYLGLVVCLSSYAEISCWMYTGERQVGTLRKKYLEAVLKQDVGFFDTDARTGDIVFSVVGNFIHYLSTFLAGLVVGFVSAWRLALLSVAVIPGIAFAGGLYAYTLTGLTSKSRESYAQAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIIRQKPTIIQDPSDGKCLPEVNGNIEFKDVTFSYPSRPDVIIFRDFSIFFPAGKTVAVVGGSGSGKSTVVSLIERFYDPNQGQVLLDNVDIKTLQLRWLRDQIGLVNQEPALFATTILENILYGKPDATMDEVEAAASAANAHSFITLLPNGYNTQVGERGVQLSGGQKQRIAIARAMLKNPKILLLDEATSALDAGSESIVQEALDRLMVGRTTVVVAHRLSTIRNVDTIAVIQQGQVVETGTHEELISKGGAYASLIRFQEMVRTRDFANPSTRRSRSTRLSHSLSTKSLSLRSGSLRNLSYSYSTGADGRIEMISNAETDRKNPAPDGYFCRLLKLNAPEWPYSIMGAIGSVLSGFIGPTFAIVMSNMIEVFYYRNPASMERKTKEYVFIYIGAGLYAVVAYLIQHYFFSIMGENLTTRVRRMMLAAILRNEVGWFDEEEHNSSLVAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQDKISSLFSYELRVPQLRSLRRSQTSGLLFGLSQLALYASEALILWYGAHLVSKGSSTFSKVIKVFVVLVITANSVAETVSLAPEIIRGGEAVGSVFSILDRSTRIDADDPEADSVESIHGEIELRHVDFAYPSRPDVPVFKDLNLRIRAGQSQALVGASGCGKSSVIALIERFYDPTAGKVMIDGKDIRRLNLKSLRLKIGLVQQEPALFAASIFDNIAYGKEGATEAEVIEAARAANVHGFVSALPDGYKTPVGERGVQLSGGQKQRIAIARAVLKDPAILLLDEATSALDAESECVLQEALERLMRGRTTVLVAHRLSTIRGVDSIGVVQDGRIVEQGSHSELVSRPDGAYSRLLQLQHHHI

SEQ ID NO: 17991 - protein, 1249 aa, Rosmarinus officinalis
MAEGGDGKAMPEAEKKKEQSLPFYQLFSFADKYDVVLMIAGSLGAIVHGSSMPVFFLLFGEMVNGFGKNQMDLHKMTHEVSKYALYFVYLGLVVCFSSYAEIACWMYTGERQAGTLRKKYLEAVLKQDVGFFDTDARTGDIVFSVSTDTLLVQDAISEKVGNFIHYLSTFLAGLVVGFVSAWKLALLSVAVIPGIAFAGGLYAYTLTGLTSKSRESYANAGIIAEQSIAQVRTVYSYVGETKALGAYSDLIQNTLKLGYKAGMAKGLGLGCTYGIACMSWALVFWYAGVFIRNGQTDGGKAFTAIFSAIVGGMSLGQSFSNLGAFSKGKAAGYKLMEIIKQKPTIVDDTCNGNCLTDIRGNIEFKSVTFSYPSRPDVIIFRDFSIFFPAGKTVAVVGGSGSGKSTVVSLIERFYDPNQGEILLDNVDIKTLQLRWLRNQIGLVNQEPALFATTILENIFYGKPDATMAEVEAAASAANAHSFITLLPNGYNTQVGERGVQLSGGQKQRIAIARAMLKDPKILLLDEATSALDASSESIVQEALDRLMVGRTTVVVAHRLSTIRNVDSIVVIQQGQVVETGTHEELISKAAAYASLIRFQEMVGNRDLSNPSTRRTRSTRLSHSLSTKSLSLRSGSLRNLSYSYSTGADGRIEMVSNAETDRKNPAPAGYFCRLLTLNAPEWPYSIMGAIGSVLSGFIGPTFAIVMSNMIEVFYYRNPAAMERKTKEYVFIYIGAGLYAVVAYLIQHYFFSIMGENLTTRVRRMMLAAILRNEVAWFDEEENNSSLLSARLATDAADVKSAIAERISVMLQNMTSLLTSFIVAFIVEWRVSLLILGTFPLLVLANFAQQLSLKGFAGDTAKAHAKTSMIAGEGVSNIRTVAAFNAQEKILSLFCHELRLPQRRSLARSQSSGFLFGLSQLALYGSEALILWYGAHLVSKGVSTFSKVIKVFVVLVITANSVAETVSLAPEIIRGGEAVGSVFSVLDRSTRIDPDDPEAEPVESIRGDIELRHVDFAYPSRPDVMVFKDLSLRIRAGQSQALVGASGSGKSSVIALIERFYDPLSGKVMIDGRDIRRLNLKSLRLKIGLVQQEPALFAASILDNIAYGKDGATEGEVIEAARAANVHTFVSRLPEGYKTPVGERGVQLSGGQKQRIAIARAVLKDPSILLLDEATSALDAESECVLQEALERLMRGRTTVLVAHRLSTIRGVDSIGVVQDGRIVEQGSHGELISRPEGAYSRLLQLQHHRI

SEQ ID NO: 17992 - protein, 1251 aa, Echinacea purpurea
MADATEPTKAMPAQAEKKKEQTLPFYQLFLFADKLDYALMILGSIGAVVHGSSMPFFFLLFGQMVNGFGKNQSDLNTMTHEVSKYALYFVYLGLVVCVSSYAEIGCWMYTGERQVSALRKRYLEAVLKQDVGFYDTDARTGDIVFSVSTDTLLVQDAISEKVGNFIHYLSTFLAGLVVGFVSAWKLALLSVAVIPGIAFAGGLYAYTLTGLTSKSRESYANAGIIAEQAIAQVRTVYSYVGETKALDSYSDAIQHTLKLGYKAGMAKGLGLGCTYGIACMSWALVFWYAGVFIRNGQTDGGKAFTAIFSAIVGGMSLGQSFSNLGAFSKGKAAGYKLLEIIKQNPTIVQDSKDGMCLAEVNGNIEFKEISFSYPSRPDVFIFRNFSILFPAGKTVAVVGGSGSGKSTVVSLIERFYDPNQGQILLDNVDIKTLQLKWLRDQIGLVNQEPALFATTILENILYGKPDATTDEVEAAASAANAHSFITSLPNGYNTQVGERGIQLSGGQKQRITIARAMLKNPKILLLDEATSALDSGSESIVQEALDRLMVGRTTVVVAHRLSTIRNVNSIAVIQQGQIVETGTHEELISKAGAYASLIRFQEMAGTRDFSNPSTRRTRSTRLSHSLSTKSLSLRSGSLRNLSYSYSTGADGRIEMISNAETDKKNPAPRGYFFRLLKMNAPEWPYSIMGAVGSVLSGFIGPTFAIVMSNMIEVFYFNNPAQMERKTKEYVFIYVGAGLYAVVAYLIQHYFFSIMGENLTTRVRRMMLSAILRNEVGWFDEEEHNSSLVAAKLATDAADVKSAIAERISVILQNMTSLLTSFVVAFIVEWRVSLLILATFPLLVLAHFAQQLSLKGFAGDTAKAHAKTSMIAGEGVSNIRTVAAFNAQDKILSLFSAELRVPQKQSLRRSQFSGMIFGISQLALYASEALILWYGAHLVTKGLSTFSKVIKVFIVLVITANSVAETVSLAPEIIRGGEAIGSVFSILDRSTRIDPDDPDADQVETIRGEIELRHVDFSYPSRPDVIVFKDFSLRIRAGQSQALVGASGSGKSSVIALIERFYDPTAGKVMIDGKDIRRLNLKSLRLKIGLVQQEPALFATTIMENIVYGKDGATEAEVIAAATAANVHTFISGLPEGYKTPVGERGVQLSGGQKQRIAIARAILKDPRILLLDEATSALDAESECALQEALERLMRGRTTVLVAHRLSTIRGVDSIGVVQDGRIVEQGSHGELISRPEGAYSRLLQLQQHRI

SEQ ID NO: 17993 - protein, 1251 aa, Mimulus guttatus
MAEAADGKAMPESPEKKKEQSLPFYQLFSFADKYDLILMTTGSLGAIIHGSSMPVFFLLFGEMVNGFGKNQMDLHKMTNEVAKYALYFVYLGLVVCFSSYAEIACWMYTGERQVGTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQSIAQVRTVYSYVGETKTLGAYSDLIQNTLKLGYKAGMAKGLGLGCTYGIACMSWALVFWYAGVFIRNGQTDGGKAFTAIFSAIVGGMSLGQSFSNLGAFSKGKAAGFKLMEIIKQKPTIVQDDLDSKCLTEVNGNIEFKNVTFSYPSRPDVIIFRDFSIFFPAGKTVAVVGGSGSGKSTVVSLIERFYDPNQGEILLDNVDIKTLQLRWLRSQMGLVNQEPALFATTILENILYGKPDATMSEVEAASSAANAHSFITLLPNGYNTQVGERGVQLSGGQKQRIAIARAMLKDPKILLLDEATSALDAGSESIVQEALDRLMIGRTTVVVAHRLSTIRNVDSIAVIQQGQVVETGTHEELIAKAAAYANLIRFQEMVGNRDFSNPSTRRTRSSRLSHSLSTKSLSLRSGSLRNLSYSYSTGADGRIEMVSNAETERKNPAPSGYFCRLLTLNAPEWPYSIMGAVGSVLSGFIGPTFAIVMSNMIEVFYYQNPADMERKTKEYVFIYIGAGIYAVIAYLIQHYFFSIMGENLTTRVRRMMLAAILRNEVGWFDEEENNSSLLANRLATDAADVKSAIAERISVILQNMTSLLTSFIVAFIVEWRVSLLILATFPLLVLANFAQQLSLKGFAGDTAKAHAKTSMIAGEGVSNIRTVAAFSAQEKILSLFSNELRLPQKQSLRRSQCSGLLFGLSQLALYASEALILWYGSHLVSKGVSTFSKVIKVFVVLVITANSVAETVSLAPEIIRGGEAVGSVFSILDRPTRIDPDDTEAETVESIRGEIELRHVDFAYPSRPDVMVFKDFSLRIRAGHSQALVGASGSGKSSVIALIERFYDPLSGKVMVDGKDIRRLNLKSLRRRIGLVQQEPALFAASIFENIAYGKDGAATEAEVIEAARAANVHTFVSGLPEGYKTPVGERGVQLSGGQKQRIAIARAVLKDPSILLLDEATSALDAESECVLQEALERLMRGRTTVLVAHRLSTIRGVHSIGVVQDGRIVEQGSHNELIGRPESAYSKLLQLQHHRI

SEQ ID NO: 17994 - protein, 1250 aa, Chenopodium quinoa
MAQSTADGKAMAEAEKKKDQTLPFYQLFTFADKYDYLLMSIGSLGAVIHGSSMPVFFLLFGEMVNGFGKNQLNLQTMTHEVSKYALYFVYLGLIVCASSYAEIACWMYSGERQAGTLRKKYLEAVLKQDVGFFDTDARTGDIVFSVSTDTLLVQDAISEKVGNFIHYLSTFLAGLVVGFVSAWKLALLSVAVIPGIAFAGGLYAYTLTGLTSKSRQSYANAGIIAEQAIAQVRTVYSYVGETKALDSYSDAIQNTLKLVYKAGMAKGLGLGCTYGIACMSWALVFWYAGVFIRNGQTDGGKAFTAIFSAIVGGMSLGQSFSNLGAFSKGKAAGYKLMEIIKQKPTIVQDQADGKCLEEVSGNIEFKNVSFSYPSRPDVMIFRDFSIFFPAGKTVAVVGGSGSGKSTVVSLIERFYDPNGGQVLLDNNDIRTLQLTWLRGQIGLVNQEPALFATTILENILYGKPDATMAEVEAATNSANAHSFITLLPNGYNTHVGERGVQLSGGQKQRIAIARAMLKNPKILLLDEATSALDASSESIVQEALDRLMVGRTTVVVAHRLSTIRNVDTIAVIQQGQVVETGTHEELIAKAGAYASLIRFQEMVGNRDFSNPSTRRTRSSRLSCSLSTKSLSLRSGSLRNLSYSYSTGLDGRIEMVSNAESERKNPAPRNYFFRLLKLNAPEWPYSIMGAVGSILSGFIGPTFAIVMSNMIEVFYYSNYASMEKKTKEYVFIYIGAGLYAVVAYLIQHYFFSIMGENLTTRVRRMMLAAILRNEVGWFDEEEHNSSLLAARLATDAADVKSAIAERISVILQNMTSLLTSFIVAFIVEWRVSLLILGTFPLLVLANFAQQLSLKGFAGDTAKAHAKTSMIAGEGVSNIRTVAAFNAQEKILSLFCHELRVPQKRSFRRSQTSGGLFGISQLALYGSEALILWYGAHLVSKGLSTFSKVIKVFVVLVITANSVAETVSLAPEIIRGGEAVGSVFSILDRCTRIDPDDSEAEPVESIRGEIEFRHVDFAYPTRPDILVFKDFNLRIRAGQSQALVGASGSGKSSVIALIERFYDPCGGKVMIDGKDIRRLNLKALRLKIGLVQQEPALFAASIFDNIVYGKEGATEAEVIEAARAANVHGFVSALPEGYKTTVGERGVQLSGGQKQRIAIARAVLKDPAILLLDEATSALDAESECVLQEALERLMRGRTSVLVAHRLSTIRGVSSIGVVQDGRIVEQGSHSELISRPEGAYSRLSQLQLHHV

SEQ ID NO: 17995 - protein, 1249 aa, Aquilegia formosa
MAETTEVKAIHEAEKKKDQSLPFYQLFTFADKYDWFIMSIGSIGAIIHGSAMPVFFLLFGKMVNGFGQNQSDLHSMVHQVSKYSLYFVYLGLIVCLSSYAEIACWMYTGERQVSTLRKKYLEAVLKQDVGFFDTDARTGDIVFSVSTDTLLVQDAISEKVGNFIHYLSTFLAGLVVGFVSAWKLALLSVAVIPGIAFAGGLYAYTLTGLTSKSRESYANAGIIAEQAIAQVRTVYSYVGETKALNSYSDAIQNTLKLGYKAGIAKGLGIGCTYGIACMSWALVFWYAGVFIRNGQTDGGKAFTAIFSAIVGGMSLGQSFSNLGAFSKGKMAGYKLMEIIKQKPSIVQDSLDGKCLQEVNGNIEFKDIAFSYPSRPDVIIFRNFSISFPAGKTVAVVGGSGSGKSTIVSLIERFYDPSQGQVLLDNVDIKTLQLKWLRDQIGLVNQEPALFATTILGNILYGKPDATMAEVEAAASAANAHSFITLLPNGYNTQVGERGVQLSGGQKQRIAIARAMLKDPKILLLDEATSALDAGSECFVQEALDRLMVGRTTIVVAHRLSTIRNVDSIAVLQQGQVVETGTHEELIAKAGAYASLIRFQEMARNRDFSVPLAHQSRSSRLSHSLSTKSLSLRSGSLRNLSYQYSTGADGRLEMISKADTERKNPAPNGYFLRLLKLNAPEWPYVIMGAVGSILSGFIGPTFAIVMSNMIEVFYYRDLSAMERKTKEFVFIYIGAGLYAVVAYLTQHYFFSIMGENLTTRVRRMMLSVILRNEVGWFDEDENNSSLIAARLATDAADVKSAIAERISVILQNMTSLLISFIVAFIVEWRVSLLILGTFPLLVLANFAQQLSMKGFAGDTAKAHAKTSMIAGEGVSNIRTVAAFNAQDKILSLFSHELRIPQLRNLRRSQSAGLLFGLSQLALYASEALILWYGVHLVSRGLSTFSKVIKVFIVLVITANSVAETVSLAPEIIRGGEAVSSVFSILDRSTRIDPDDPEAQQVETIRGEIELHHVDFSYPARPDLIVFKDFNLRIRAGKSQALVGASGSGKSSVIALIERFYDPTGGKVLIDGKDIRRLNLKSLRLKIGLVQQEPALFATSIFENIAYGKDGATEAEVIEAARAANVHVFVSSLPEGYKTPVGERGVQLSGGQKQRIAIARAVLKDPAVLLLDEATSALDAESECVLQEALERLMRGRTTVLVAHRLSTIRGVDNIGVVQDGHIIEQGSHSELLNRPDGAYCKLLQLQHHSI

SEQ ID NO: 17996 - protein, 1224 aa, Vinca minor
LFSFADKYDYVLMISGSIGAIIHGSSMPVFFLLFGQMVNGFGKNQSDLHKMTHEVAKYALYFVYLGLVVCFSSYAEIACWMHTGERQAGALRRKYLEAVLKQDVGFFDTDARTGDIVFSVSTDTLLVQDAISEKVGNFIHYLSTFLAGLVVGFVSAWKLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIIKQKPTIVQDHEDGKCLDEVNGNIEFKSVTFSYPSRPDVIIFRDFTIFFPAGKTVAVVGGSGSGKSTVVSLIERFYDPNQGEILLDNVDIKTLQLRWLRDQIGLVNQEPALFATTILENILYGKPDATMAEVEAATSAANAHSFITLLPNGYKTQVGERGVQLSGGQKQRVAIARAMLKNPKILLLDEATSALDAGSESIVQEALDRLMVGRTTVVVAHRLSTIRNVDSVAVIQQGQVVETGTHEELVAKAGAYASLIRFQEMVGNRDFSNPSTRRTRSSRLSHSLSTKSLSLRSGSLRNLSYSYSTGADGRIEMVSNAETERKNPAPHGYFCRLLKLNAPEWPYSIMGAIGSVLSGFIGPTFAIVMSNMIEVFYYRNPASMERKTKEYVFIYIGAGLYAVVAYLIQHYFFSIMGENLTTRVRRMMLAAILRNEVGWFDEEEHNSTLLAARLATDAADVKSAIAERISVILQNMTSLLTSFIVAFIVEWKVSLLILATFPLLVLANFAQQLSLKGFAGDTAKAHAKTSMIAGEGVSNIRTVAAFNAQEKILSLFSQELHVPQLRSLRRSQTSGLLFGLSQLALYSSEALILWYGSHLVSKGASTFSKVIKVFVVLVITANSVAETVSLAPEIIRGGEAVGSVFSVLDRSTRIDSDDPEAETVESMRGDIEFRHVDFAYPSRPDVTVFKDLNLRIRAGQSQALVGASGSGKSSVIALIERFYDPIAGKVMIDGKDIRRLNLKSLRLKIGLVQQEPALFAASIYDNIAYGKEGATEAEVIEAARAANMHAFVSSLPEGYKTPVGERGVQLSGGQKQRIAIARAVLKDPTILLLDEATSALDAESECVLQEALERLMRGRTTVLVAHRLSTIRGVDCIGVVQDGRIIEQGSHGELISRPDGAYSRLLQLQHNHI

SEQ ID NO: 17997 - protein, 1249 aa, Aquilegia formosa
MAETVEPKVVLEAEKKKEQSLPFYQLFTFADKYDYLLMIGGSLGAFIHGSAMPVFFLLFGEMVNGFGKNQSDLKKLTEEVSKYALYFVYLGLVVCLSSYAEIACWMYTGERQVSTLRKKYLEAVLKQDVGFFDTDARTGDIVFSVSTDTLLVQDAISEKVGNFIHYLSTFLAGLVVGFISAWRLALLSIAVIPGIAFAGGLYAYTLTGLTSKSQESYANAGIIAEQAVAQVRTVYSYVGESKTLNSYSDAISDTLKLGYKAGIAKGLGIGCTYGIACMSWALVFWYAGVFIRNGQTDGGKAFTAIFSAIVGGISLGQSFSNLGAFSKGKAAGYKLMEIIKQKPSIVQDVSGGKCLTEVMGNIEFKDVTFSYPSRPDVIILRDFSIFFPAGKTVAVVGGSGSGKSTVVSLIERFYDPNQGQVLLDNADIKTLQLKWLRNQTGLVNQEPALFATTILENILYGKPDATISEVEAAATAANAHSFITLLPNGYNTQVGERGVQLSGGQKQRIAIARAMLKNPKILLLDEATSALDAGSESIVQEALDRLMVGRTTIVVAHRLSTIRNVDTIAVIQQGQVVETGTHEELISKAGAYASLIRFQEMVRNRDNSTPSTHHSRSTRLSHSLSTKSLSLRSGSLRNLSYQYSTGADGRLEMISNADIGRKIPAPKGYFIRLLRMNSPEWPYSLMGAVGSILSGFIGPTFAIVMSNMIEVFYYKDPSAMERKTKQFVFIYIGAGLYAVGAYLTQHYFFSIMGENLTTRVRRMMLAAILRNEVGWFDEEENNSSLVAARLATDAADVKSAIAERISVILQNMTSLLTSFIVAFIIEWRVSLLILGTFPLLVLANFAQQLSMKGFAGDTAKAHAKTSMIAGEGVSNIRTVAAFNAQDKILSLFSHELRIPQLRSLRRSQSAGLLFGLSQLALYTSEALILWYGAHLVSKGVSTFSKVIKVFVVLVITANSVAETVSLAPEIIRGGESVSSVFSILDRSTKIDPDDPDAEVVESVRGDIELRHVDFAYPLRPEVSVFRDFNLRIRAGQSQALVGASGSGKSSVIALIERFYDPVVGKILIDGKDIRRLNLKSLRLKIGLVQQEPALFASSIFENIAYGKDGATEAEVIEAARAANVHGFVSGLPNGYKTPVGERGVQLSGGQKQRIAIARAVLKSPAILLLDEATSALDAESECMLQEALERLMKGRTTILVAHRLSTIRGVDNIGVVEDGHIVEQGSHAELVSRADSAYYRLLQLQHHHI

SEQ ID NO: 17998 - protein, 1249 aa, Lactuca sativa
MAETVKAMPAQAEKKKEQSLPFYQLFSFADKLDYVLMIFGSIGAIVHGSSMPVFFLLFGQMVNGFGKNQTDLSTMTHEVSKYALYFVYLGLVVCVSSYAEIGCWMYTGERQVSALRKRYLEAVLKQDVGFYDTDARTGDIVFGVSTDTLLVQDAISEKVGNFIHYLSTFLAGLVVGFVSAWKLALLSIAVIPGIAFAGGLYAYTLTGLTSKSRESYANAGIIAEEAIAQVRTVYSYVGETKALNSYSDAIQHTLKLGYKAGMAKGLGLGCTYGIACMSWALVFWYAGVFIRNGQTDGGKAFTAIFSAIVGGMSLGQSFSNLGAFSKGKAAGYKLFEIIKQKPTIHHNTVNGKCLTEVNGNIEFKEVTFSYPSRPDVIIFRSFSIFFPAGKTVAVVGGSGSGKSTVVSLIERFYDPNQGQILLDNVDIKTLQLEWLRDQIGLVNQEPALFATTILENILYGKRDATMADVESATSAANAHSFITLLPNGYNTQVGERGIQLSGGQKQRIAIARAMLKNPKILLLDEATSALDSGSESIVQEALDRLMIGRTTVVVAHRLSTIRNVDSVAVIQQGHVVETGTHEELISKPGAYASLIRFQEMAGNRDFSNPSTRRTRSTRLSHSLSTKSLSLRSGSLRNLSYQYSTGADGRIEMISNAETDRKNPAPSGYFFRLLKMNAPEWPYSIMGAVGSVLSGFIGPTFAIVMSNMIEVFYYDNPDKMESKTKECVFIYVGAGLYAVVAYLIQHYFFSIMGENLTTRVRRMMLAAIMRNEVGWFDEEEHNSSLVAARLATDAADVKSAIAERISVILQNMTSLLTSFVVAFIVEWRVSLLILGTFPLLVLAHFAQQLSLKGFAGDTAKAHAKTSMIAGEGVSNIRTIAAFNAQDKILSLFSDELRVPQKQSLRRSQISGILFGVSQLALFASEALILWYGAHLVKNGVSTFSKVIKVFVVLVITANSVAETVSLAPEIIRGGEAIGSVFSVLDRSTRIDPDDPDSEPVETIRGEIELRHVDFSYPSRPDVIIFKDLSLRIRSGQSQALVGASGCGKSSIIALIERFYDPSAGKVMIDGKDIRRLNLRSLRAKIGLVQQEPALFAASIMENIAYGKEGATEAEVIEAARAANVHVFVSGLPQGYKTPVGERGVQLSGGQKQRIAIARAVLKDPTILLLDEATSALDAESECVLQEALERLMRGRTTVLVAHRLSTIRGVDNIGVVQDGRIVEQGSHGELLSRGADGAYSRLLQLQHHRI

SEQ ID NO: 17999 - protein, 1254 aa, Triphysaria pusilla
MAEAADVGKPMPLPAESEKKKAQSLPFYQLFTFADKYDLVLMITGSLGAIIHGSSMPVFFLLFGQMVNGFGKNQMDLQKMTHEVAKYALYFVYLGLIVCFSSYAEISCWMYTGERQVGAMRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYASAGIIAEQSIAQVRTVYSYAGETKALNAYSDLIQNTLKLGYKAGMAKGLGLGCTYGIACMSWALVFWYAGVFIRNGQTDGGKAFTAIFSAIVGGMSLGQSFSNLGAFSKGKAAGYKLMEIIKQKPTIVQDGEGSKCLSKVNGNIEFKNVTFSYPSRPDVIIFRDFSIFFPAGKTIAVVGGSGSGKSTVVSLIERFYDPNQGEILLDEVDIKTLQLRWLRNQIGLVNQEPALFATTILENILYGKPDATMAEVEAAASAANAHSFVTLLPNGYNTQVGERGVQLSGGQKQRIAIARAMLKDPKILLLDEATSALDAGSESIVQEALDRLMVGRTTVIVAHRLSTIRNVDSISVIQQGQVVETGTHEELISKAGAYASLIRFQEMIGNREITTNPSTIRNRSSRLSHSLSTKSLSLRSGSLRNLSYSYSTGADGRIEMVSNAETDRKNPAPAGYFCRLLKLNAPEWAYSIMGGVGSILSGFIGPTFAIVMSNMIEVFYYQNSADMERKTKEYVFIYIGAGIYAVGAYLIQHYFFSIMGENLTTRVRRMMLAAILRNEVGWFDEEENNSGLLAARLSADAADVKSAIAERISVILQNMTSLLTSFIVAFIVEWRVSLLILATFPLLVLANFAQQLSLKGFAGDTAKAHAKTSMIAGEGVSNIRTVAAFNAQEKILSLFSHELRLPQNRSLRRSQSSGFLFGLSQLALYASEALILWYGAHLVSKGLSTFSKVIKVFVVLVITANSVAETVSLAPEIIRGGEAVGSVFSILDRSTRIDPDDTEADPVETIRGEIELRHVDFAYPSRPDVLVFKDFNLRIRAGQSQALVGASGSGKSSVIALIERFYDPIGGKVMIDGKDIRRLNLKSLRLKIGLVQQEPVLFATSIFDNIAYGKNGATETEVIEAARAANVHTFVSGLPEGYKTPVGERGVQLSGGQKQRIAIARAVLKDPSILLLDEATSALDAESECVLQEALERLMRGRTTVLVAHRLSTIRGVDSIGVVQDGRIVEQGSHGELVSRHDGAYSRLLQLQHHRI

SEQ ID NO: 18000 - protein, 1246 aa, Helianthus annuus
MAETAKTMPEKKKEQTLPFYKLFSFADKYDYILMISGSIGAIIHGSSMPFFFLLFGQMVNGFGKNQSDLSTMTHEVSKYALYFVYLGLVVCVSSYAEIGCWMYTGERQVSALRKRYLEAVLKQDVGFYDTDARTGDIVFGISTDTLLVQDAISEKVGNFIHYLSTFLAGLVVGFVSAWKLALLSIAVIPGIAFAGGLYAYTLTGLTSKSRESYANAGIIAEEAIAQVRTVYSYVGETKALNSYSDAIQHTLKLGYKAGMAKGLGLGCTYGIACMSWALVFWYAGVFIRNGQTDGGKAFTAIFSAIVGGMSLGQSFSNIGAFSKGKAAGYKLLEIIQQKPTIAHNSTDGKCLAEVNGNIEFKEVTFSYPSRPDVIIFRNFSIFFPAGKTVAVVGGSGSGKSTVVSLIERFYDPNQGQILIDNVDIKTLQLRWLRDQIGLVNQEPALFATTILENILYGKPDATMAEVEAAASAANAHSFITLLPNGYNTQVGERGVQLSGGQKQRIAIARAMLKNPKILLLDEATSALDSGSESIVQEALDRLMLGRTTVVVAHRLSTIRNVDSIAVIQQGQVVETGTHEELISKPGPYASLIRFQEMAGNRDFSNPSTHRTRSTRLSHSLSTKSLSLRSGSLRNLSYSYSTGADGRIEMISNAETERKNPAPSGYFFRLLKLNAPEWPYSIMGAVGSILSGFIGPTFAIVMSNMIEVFYYNNPAKMESKTKECVFIYVGAGLYAVVAYLIQHYFFSIMGENLTTRVRRMMLAAILRNEVGWFDEEEHNSSLVAARLATDAADVKSAIAERIAVILQNVTSLLTSFVVAFIVEWRVSLLILGTFPLLVMAYFAQQLSLKGFAGDTAKAHAKTSMIAGEGVSNIRTIAAFNAQDKILTLFSNELRVPQSQSLRRSQFSGILFGISQLALFSSEALILWYGAHLVSVHVSTFSKVIKVFVVLVITANSVAETVSLAPEIIRGGEAIGSVFSVLDRSTRIDPDDPDAETVETIRGEIELRHVDFSYPSRPDVMIFKDLSLRIRAGQSQALVGASGSGKSSIIALIERFYDPTAGKVMIDGKDIRRLNLRALRAKIGLVQQEPALFAASIMENIAYGKDGATESEVIEAARAANVHTFVSGLPQGYKTPVGERGVQLSGGQKQRIAIARAVLKDPTILLLDEATSALDAESECVLQEALERLMRGRTTVLVAHRLSTIRGVDNIGVVQDGRIVEQGSHSELLSRGSDGAYFRLLQLQQHRA

SEQ ID NO: 18001 - protein, 1251 aa, Chrysanthemum coronarium
MADSTEPTKPMPPPPEKKKEHSLPFFKLFSFADKLDYMLMSLGTIGAIIHGSSMPCFFLLFGQMINGFGKNQSDLTTMTHEVSKYALYFVYLGLVVCVSSYAEIGCWMYTGERQVSALRKRYLEAVLKQDVGFYDTDARTGDIVFSVSTDTLLVQDAISEKVGNFIHYLSTFLAGLVVGFVSAWKLALLSVAVIPGIAFAGGLYAYTLTGLTSKSRESYANAGIIAEQAIAQVRTVYSYVGETKALDSYSDAIQHTLKLGYKAGMAKGLGLGCTYGIACMSWALVFWYAGVFIRNGQTDGGKAFTAIFSAIVGGMSLGQSFSNLGAFSKGKAAGYKLFEMIKQKPTIVQDSTDGKCFSEVNGNIEFKDISFSYPSRPDVLIFRNFSIFFPAGKTVAVVGGSGSGKSTVVSLIERFYDPNQGQILLDNVDIKTLQLRWLRDQIGLVNQEPALFATTILENILYGKPDATTAEVEAATSAANAHSFITLLPNGYNTQVGERGVQLSGGQKQRIAIARAMLKDPKILLLDEATSALDSGSESIVQEALDRLMIGRTTVVVAHRLSTIRNVDSIAVLQQGQIVETGTHEELISKPGAYASLIRFQEMVGNRDFSNPSTHRTRSSRLSHSLSTKSLSLRSGSLRNLSYQYSTGADGRIEMVSNAETDRKNPAPSGYFFRLLKMNAPEWPYSIMGAVGSILSGFIGPTFAIVMSNMIEVFYFNNPARMERKTKEYVFIYVGAGLYAVVAYLIQHYFFSIMGENLTTRVRRMMLSAIMRNEVGWYDEEEHNSSLVAARLATDAADVKSAIAERISVILQNMTSLLTSFVVAFIVEWRVSLLILATFPLLVLAHFAQQLSLKGFAGDTAKAHAKTSMIAGEGVSNIRTVAAFNAQDKILSLFSAELRVPQKQSLRRSQFSGMLFGISQLALFASEALILWYGAHLVNKGLSTFSKVIKVFIVLVITANSVAETVSLAPEIIRGGEAIGSVFSILDRSTRIDPDDPDAEVVETMRGEIELRHVDFAYPSRPDIMVFKDFSLRIRAGQSQALVGASGSGKSSVIALIERFYDPITGRVMIDGKDIRRLNLKSLRLKIGLVQQEPALFAASIMENIAYGKEGATEAEIIAAATAANVHTFVSGLPEGYHTPVGERGVQLSGGQKQRIAIARAVLKNPTILLLDEATSALDAESECVLQEALERLMRGRTVVLIAHRLSTIRGVDSIGVVQDGRIVEQGSHGELVSRPEGAYSRLLQLQQHRI

SEQ ID NO: 18002 - protein, 1241 aa, Chrysanthemum coronarium
MPPPPEKKKEHSLPFFKLFSFADKLDYMLMSLGTIGAIIHGSSMPCFFLLFGQMINGFGKNQSDLTTMTHEVSKYALYFVYLGLVVCVSSYAEIGCWMYTGERQVSALRKRYLEAVLKQDVGFYDTDARTGDIVFSVSTDTLLVQDAISEKVGNFIHYLSTFLAGLVVGFVSAWKLALLSVAVIPGIAFAGGLYAYTLTGLTSKSRESYANAGIIAEQAIAQVRTVYSYVGETKALDSYSDAIQHTLKLGYKAGMAKGLGLGCTYGIACMSWALVFWYAGVFIRNGQTDGGKAFTAIFSAIVGGMSLGQSFSNLGAFSKGKAAGYKLFEMIKQKPTIVQDSTDGKCFSEVNGNIEFKDISFSYPSRPDVLIFRNFSIFFPAGKTVAVVGGSGSGKSTVVSLIERFYDPNQGQILLDNVDIKTLQLRWLRDQIGLVNQEPALFATTILENILYGKPDATTAEVEAATSAANAHSFITLLPNGYNTQVGERGVQLSGGQKQRIAIARAMLKDPKILLLDEATSALDSGSESIVQEALDRLMIGRTTVVVAHRLSTIRNVDSIAVLQQGQIVETGTHEELISKPGAYASLIRFQEMVGNRDFSNPSTHRTRSSRLSHSLSTKSLSLRSGSLRNLSYQYSTGADGRIEMVSNAETDRKNPAPSGYFFRLLKMNAPEWPYSIMGAVGSILSGFIGPTFAIVMSNMIEVFYYNNPARMEKKTKEYVFIYVGAGLYAVVAYLIQHYFFSIMGENLTTRVRRMMLSAIMRNEVGWYDEEEHNSSLVAARLATDAADVKSAIAERISVILQNMTSLLTSFVVAFIVEWRVSLLILATFPLLVLAHFAQQLSLKGFAGDTAKAHAKTSMIAGEGVSNIRTVAAFNAQDKILSLFSAELRVPQKQSLRRSQFSGMLFGISQLALFASEALILWYGAHLVNKGLSTFSKVIKVFIVLVITANSVAETVSLAPEIIRGGEAIGSVFSILDRSTRIDPDDPDAEVVETMRGEIELRHVDFAYPSRPDIMVFKDFSLRIRAGQSQALVGASGSGKSSVIALIERFYDPITGRVMIDGKDIRRLNLKSLRLKIGLVQQEPALFAASIMENIAYGKEGATEAEIIAAATAANVHTFVSGLPEGYHTPVGERGVQLSGGQKQRIAIARAVLKNPTILLLDEATSALDAESECVLQEALERLMRGRTVVLIAHRLSTIRGVDSIGVVQDGRIVEQGSHGELVSRPEGAYSRLLQLQQHRI

SEQ ID NO: 18003 - protein, 1257 aa, Euphorbia peplus
LHKMAAENIDSNKSALPLAEAEKKKEQSLPFFQLFSFADKYDWLLMIIGTIGAIIHGSSMPCFFLLFGEMINGFGKNQSDLSLMTHEVEKYALYFVYLGGVVCVASYAEVACWMYSGERQVGTLRKKYLEAVLKQDVGFFDTDARTGDIVFSVSTDTLLVQDAISEKVGNFIHYLSTFLAGLVVGFVSAWRLALLSVAIIPGIAFAGGLYAYTLTGLTSKSRQSYALANVIAEQAIAQVRTVYSYVGETKALNSYSDAIQNTLKLGYKAGMAKGLGLGCTYGIACMSWALVFWYAGVFIRNGQSDGGKAFTAVFSAIVGGLSLGQSFSNLGPFSKGKAAGYKLMEIIKQKPTIIQDLSDGKCLPEVNGNIEFKDVTFSYPSRPDVMIFRDFSIFFPAGKTVAVVGGSGSGKSTVVSLIERFYDPNQGQVLLDNVDIKTLQLKWLRDQIGLVNQEPALFATTILENILYGKPGATMDEVEAATSAANAHSFITLLPKGYNTQVGERGVQLSGGQKQRIAIARAMLKNPKILLLDEATSALDAGSESIVQEALDRLMVGRTTVVVAHRLSTIRNVDTIAVIQQGQVVETGTHEELISKGGSYASLIRFQEIVRNRDFANPSTRRTRSSRLSHSLSTKSLSLRSGSLRNLSYSYSTGADGRIEMVSNAETDRKTTAPDGYFLRLLKLNAPEWPYSIMAVVGSILAGFIGPIFAITMSNMIEVFYYTDLAAMERKTKEYVFVYIGAGVYGVVAYLIQHYFFSIMGENLTTRVRRMMLAAILRNEVGWFDEDEHNSSLVSARLSADAADVKSAVPERISVILQNLTSLLTSFIVAFIVEWKVALLILATFPILVLGNFAQSLALKGFAGDTAKAHAKTSMIAGEGVSNIRTVAAFNAQDKIHSLFCHELRIPQLRSLRKSQTSGILFGLSQFALYGSEALILWYGVHLVSKGASTFSKVIKVFVVLVVTANSVAETVSLAPEIIRGGEAVGSVFSILDRSTRIDPDDPEAESVESMRGEIELRHVDFAYPSRPDVPVFKDLSLRIRAGQSQALVGASGSGKSSVIALIERFYDPSAGKVMIDGKDIRRLNLKSLRLKIGLVQQEPALFASSIFDNIAYGKEGATEAEVIEAARSANVHGFVSALPDGYKTPVGERGVQLSGGQKQRIAIARAVLKDPTILLLDEATSALDAESECVLQEALERLMRGRTTVLVAHRLSTIRGVDSIGVVQDGRIVEQGSHSELVSRPEGAYSRLLQLQHHNI

SEQ ID NO: 18004 - protein, 1252 aa, Brassica oleracea
MSETTADAKPVPPAEAEKKKEQSLPFFKLFSFADKFDHLLMITGSIGAIIHGSSMPVFFLLFGEMVNGFGKNQMDLHQMTHEVSKYALYFVYLGLVVCVSSYAEIACWMYSGERQVAALRKKYLEAVLKQDVGFFDTDARTGDIVFSVSTDTLLVQDAISEKVGNFIHYLSTFLAGLVVGFVSAWRLALLSVAVIPGIAFAGGLYAYTLTGITSKSRESYANAGVIAEQAIAQVRTVYSYVGESKALSSYSEAIQYTLKLGYKAGMAKGLGLGCTYGIACMSWALVFWYAGVFIRSGTTDGGKAFTAIFSAIVGGMSLGQSFSNLGAFSKGKAAGYKLMEIINQRPTIVQDPLDGKCLEQVHGNIEFKDVTFSYPSRPDVIIFRNFSIFFPSGKTVAVVGGSGSGKSTVVSLIERFYDPNNGKILLDGVEIKTLQLKFLREQIGLVNQEPALFATTILENILYGKPNATLDEVEAAASAANAHSFITLLPKGYDTQVGERGVQLSGGQKQRIAIARAMLKDPKILLLDEATSALDASSESIVQEALDRVMVGRTTVVVAHRLCTIRNVDSIAVIQQGQVVETGTHEELIAKSGPYASLIRFQEMVGTRDFSNPSTRRTRSTRLSHSLSTKSLSLRSGSLRNLSYSYSTGADGRIEMISNAESDRKTRPPQNYFYRLLKLNAPEWPYSIMGAVGSVLSGFIGPTFAIVMSNMIEVFYYTDYVSMERKTKEYVFIYIGAGIYAVIAYLIQHYFFSIMGENLTTRVRRMMLSAILRNEVGWFDEDEHNSSLVAARLATDAADVKSAIAERISVILQNMTSLLTSFIVAFIIEWRVSLLILCTFPLLVLANFAQQLSLKGFAGDTAKAHAKTSMIAGEGVSNIRTVAAFNAQSKILSLFSHELRVPQKRSFYRSQTSGFLFGLSQLALYGSEALILWYGAHLVSQGKSTFSKVIKVFVVLVITANSVAETVSLAPEIIRGGEAVGSVFSVLDRQTRIDPDDADADPAETIRGDIEFRHVDFAYPSRPDVMVFTDFNLRIRAGHSQALVGASGSGKSSVIAMIERFYDPLAGKVMIDGKDIRRLNLKSLRLKIGLVQQEPALFAATIFDNIAYGKDGATESEVIEAARAANAHGFISGLPEGYKTPVGERGVQLSGGQKQRIAIARAVLKNPSVLLLDEATSALDAESECVLQEALERLMRGRTTVVVAHRLSTIRGVDCIGVIQDGRIVEQGRHSELVSRPEGAYSRLLQLQTHRI

SEQ ID NO: 18005 - protein, 1224 aa, Manihot esculenta
MAAETVDTNTSSCKASLPEAEKKKEQTLPFFQLFSFADKYDWLLMISGSIGAIIHGSSMPVFFLLFGEMVNGFGKNQSDLPKMTHEVSKYALYFVYLGIVVCLSSYAEIACWMYTGERQVGTLRKKYLEAVLKQDVGFFDTDARTGDIVFSVGNFIHYLSTFLAGLVVGFVSAWRLALLSVAVIPGIAFAGGLYAYTLTGLTSKSRESYAQAGIIAEQAIAQVRTVYSYVGESKALNSYSEAIQNTLKLGYKAGMAKGLGLGCTYGIACMSWALVFWYAGVFIRNGQTDGGKAFTAIFSAIVGGMSLGQSFSNLGAFSKGKAAGYKLMEIIKQKPTIIQDPSDGKCLSEFNGNIEFKDVTFSYPSRPDVIIFRDFSIFFPAGKTVAVVGGSGSGKSTVVSLIERFYDPNQAGQVLLDNVDIKTLQLRWLRDQIGLVNQEPALFATTILENILYGKPDATMDEVEAAAASANAHSFITLLPNGYNTQVGERGVQLSGGQKQRIAIARAMLKNPKILLLDEATSALDAGSESVVQEALDRLMVGRTTVVVAHRLSTIRNVDTIAVIQQGQVVETGTHEELIAKGGAYASLIRFQEMVRNRDFANPSTRRSRSSRLSHSLSTKSLSLRSGSLRNLSYSYSTGADGRIEMISNAETDRKNPAPHGYFCRLLKLNAPEWPYSIMGAIGSVLSGFIGPTFALVMSNMIEVFYYGNPASMERKTKEYHYFFSIMGENLTTRVRRMMLAAILRNEVGWFDEEEHNSSLVAARLATDAADVKSAIAERISVILQNMTSLLTSFIVAFIVEWRVSLLILATFPLLVLANFAQQLSLKGFAGDTAKAHARTSMIAGEGVSNIRTVAAFNAQGKILSLFCHELRVPQLHSLRRSQTSGLLFGLSQLALYASEALILWYGAHLVSKGASTFSKVIKVFVVLVITANSVAETVSLAPEIIRGGESVGSVFSILDRSTRIDPDDPEADPVESMRGEIELRHVDFAYPSRPDVPVFKDLSLRIRAGQSQALVGASGCGKSSVIALIERFYDPTAGKVMIDGKDIRRLNLKSLRLKIGLVQQEPALFAASIFDNIAYGKDGATEAEVIEAARAANVHGFVSALPDGYKTPVGERGVQLSGGQKQRIAIARAVLKDPTILLLDEATSALDAESECVLQEALERLMRGRTTVLVAHRLSTIRGVDSIGVVQDGRIVEQGSHSELVSRANGAYSRLLQLQHHQI

SEQ ID NO: 18006 - protein, 1251 aa, Valeriana officinalis
MAEMTEAKPMPEMEKKKEQSLPFYQLFSFADKFDYLLMASGTFGAIIHGSSMPVFFLLFGQMVNGFGKNQSDLQKLTEEVSKYALYFVYLGLVVCFASYAEISCWMYTGERQVSALRKKYLESVLKQDVGFFDTDARTGDIVFSVSTDTLLVQDAISEKVGNFIHYLSTFLAGLVVGFVTAWRLALLSIAVIPGIAFAGGLYAYTLTGLTSKSRESYANANIAAEQAIAQVRTVYSYVGESKVLNAYSDAIQHTLKLGYKAGMAKGLGLGCTYGIACMSWALVFWYAGVFIRNGQTDGGKAFTAIFSAIVGGISLGQSFSNLEAFSKGKAAGFKLMEIIKQQPSIVQDSLDGKCLAEVSGQIEFKDVTFSYPSRPDVIIFRDFSISFPTGKTVAVVGGSGSGKSTVVSLIERFYDPSQGQILLDNVDIKTLQLKWLRDQIGLVNQEPALFATTILENIMYGKPDATMEEVEASSSAANAHSFITLLPYGYNTQVGERGVQLSGGQKQRIAIARAMLKNPKILLLDEATSALDAGSESIVQEALDRLMVGRTTVVVAHRLSTIRNVDSIAVLQQGQVVETGTHEELISKPGGAYSSLIRFQEMVGNRDFSNASTTHRSRSTRLSHSLSTKSLSLRSGSLRNLSYQYSTGADGRIEMISNAETDKKNPAPTGYFLRLLKLNAPEWPYSIMGAVGSILSGFMGPTFAIVMSNMIEVFYYNNPARMERKTKEYVFIYIGAGLYAVVAYLIQHYFFSIMGENLTTRVRRMMLAAILRNEVGWYDEEEHNSSLVTARLATDAADVKLAISERISVILQNMTSLLTSFIVAFIIEWRVSLLILGTFPLLVLANFAQQLSLKGFAGDTAKAHAKTSMIAGEGVSNIRTVAAFNAQDKILSLFCQQLKVPQLVSLRRSQSSGILFGLSQLALYSSEALILWYGAHLVGTGVSTFSKVIKVFVVLVITANSVAETVGLAPEIIRGGEAIGSVFSILDRSTKIESDDPDAEIVETIRGEIELRHVDFSYPSRPDISIFKEFNLRIRAGHSQALVGASGSGKSTVIALIERFYDPTAGKVMIDGKDIRRLNLKSLRLKIGLVQQEPALFATSIFDNIAYGKDEATEAEVIEAARAANVHAFISSLPDGYKTSVGERGVQLSGGQKQRIAIARAVLKDPRILLLDEATSALDAESECVLQEALERLMKGRTTVLVAHRLSTIRGVDTIGVVQDGRIIEHGSHAELTSRPEGPYSRLLKLQNHRL

SEQ ID NO: 18007 - protein, 1250 aa, Conyza canadensis
MSETTKQAMPAAAEKKKEQSLPFYQLFSFADKYDYILMIFGSIGAIIHGSSMPFFFLLFGQMVNGFGKNQSDLITMTHEVSKYALYFVYLGLVVCVSSYAEIGCWMYTGERQVSTLRKKYLEAVLKQDVGFYDTDARTGDIVFGISTDTLLVQDAISEKVGNFIHYLSTFLAGLVVGFVSAWKLALLSIAVIPGIAFAGGLYAYTLTGLTSKSRESYANAGIIAEEAIAQVRTVYSYVGETKALNSYSDAIQHTLKLGYKAGMAMGLGLGCTYGIACMSWALVFWYAGVFIRNGQTDGGKAVTAIFSAIVGGMSLGQSFSNLGAFSKGKSAGYKLLEIINQKPTITTNSVNGKCLTEVNGNIEFKEVTFSYPSRPDVIIFRDFSIVFAAGKTVAVVGGSGSGKSTVISLIERFYDPNEGQILLDNVDIKTLQLRWLRDQIGLVNQEPALFATTILENILYGKPDATMADVEAATSAANAHSFITLLPNGYNTQVGERGVQLSGGQKQRIAIARAMLKDPKILLLDEATSALDSGSESIVQEALDRLMIGRTTVVVAHRLSTIRNVDSIAVIQQGQVIETGTHEDLISKPGAYASLIRFQEMAGNRDFSNPSTQRTRSTRLSHSLSTKSLSLRSGSLRNLSYQYSTGADGRIEMISNAETDKKNPAPSGYFLRLLKMNAPEWPYSIMGAVGSILSGFIGPTFAIVMSNMIEVFYYTNPARMESKTKECVFIYVGAGLYAVVAYLIQHYFFSIMGENLTTRVRRMMLAAIMRNEVGWFDEEEHNSSLVAARLATDAADVKSAIAERIAVILQNMTSLLTSFVVAFIVEWRVSLLILGTFPLLVLAYFAQQLSLKGFAGDTAKAHAKTSMIAGEGVSNIRTIAAFNAQDKILSLFSDELRVPQNQSLRRSQYSGMLFGISQLALFASEALILWYGAHLVKDGVSTFSKVIKVFVVLVITANSVAETVSLAPEIIRGGEAIGSVFAVLDRSTRIDPDDPDAEMVETIRGEIELRHVDFSYPSRPDVIIFKDLSLRIRAGQSQALVGASGSGKSSIIALIERFYDPTAGKVMVDGKDIRRLNLRSLRAKIGLVQQEPALFAASIMENIAYAKEEATEAEVIEAARAANVHTFVSGLPQGYNTPVGERGVQLSGGQKQRIAIARAVLKNPTILLLDEATSALDAESECVLQEALERLMRGRTTVLVAHRLSTIRGVDSIGVVQDGRIVEQGSHSELLGRGTDGAYSRLLQLQQHRI

SEQ ID NO: 18008 - protein, 1252 aa, Brassica rapa
MSETTADAKPVPPAEAEKKKEQSLPFFKLFSFADKFDHLLMITGSIGAIIHGSSMPVFFLLFGEMVNGFGKNQMDLHQMTHEVSRYALYFVYLGLVVCVSSYAEIACWMYSGERQVAALRKKYLEAVLKQDVGFFDTDARTGDIVFSVSTDTLLVQDAISEKVGNFIHYLSTFLAGLVVGFVSAWRLALLSVAVIPGIAFAGGLYAYTLTGITSKSRESYANAGVIAEQAIAQVRTVYSYVGESKALSSYSEAIQYTLKLGYKAGMAKGLGLGCTYGIACMSWALVFWYAGVFIRSGTTDGGKAFTAIFSAIVGGMSLGQSFSNLGAFSKGKAAGYKLMEIINQRPTIVQDPLDGKCLEQVQGNIEFKDVTFSYPSRPDVIIFRNFSIFFPSGKTVAVVGGSGSGKSTVVSLIERFYDPNNGEILLDGVEIKTLQLKFLREQIGLVNQEPALFATTILENILYGKPNATIDEVEAAASAANAHSFITLLPKGYDTQVGERGVQLSGGQKQRIAIARAMLKDPKILLLDEATSALDASSESIVQEALDRVMVGRTTVVVAHRLCTIRNVDSIAVIQQGQVVETGTHEELIAKSGAYASLIRFQEMVGTRDFSNPSTRRTRSTRLSHSLSTKSLSLRSGSLRNLSYSYSTGADGRIEMISNAESDRKTRPPQNYFYRLLKLNAPEWPYSIMGAVGSVLSGFIGPTFAIVMSNMIEVFYYTDYVSMERKTKEYVFIYIGAGIYAVIAYLIQHYFFSIMGENLTTRVRRMMLSAILRNEVGWFDEDEHNSSLVAARLATDAADVKSAIAERISVILQNMTSLLTSFIVAFIIEWRVSLLILCTFPLLVLANFAQQLSLKGFAGDTAKAHAKTSMIAGEGVSNIRTVAAFNAQSKILSLFSHELRVPQKRSFYRSQTSGFLFGLSQLALYGSEALILWYGAHLVSQGKSTFSKVIKVFVVLVITANSVAETVSLAPEIIRGGEAVGSVFSVLDRQTRIDPDDADADPVETIRGDIKFRHVDFAYPSRPDVMVFTDFNLRIRAGHSQALVGASGSGKSSVIAMIERFYDPLAGKVMIDGKDIRRLNLKSLRLKIGLVQQEPALFAATIFDNIAYGKDGATESEVIEAARAANAHGFISGLPEGYKTPVGERGVQLSGGQKQRIAIARAVLKNPSVLLLDEATSALDAESECVLQEALERLMRGRTTVVVAHRLSTIRGVDCIGVIQDGRIVEQGRHSELVSRPEGAYSRLLQLQTHRI

SEQ ID NO: 18009 - protein, 1247 aa, Chrysanthemum coronarium
MSDTSAKTAVKKNEQQSLPFYKLFSFADKLDYILMMFGSIGAIIHGSSMPCFFLLFGQMVNGFGKNQTDLTTMTHEVSKYALYFVYLGLVVCVSSYAEIGCWMYTGERQVSALRKRYLEAVLKQDVGFYDTDARTGDIVFGISTDTLLVQDAISEKVGNFIHYLSTFLAGLVVGFVSAWKLALLSIAVIPGIAFAGGLYAYTLTGLTSKSRESYANAGIIAEEAIAQVRTVYSYVGETKALNSYSDAIQHTLKLGYKAGMAKGLGLGCTYGIACMSWALVFWYAGVFIRNGQTDGGKAFTAIFSAIVGGMSLGQSFSNLGAFSKGKSAGYKLMEIINQKPTITNNSADGKVLDEVSGNIEFKEVTFSYPSRPDVIIFRDFSIFFRAGKTVAVVGGSGSGKSTVVSLIERFYDPNHGQILLDNVDIKTLQLKWLRDQIGLVNQEPALFATTILENILYGKPDATMTEVEAATSAANAHSFITLLPNGYNTQVGERGVQLSGGQKQRIAIARAMLKDPKILLLDEATSALDSGSESIVQEALDRLMIGRTTVVVAHRLSTIRNVDSIAVIQQGQVVETGTHEELISKPGHYASLIRFQEMAGNRDFSNPSTHRTRSTRLSHSLSTKSLSLRSGSLRNLSYQYSTGADGRIEMISNAETDRQNPAPSGYFFRLLKMNAPEWPYSIMGAVGSVLSGFIGPTFAIVMSNMIEVFYYDNPARMESKTKECVFIYVGAGLYAVGAYLIQHYFFSIMGENLTTRVRRMMLSAIMRNEVGWFDEEEHNSSLVAARLATDAADVKSAIAERISVILQNMTSLLTSFVVAFIVEWRVSLLILGTFPLLVLAHFAQQLSLKGFAGDTAKAHAKTSMIAGEGVSNIRTIAAFNAQDKILTLFSNELRVPQNQSLRCSQISGILFGISQLALFASEALILWYGAHLVSKGVSTFSKVIKVFIVLVITANSVAETVSLAPEIIRGGEAIGSVFAVLDRSTRIDPDDLDAEPVEKVRGEIELRHVDFSYPSRPDMVVFKGFSLRIRAGQSQALVGPSGSGKSSVIALIERFYDPNAGKVMIDGKDIRRLNLRSLRAKIGLVQQEPALFAASIMENIAYGKEGATEAEIIEAARAANVHTFVSGLPQGYKTPVGERGVQLSGGQKQRIAIARAVLKDPAILLLDEATSALDAESECVLQEALERLMRGRTTVLVAHRLSTIRGVDNIGVVQDGRIVEQGSHSELLSRGSDGAYFRLLQLQQHRV

SEQ ID NO: 18010 - protein, 1255 aa, Eutrema halophilum
MSEATATAADGKAVPPAEAEKKKEQSLPFFKLFSFADKFDYLLMITGSLGAIIHGSSMPVFFLLFGEMVNGFGKNQMDLQQMTHEVSKYALYFVYLGLVVCFSSYAEIACWMYSGERQVAALRKKYLEAVLKQDVGFFDTDARTGDIVFSVSTDTLLVQDAISEKVGNFIHYLSTFLAGLVVGFVSAWRLALLSVAVIPGIAFAGGLYAYTLTGITSKSRESYANAGVIAEQAIAQVRTVYSYVGESKALSSYSDAIQYTLKLGYKAGMAKGLGLGCTYGIACMSWALVFWYAGVFIRSGTTDGGKAFTAIFSAIVGGMSLGQSFSNLGAFSKGKAAGFKLMEIINQRPTIIQDPLDGKCLDQVHGNIEFKDVTFSYPSRPDVIIFRNFSIFFPSGKTVAVVGGSGSGKSTVVSLIERFYDPNNGQILLDGVEIKTLQLKFLREQIGLVNQEPALFATTILENILYGKPDATMVEVEAAASAANAHSFITLLPKGYDTQVGERGVQLSGGQKQRIAIARAMLKDPKILLLDEATSALDASSESIVQEALDRVMVGRTTVVVAHRLCTIRNVDSIAVIQQGQVVETGTHEELIAKSGAYASLIRFQEMVGTRDFSNPSTRRNRSTRLSHSLSTKSLSLRSGSLRNLSYSYSTGADGRIEMISNAETDRKTRAPQNYFYRLLKLNAPEWPYSIMGAVGSVLSGFIGPTFAIVMSNMIEVFYYTDYDSMERKTKEYVFIYIGAGLYAVGAYLIQHYFFSIMGENLTTRVRRMMLSAILRNEVGWFDEDEHNSSLVAARLATDAADVKSAIAERISVILQNMTSLLTSFIVAFIVEWRVSLLILGTFPLLVLANFAQQLSLKGFAGDTAKAHAKTSMIAGEGVSNIRTVAAFNAQSKILSLFCHELRVPQKRSLYRSQTSGFLFGLSQLALYGSEALILWYGAHLVSEGKSTFSKVIKVFVVLVITANSVAETVSLAPEIIRGGEAVGSVFSVLDRQTRIDPDDADADPVETIRGDIDFRHVDFAYPSRPDVMVFRDFNLRIRAGHSQALVGASGSGKSSVIAMIERFYDPLAGKVMIDGKDIRRLNLKSLRLKIGLVQQEPALFAATIFDNIAYGKDGATESEVIEAARAANAHGFISGLPEGYKTPVGERGVQLSGGQKQRIAIARAVLKNPTVLLLDEATSALDAESECVLQEALERLMRGRTTVVVAHRLSTIRGVDCIGVIQDGRIVEQGSHSELVSRPEGAYSRLLQLQTHRI

SEQ ID NO: 18011 - protein, 1252 aa, Arabidopsis lyrata
MSEPNTTDAKTVPTEAEKKKEQSLPFFKLFSFADKFDYLLMFVGSLGAIVHGSSMPVFFLLFGQMVNGFGKNQMDLHQMVHEVSKYSLYFVYLGLVVCFSSYAEIACWMYSGERQVAALRKKYLEAVLKQDVGFFDTDARTGDIVFSVSTDTLLVQDAISEKVGNFIHYLSTFLAGLVVGFVSAWKLALLSVAVIPGIAFAGGLYAYTLTGITSKSRESYANAGVIAEQAIAQVRTVYSYVGESKALSSYSDAIQYTLKLGYKAGMAKGLGLGCTYGIACMSWALVFWYAGVFIRNGQTDGGKAFTAIFSAIVGGMSLGQSFSNLGAFSKGKAAGYKLMEIINQKPTIIQDPLDGKCLDQVHGNIEFKDVTFSYPSRPDVMIFRNFNIFFPSGKTVAVVGGSGSGKSTVVSLIERFYDPNSGQILLDGVEIKTLQLKFLREQIGLVNQEPALFATTILENILYGKPDATMVEVEAAASAANAHSFITLLPKGYDTQVGERGVQLSGGQKQRIAIARAMLKDPKILLLDEATSALDASSESIVQEALDRVMVGRTTVVVAHRLCTIRNVDSIAVIQQGQVVETGTHEELIAKSGAYASLIRFQEMVGTRDFSNPSTRRTRSTRLSHSLSTKSLSLRSGSLRNLSYSYSTGADGRIEMISNAETDRKTRAPENYFYRLLKLNSPEWPYSIMGAIGSILSGFIGPTFAIVMSNMIEVFYYTDYNSMERKTKEYVFIYIGAGLYAVGAYLIQHYFFSIMGENLTTRVRRMMLSAILRNEVGWFDEDEHNSSLIAARLATDAADVKSAIAERISVILQNMTSLLTSFIVAFIVEWRVSLLILGTFPLLVLANFAQQLSLKGFAGDTAKAHAKTSMIAGEGVSNIRTVAAFNAQSKILSLFCHELRVPQKRSLYRSQTSGFLFGLSQLALYGSEALILWYGAHLVSKGVSTFSKVIKVFVVLVITANSVAETVSLAPEIIRGGEAVGSVFSVLDRQTRIDPDDADADPVETIRGDIEFRHVDFAYPSRPDVMVFRDFNLRIRAGHSQALVGASGSGKSSVIAMIERFYDPLAGKVMIDGKDIRRLNLKSLRLKIGLVQQEPALFAATIFDNIAYGKDGATESEVIEAARAANAHGFISGLPEGYKTPVGERGVQLSGGQKQRIAIARAVLKNPTVLLLDEATSALDAESECVLQEALERLMRGRTTVVVAHRLSTIRGVDCIGVIQDGRIVEQGSHSELVSRPDGAYSRLLQLQTHRI

SEQ ID NO: 18012 - protein, 1252 aa, Arabidopsis thaliana
MSETNTTDAKTVPPEAEKKKEQSLPFFKLFSFADKFDYLLMFVGSLGAIVHGSSMPVFFLLFGQMVNGFGKNQMDLHQMVHEVSRYSLYFVYLGLVVCFSSYAEIACWMYSGERQVAALRKKYLEAVLKQDVGFFDTDARTGDIVFSVSTDTLLVQDAISEKVGNFIHYLSTFLAGLVVGFVSAWKLALLSVAVIPGIAFAGGLYAYTLTGITSKSRESYANAGVIAEQAIAQVRTVYSYVGESKALNAYSDAIQYTLKLGYKAGMAKGLGLGCTYGIACMSWALVFWYAGVFIRNGQTDGGKAFTAIFSAIVGGMSLGQSFSNLGAFSKGKAAGYKLMEIINQRPTIIQDPLDGKCLDQVHGNIEFKDVTFSYPSRPDVMIFRNFNIFFPSGKTVAVVGGSGSGKSTVVSLIERFYDPNSGQILLDGVEIKTLQLKFLREQIGLVNQEPALFATTILENILYGKPDATMVEVEAAASAANAHSFITLLPKGYDTQVGERGVQLSGGQKQRIAIARAMLKDPKILLLDEATSALDASSESIVQEALDRVMVGRTTVVVAHRLCTIRNVDSIAVIQQGQVVETGTHEELIAKSGAYASLIRFQEMVGTRDFSNPSTRRTRSTRLSHSLSTKSLSLRSGSLRNLSYSYSTGADGRIEMISNAETDRKTRAPENYFYRLLKLNSPEWPYSIMGAVGSILSGFIGPTFAIVMSNMIEVFYYTDYDSMERKTKEYVFIYIGAGLYAVGAYLIQHYFFSIMGENLTTRVRRMMLSAILRNEVGWFDEDEHNSSLIAARLATDAADVKSAIAERISVILQNMTSLLTSFIVAFIVEWRVSLLILGTFPLLVLANFAQQLSLKGFAGDTAKAHAKTSMIAGEGVSNIRTVAAFNAQSKILSLFCHELRVPQKRSLYRSQTSGFLFGLSQLALYGSEALILWYGAHLVSKGVSTFSKVIKVFVVLVITANSVAETVSLAPEIIRGGEAVGSVFSVLDRQTRIDPDDADADPVETIRGDIEFRHVDFAYPSRPDVMVFRDFNLRIRAGHSQALVGASGSGKSSVIAMIERFYDPLAGKVMIDGKDIRRLNLKSLRLKIGLVQQEPALFAATIFDNIAYGKDGATESEVIDAARAANAHGFISGLPEGYKTPVGERGVQLSGGQKQRIAIARAVLKNPTVLLLDEATSALDAESECVLQEALERLMRGRTTVVVAHRLSTIRGVDCIGVIQDGRIVEQGSHSELVSRPEGAYSRLLQLQTHRI

SEQ ID NO: 18013 - protein, 1252 aa, Brassica oleracea
MSETTADAKPVPPAEAEKKKEESLPFFKLFSFADKFDYLLMITGTLGAIVHGSSMPVFFLLFGEMVNGFGKNQMDLHQMTHEVSKYALYFVYLGLVVCFSSYAEIACWMYSGERQVAALRKKYLEAVLKQDVGFFDTDARTGDIVFSVSTDTLLVQDAISEKVGNFIHYLSTFLAGLVVGFVSAWRLALLSVAVIPGIAFAGGLYAYTLTGITSKSRESYANAGVIAEQAIAQVRTVYSYVGESKALSSYSDAIQYTLKLGYKAGMAKGLGLGCTYGIACMSWALVFWYAGVFIRSGTTDGGKAFTAIFSAIVGGMSLGQSFSNLGAFSKGKAAGFKLMEIINQRPTIIQDPLDGKCLDQVRGDIEFKDVTFSYPSRPDVIIFRNFSIFFPSGKTVAVVGGSGSGKSTVVSLIERFYDPNNGQILLDGVEIKTLQLKFLREQIGLVNQEPALFATTILENILYGKPDATMVEVEAAASAANAHSFITLLPKGYDTQVGERGVQLSGGQKQRIAIARAMLKDPKILLLDEATSALDASSESIVQEALDRVMVGRTTVVVAHRLCTIRNVDSIAVIQQGQVVETGTHEELIAKAGAYASLIRFQEMVGTRDFSNPSTRRTRSTRLSHSLSTKSLSLRSGSLRNLSYSYSTGADGRIEMISNAETDRKTRAPQNYFYRLLKLNAPEWPYSIMGAVGSVLSGFIGPTFAIVMSNMIEVFYYTDYDSMERKTKEYVFIYIGAGIYAVIAYLIQHYFFSIMGENLTTRVRRMMLSAILRNEVGWFDEDEHNSSLIAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQSKILSLFCHELRVPQKRSFYRSQTSGFLFGLSQLALYGSEALILWYGAHLVSEGKSTFSKVIKVFVVLVITANSVAETVSLAPEIIRGGEAVGSVFSVLDRQTRIDPDDADADPVETIRGDIDFRHVDFAYPSRPDVMVFRDFNLRIRAGHSQALVGASGSGKSSVIAMIERFYDPLGGKVMIDGKDIRRLNLKSLRLKIGLVQQEPALFAATIFDNIAYGKDGATESEVIEAARAANAHGFISGLPEGYKTPVGERGVQLSGGQKQRIAIARAVLKNPTVLLLDEATSALDAESECVLQEALERLMRGRTTVVVAHRLSTIRGVDSIGVIQDGRIVEQGSHSELVSRPEGAYSRLLQLQTHRI

SEQ ID NO: 18014 - protein, 1252 aa, Brassica rapa
MSETTADTKPVPPAEAEKKKEESLPFFKLFSFADKFDYLLMTTGTLGAIVHGSSMPVFFLLFGEMVNGFGKNQMDLHQMTHEVSKYSLYFVYLGLVVCFSSYAEIACWMYSGERQVAALRKKYLEAVLKQDVGFFDTDARTGDIVFSVSTDTLLVQDAISEKVGNFIHYLSTFLAGLVVGFVSAWRLALLSVAVIPGIAFAGGLYAYTLTGITSKSRESYANAGVIAEQAIAQVRTVYSYVGESKALSSYSDAIQYTLKLGYKAGMAKGLGLGCTYGIACMSWALVFWYAGVFIRSGTTDGGKAFTAIFSAIVGGMSLGQSFSNLGAFSKGKAAGFKLMEIINQRPTIIQDPLDGKCLDQVRGDIEFKDVTFSYPSRPDVIIFRNFSIFFPSGKTVAVVGGSGSGKSTVVSLIERFYDPNNGQILLDGVEIKTLQLKFLREQIGLVNQEPALFATTILENILYGKPDATMVEVEAAASAANAHSFITLLPKGYDTQVGERGVQLSGGQKQRIAIARAMLKDPKILLLDEATSALDASSESIVQEALDRVMVGRTTVVVAHRLCTIRNVDSIAVIQQGQVVETGTHEELIAKAGAYASLIRFQEMVGTRDFSNPSTRRTRSTRLSHSLSTKSLSLRSGSLRNLSYSYSTGADGRIEMISNAETDRKTRAPQNYFYRLLKLNAPEWPYSIMGAVGSVLSGFIGPTFAIVMSNMIEVFYYTDYDSMERKTKEYVFIYIGAGIYAVIAYLIQHYFFSIMGENLTTRVRRMMLSAILRNEVGWFDEDEHNSSLIAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQSKILSLFCHELRVPQKRSFYRSQTSGFLFGLSQLALYGSEALILWYGAHLVSEGKSTFSKVIKVFVVLVITANSVAETVSLAPEIIRGGEAVGSVFSVLDRQTRIDPDDADADPVETIRGDIDFRHVDFAYPSRPDVMVFRDFNLRIRAGHSQALVGASGSGKSSVIAMIERFYDPLGGKVMIDGKDIRRLNLKSLRLKIGLVQQEPALFAATIFDNIAYGKDGATESEVMEAARSANAHGFISGLPEGYKTPVGERGVQLSGGQKQRIAIARAVLKNPTVLLLDEATSALDAESECVLQEALERLMRGRTTVVVAHRLSTIRGVDSIGVIQDGRIVEQGSHSELVSRPEGAYSRLLQLQTHRI

SEQ ID NO: 18015 - protein, 1245 aa, Brassica napus
PKPVPPAEAEKKKEESLPFFKLFSFADKFDYLLMITGTLGAIVHGSSMPVFFLLFGEMVNGFGKNQMDLHQMTHEVSKYALYFVYLGLIVCFSSYAEIACWMYSGERQVAALRKKYLEAVLKQDVGFFDTDARTGDIVFSVSTDTLLVQDAISEKVGNFIHYLSTFLAGLVVGFVSAWRLALLSVAVIPGIAFAGGLYAYTLTGITSKSRESYANAGVIAEQAIAQVRTVYSYVGESKALSSYSDAIQYTLKLGYKAGMAKGLGLGCTYGIACMSWALVFWYAGVFIRSGTTDGGKAFTAIFSAIVGGMSLGQSFSNLGAFSKGKAAGFKLMEIINQRPTIIQDPLDGKCLDQVRGDIEFKDVTFSYPSRPDVIIFRNFSIFFPSGKTVAVVGGSGSGKSTVVSLIERFYDPNNGQILLDGVEIKTLQLKFLREQIGLVNQEPALFATTILENILYGKPDATMVEVEAAASAANAHSFITLLPKGYETQVGERGVQLSGGQKQRIAIARAMLKDPKILLLDEATSALDASSESIVQEALDRVMVGRTTVVVAHRLCTIRNVDSIAVIQQGQVVETGTHEELIAKAGAYASLIRFQEMVGTRDFSNPSTRRTRSTRLSNSLSTKSLSLRSGSLRNLSYSYSTGADGRIEMISNAETDRKTRAPQNYFYRLLKLNAPEWPYSIMGAVGSVLSGFIGPTFAIVMSNMIEVFYYTDYDSMERKTKEYVFIYIGAGIYAVIAYLIQHYFFSIMGENLTTRVRRMMLSAILRNEVGWFDEDEHNSSLIAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQSKILSLFCHELRVPQKRSFYRSQTSGFLFGLSQLALYGSEALILWYGAHLVSEGKSTFSKVIKVFVVLVITANSVAETVSLAPEIIRGGEAVGSVFSVLDRQTRIDPDDADADPVETIRGDIDFRHVDFAYPSRPDVMVFRDFNLRIRAGHSQALVGASGSGKSSVIAMIERFYDPLGGKVMIDGKDIRRLNLKSLRLKIGLVQQEPALFAATIFDNIAYGKDGATESEVIEAARAANAHGFISGLPEGYKTPVGERGVQLSGGQKQRIAIARAVLKNPTVLLLDEATSALDAESECMLQEALERLMRGRTTVVVAHRLSTIRGVDSIGVIQDGRIVEQGSHSELVSRPEGAYSRLLQLQTHRI

SEQ ID NO: 18016 - protein, 1235 aa, Brassica napus
KKKEESLPFFKLFSFADKFDYLLMTTGTLGAIVHGSSMPVFFLLFGEMVNGFGKNQMDLHQMTHEVSKYSLYFVYLGLVVCFSSYAEIACWMYSGERQVAALRKKYLEAVLKQDVGFFDTDARTGDIVFSVSTDTLLVQDAISEKVGNFIHYLSTFLAGLVVGFVSAWRLALLSVAVIPGIAFAGGLYAYTLTGITSKSRESYANAGVIAEQAIAQVRTVYSYVGESKALSSYSDAIQYTLKLGYKAGMAKGLGLGCTYGIACMSWALVFWYAGVFIRSGTTDGGKAFTAIFSAIVGGMSLGQSFSNLGAFSKGKAAGFKLMEIINQRPTIIQDPLDGKCLDQVRGDIEFKDVTFSYPSRPDVIIFRNFSIFFPSGKTVAVVGGSGSGKSTVVSLIERFYDPNNGQILLDGVEIKTLQLKFLREQIGLVNQEPALFATTILENILYGKPDATMVEVEAAASAANAHSFITLLPKGYDTQVGERGVQLSGGQKQRIAIARAMLKDPKILLLDEATSALDASSESIVQEALDRVMVGRTTVVVAHRLCTIRNVDSIAVIQQGQVVETGTHEELIAKAGAYASLIRFQEMVGTRDFSNPSTRRTRSTRLSHSLSTKSLSLRSGSLRNLSYSYSTGADGRIEMISNAETDRKTRAPQNYFYRLLKLNAPEWPYSIMGAVGSVLSGFIGPTFAIVMSNMIEVFYYTDYDSMERKTKEYVFIYIGAGIYAVIAYLIQHYFFSIMGENLTTRVRRMMLSAILRNEVGWFDEDEHNSSLIAARLATDAADVKSAIAERISVILQNMTSLLTSFIVAFIVEWRVSLLILATFPLLVLANFAQQLSLKGFAGDTAKAHAKTSMIAGEGVSNIRTVAAFNAQSKILSLFCHELRVPQKRSFYRSQTSGFLFGLSQLALYGSEALILWYGAHLVSEGKSTFSKVIKVFVVLVITANSVAETVSLAPEIIRGGEAVGSVFSVLDRQTRIDPDDADADPVETIRGDIDFRHVDFAYPSRPDVMVFRDFNLRIRAGHSQALVGASGSGKSSVIAMIERFYDPLGGKVMIDGKDIRRLNLKSLRLKIGLVQQEPALFAATIFDNIAYGKDGATESEVMEAARSANAHGFISGLPEGYKTPVGERGVQLSGGQKQRIAIARAVLKNPTVLLLDEATSALDAESECVLQEALERLMRGRTTVVVAHRLSTIRGVDSIGVIQDGRIVEQGSHSELVSRPEGAYSRLLQLQTHRI

SEQ ID NO: 18017 - protein, 453 aa, Echinochloa colona
MKERSGSRAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLIWDVEAQPNRHAVLGATESRPDLILTGHKENAEFALAMCPAEPYVLSGGKDKSVVLWSIQDHISALGDSSSSPGASGSKQSGKTGNEKESPKVDPRGIFHGHDSTVEDVQFCPSSAQEFCSVGDDACLILWDARTGTNPAVKVEKAHSGDVHCVDWNPLDVNYILTGSADNSVRMWDRRNLGSGGAGSPIHKFEGHKAAVLCVQWSPDRASVFGSSAEDGFLNVWDHEKVGKKKNSNVPAGLFFQHAGHRDKIVDFHWNSSDPWTIVSVSDDGESTGGGGTLQIWRMSDLIYRPEEEVLTELENFKAHLASCTPRN

SEQ ID NO: 18018 - protein, 453 aa, Setaria italica
MKERSGSRAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLIWDVEAQPNRHAVLGATESRPDLILTGHQENAEFALAMCPAEPYVLSGGKDKSVVLWSIQDHISALGDSSSSPGASGSKQSGKTTNEKESPKVDPRGIFHGHDSTVEDVQFCPSSAQEFCSVGDDACLILWDARTGTSPAVKVEKAHSGDVHCVDWNPLDVNYILTGSADNSVRMWDRRNLGSGGAGSPIHKFEGHKAAVLCVQWSPDRASVFGSSAEDGFLNVWDHEKVGKKKNSNVPAGLFFQHAGHRDKIVDFHWNSSDPWTIVSVSDDGESTGGGGTLQIWRMSDLIYRPEEEVLTELENFKSHLASCTPRN

SEQ ID NO: 18019 - protein, 453 aa, Saccharum officinarum
MKERSGSRAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLIWDVEAQPNRHAVLGASESRPDLILTGHKENAEFALAMCPAEPYVLSGGKDKSVVLWSIQDHISALGDSSSSPGASGSKQSAKTANEKESPKVDPRGIFHGHDSTVEDVQFCPSSAQEFCSVGDDACLILWDARTGTGPAVKVEKAHSGDVHCVDWNPLDVNYILTGSADNSVRMWDRRNLASGGAGSPVHKFEGHKAAVLCVQWSPDRASVFGSSAEDGFLNVWDHEKVGKKRNSNVPSGLFFQHAGHRDKIVDFHWNSSDPWTIVSVSDDGESTGGGGTLQIWRMSDLIYRPEDEVLTELENFKAHLASCAPRN

SEQ ID NO: 18020 - protein, 453 aa, Sorghum bicolor
MKERSGSRAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLIWDVEAQPNRHAVLGASESRPDLILTGHKENAEFALAMCPAEPYVLSGGKDKSVVLWSIQDHISALGDSSSSPGASGSKQSGKSATEKESPKVDPRGIFHGHDSTVEDVQFCPSSAQEFCSVGDDACLILWDARTGTGPAVKVEKAHSGDVHCVDWNPLDVNYILTGSADNSVRMWDRRKLGSGGASSPIHKFEGHKAAVLCVQWSPDRASVFGSSAEDGFLNVWDHEKVGTKKNTNVPAGLFFQHAGHRDKIVDFHWNSSDPWTIVSVSDDGESTGGGGTLQIWRMSDLIYRPEDEVLTELENFKAHLASCAPRT

SEQ ID NO: 18021 - protein, 453 aa, Cenchrus ciliaris
MKERSGSRAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLIWDVEAQPNRHAVLGATESRPDLILTGHQENAEFALAMCPAEPYVLSGGKDKSVVLWSIQDHISALGDSSSSPGASGSKQPGKSANEKPPLRGDPRGIFHGHDSTVEDVQFCPSSAQEFCSVGDDACLILWDARTGTSPAVKVEKAHSGDVHCVDWNPLDVNYILTGSADNSVRMWDRRNLGSGGAGSPIHKFEGHKAAVLCVQWSPDRASVFGSSAEDGFLNVWDHEKVGKKKNSNVPAGLFFQHAGHRDKIVDFHWNSSDPWTIVSVSDDGESTGGGGTLQIWRMSDLIYRPEEEVLTELENFKSHLASCTPRN

SEQ ID NO: 18022 - protein, 445 aa, Pennisetum glaucum
AAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLIWDVEAQPNRHAVLGATESRPDLILTGHQENAEFALAMCPAEPYVLSGGKDKSVVLWSIQDHISALGDSSSSPGASGSKQSGKSANEKESPKVDPRGIFHGHDSTVEDVQFCPSSAQEFCSVGDDACLILWDARTGTSPAVKVEKAHSGDVHCVDWNPLDVNYILTGSADNSVRMWDRRNLGSGGAGSPIHKFEGHKAAVLCVQWSPDRASVFGSSAEDGFLNVWDHEKVGKKKNSNVPAGLFFQHAGHRDKIVDFHWNSSDPWTIVSVSDDGESTGGGGTLQIWRMSDLIYRPEEEVLTELENFKSHLASCTPRN

SEQ ID NO: 18023 - protein, 455 aa, Triticum aestivum
MKERGGSRAAVDERYAQWKSLIPVLYDWFANHNLVWPSLSCRWGPQFEQATYKNRQRLYLSEQTDGSVPNTLVIANCEVVKPRVAAAEHISQFNEEARSPFVKKYKTIIHPGEVNRIRELPQNSRIIATHTDSPDVLIWDVEAQPNRHAVLGATDSRPDLILRGHQENAEFALAMCPAEPYVLSGGKDKSVVWWSIQDHISGLGDSSKSETSPGASGSKHSKTANEKDSPKVDPRGVFHGHDSTVEDVQFCPSSAQEFCSVGDDACLILWDARTGTSPAVKVEKAHGGDVHCVDWNLHDVNYILTGSADNSVRMWDRRNLGPGGAGSPIHKFEGHKAAVLCVQWSPDKASVFGSSAEDGFLNVWDHEKVGKKKNPNSPGGLFFQHAGHRDKIVDFHWNSSDPWTIVSVSDDGESTGGGGTLQIWRMSDLIYRPEDEVVSELETFKSHLASCTPRA

SEQ ID NO: 18024 - protein, 455 aa, Avena sativa
MKERGGSRAAVDERYAQWKSLIPVLYDWFANHNLVWPSLSCRWGPQFEQATYKNRQRLYLSEQTDGSVPNTLVIANCEVVKPRVAAAEHISQFNEEARSPFVKKYKTIIHPGEVNRIRELPQNSRIIATHTDSPDVLIWDVESQPNRHAVLGATDSRPDLILRGHEENAEFALAMCPAEPYVLSGGKDKSVVWWSIQDHISGLGDSSKSETSPGASGSKHSKTANEKDSPKVDPRGVFHGHDSTVEDVQFCPSSAQEFCSVGDDACLILWDARTGTSPAVKVEKAHGGDVHCVDWNLHDVNYILTGSADNSVRMWDRRNLGSGGAGSPIHKFEGHKAAVLCVQWSPDKSSVFGSSAEDGFLNVWDHEKVGKKKNPNSPGGLFFQHAGHRDKIVDFHWNSSDPWTIVSVSDDGESTGGGGTLQIWRMSDLIYRPEEEVLSELENFKSHLASCTPRG

SEQ ID NO: 18025 - protein, 456 aa, Festuca arundinacea
MKEKGGSRAAVDERYAQWKSLIPVLYDWFANHNLVWPSLSCRWGPQFEQATYKNRQRLYLSEQTDGSVPNTLVIANCEVVKPRVAAAEHISQFNEEARSPFVKKYKTIIHPGEVNRIRELPQDSRIIATHTDSPDVLIWDVEAQPNRHAVLGATDSRPDLILRGHQENAEFALAMCPAEPYVLSGGKDKSVVWWSIQDHISGLGDSSKSETSPGASGSKHSKTANEKDSPKVDPRGVFHGHDSTVEDVQFCPSSAQEFCSVGDDACLILWDARTGTSPAVKVEKAHGGDVHCVDWNLHDVNYILTGSADNSVRMWDRRNLGPGGGAGSPIHKFEGHKAAVLCVQWSPDKASVFGSSAEDGFLNVWDHDKVGKKKNPNSPGGLFFQHAGHRDKIVDFHWNSSDPWTIVSVSDDGESTGGGGTLQIWRMSDLIYRPEDEVLSELENFKSHLASCTPRA

SEQ ID NO: 18026 - protein, 456 aa, Festuca arundinacea
  Sequence also found in Organisms: Lolium multiflorum
MKEKGGSRAAVDERYAQWKSLIPVLYDWFANHNLVWPSLSCRWGPQFEQATYKNRQRLYLSEQTDGSVPNTLVIANCEVVKPRVAAAEHISQFNEEARSPFVKKYKTIIHPGEVNRIRELPQDSRIIATHTDSPDVLIWDVEAQPNRHAVLGATDSRPDLILRGHEENAEFALAMCPAEPYVLSGGKDKSVVWWSIQDHISGLGDSSKSETSPGASGSKHSKTANEKDSPKVDPRGVFHGHDSTVEDVQFCPSSAQEFCSVGDDACLILWDARTGTSPAVKVEKAHGGDVHCVDWNLHDVNYILTGSADNSVRMWDRRNLGPGGGAGSPIHKFEGHKAAVLCVQWSPDKASVFGSSAEDGFLNVWDHDKVGKKKNPNSPGGLFFQHAGHRDKIVDFHWNSSDPWTIVSVSDDGESTGGGGTLQIWRMSDLIYRPEEEVLSELENFKSHLASCTPRA

SEQ ID NO: 18027 - protein, 456 aa, Brachypodium distachyon
MKERGGSRAAVDERYAQWKSLIPVLYDWFANHNLVWPSLSCRWGPQFEQATYKNRQRLYLSEQTDGSVPNTLVIANCEVVKPRVAAAEHISQFNEEARSPFVKKFKTIIHPGEVNRIRELPQDSRIIATHTDSPDVLIWDVDSQPNRHAVLGASDSRPDLILRGHQENAEFALAMCPAEPFVLSGGKDKSVVWWSIQDHISGLGDSSKNESSPGASGSKQSGKTANDKDSPKVDPRGVFHGHDSTVEDVQFCPSSAQEFCSVGDDACLILWDARTGTSPAIKVEKAHGGDVHCVDWNLHDVNYILTGSADNSVRMWDRRNLGPGGAGSPVHKFDGHKAAVLCVQWSPDKASVFGSSAEDGFLNVWDHEKAGKKKNPNSPAGLFFQHAGHRDKIVDFQWNSSDPWTIVSVSDDGETTGGGGTLQIWRMSDLIYRPEEEVLSELENFKTHLASCTPRT

SEQ ID NO: 18028 - protein, 453 aa, Oryza sativa
MKEKGSRAAVDERYAQWKSLIPVLYDWFANHNLVWPSLSCRWGPQFEKATYKNRQRLYLSEQTDGTVPNTLVIANCEVVKPRVAAAEHISQFNEEARSPFVKKYKTIIHPGEVNRIRELPQNSKIIATHTDSPDVLIWDVEAQPNRQAQLAQMESRPDLILRGHKDIAEFALAMCPAEPYVLSGGKDKSVVWWSIQDHISALGDSSKTESSPGASGSKGKTANDKDSPKVDPRGIFLGHDSTVEDVQFCPSSAQEFCSVGDDSCLILWDARSGTGPAVKVEKAHGGDVHCVDWNLHDVNYILTGSADNSVRMWDRRNLGSGGAGIPVHKFEGHKAAVLCVQWSPDKASVFGSSAEDGFLNVWDHEKVGNKKNPNAPAGLFFQHAGHRDKIVDFHWNSSDPWTIVSVSDDGESTGGGGTLQIWRMSDLIYRPEDEVLAELENFKTHLASCAPRS

SEQ ID NO: 18029 - protein, 464 aa, Musa acuminata
MRERGGKATVDERYTQWKSLIPVLYDWLANHNLVWPSLSCRWGPQLEQATYKNRQRLYLSEQTDGSVPNTLVIANCEVVKPRVAAAEHISQFNEEARSPFVKKYKTIIHPGEVNRIRELPQNSKIVATHTDSPDVLIWDVEAQPNRHPMLGAAESRPDLILTGHQQNAEFALAMCPTEPFVLSGGKDKSVVLWSIHDHISSVAESTSKSPASASNSSGKQSIKAGNEKSSDSTTVGPRGVYQGHEDTVEDVQFCPSSAQEFCSVGDDSCLILWDARVGTSPVVKVEKAHNADLHCVDWNPHDQNLILTGSADNSVRMFDRRNLTSGGVGSPIYKFEGHKAAVLCVQWSPDRASVFGSAAEDGFLNIWDHERVGKKKERAGTKTPNSPPGLFFQHAGHRDKVVDFHWNASDPWTIVSVSDDCGSTGGGGTLQIWRMSDLIYRPEEEVLAELEKFKAHLLSCSPKS

SEQ ID NO: 18030 - protein, 468 aa, Ananas comosus
MKERGGKSGHPTVDERYTQWKSLVPVLYDWLANHNLVWPSLSCRWGPQLEQATYKNRQRLYLSEQTDGSVPNTLVIANCEVVKPRVAAAEHISQFNEEARSPFVKKFKTIIHPGEVNRIRELPQNSKIVATHTDSPDVLIWDVEAQPNRHAVLGAAESRPDLILTGHKENAEFALAMCPTEPFVLSGGKDKSVVLWSIQDHISTLAESASKSPVSPGSSGSKQVVGKSGTEKSSDTPTIGPRGVYQGHGDTVEDVQFCPSSAQEFCSVGDDSCLIFWDARVGTSPVVKVEKAHNADLHCVDWNPHDMNLILTGSADTSVRMFDRRNLTSGGVGSPIHKFEGHKAAVLCVQWSPDKATIFGSAAEDGFLNIWDHEKVGKKKERTGTRTSNTPPGLFFQHAGHRDKVVDFHWNAYDPWTIVSVSDDGESTGGGGTLQIWRMSDLIYRPEEEVLAELEKFKAHLASCTPKA

SEQ ID NO: 18031 - protein, 460 aa, Aquilegia formosa
MKERGKSGKPSVDERYTQWKSLVPVLYDWLANHNLVWPSLSCRWGPQQETATYKNRQRLYLSEQTDGSVPNTLVIANCEVVKPRVAAAEHISQFNEEARSPFVKKYKTIIHPGEVNRIRELPQNSKIVATHTDSPDVLIWDVESQPNRHAVLGAAESRPDLILTGHQDNAEFALAMCPTEPFVLSGGKDKSVVLWSIHDHITASATDSGSGKSPASASKSGGDKAPDSLAVGPRGVYQGHEDTVEDVQFCPSSAQEFCSVGDDSCLILWDARAGTSPATKVEKAHNADLHCVDWNPHDENLILTGSADNSVRMYDRRNLVSNGVGSPIYKFEGHKAAVLCVQWSPDKASVFGSAAEDGLLNVWDHEKIGKKKERVGTRMPNSPPGLFFQHGGHRDKVVDFHWNTSDPWTIVSVSDDCESTGGGGTLQIWRMSDLIYRPEEEVLAELEKFKSHILTCSSKS

SEQ ID NO: 18032 - protein, 451 aa, Eschscholzia californica
SVDERYTQWKSLVPVLYDWLANHNLVWPSLSCRWGPQLEQATYKNRQRLYLSEQTDGSVPNTLVIANCEVVKPRVAAAEHISQFNEEARSPFVKKFKTIIHPGEVNRIRELPQNSKIVATHTDSPDVLIWDVDAQPNRHAVLGAAESRPDLILTGHQDNAEFALAMCPTEPFVLSGGKDKSVVLWSIQDHISAAAVDQEAAKSPGSKQPSKVGGDKSESLSVGPRGIYQGHDDTVEDVQFCPSSAQEFCSVGDDSCLILWDARTGTSPAVKVEKAHNADLHCVDWNPLDENLILTGSADNSVRMFDRRNLTSGGVGAPIYKFEGHKAAVLCVQWCPDKASVFGSAAEDGFLNVWDHEKVGKKKERVGTRMPNSPPGLFFQHAGHRDKVVDFHWNTSDPWTIVSVSDDCESSGGGGTLQIWRMSDLIYRPEEEVLAELEKFKSHILACSSKS

SEQ ID NO: 18033 - protein, 464 aa, Aristolochia fimbriata
MRDRGKAGQPSVDERYTQWKSLVPVLYDWLANHNLVWPSLSCRWGPQLEQATYKNRQRLYLSEQTDGSVPNTLVIANCEVVKPRVAAAEHISQFNEEARSPFVKKYKTIIHPGEVNRIRELPQNSKIVATHTDSPDVLIWDVEAQPNRHAVLGAGDSRPDLILTGHQDNAEFALAMCPTEPHVLSGGKDKLVVLWSIQDHISNAVVDPSSTKSPSGGSIVKQTSKSDKSVESPTIGPRGTFQGHEDTVEDVQFCPSSAQIFCSVGDDSCLILWDARAGNSPSMKVEKAHNADLHCVDWNPHDENLILTGSADNSVRMFDRRNLISGGIGAPVHKFEGHKAAVLCVQWSPDKSSVFGSSAEDGFLNVWDYEKVGKKKDRVGTRMPNSPPGLFFQHAGHRDKVVDFHWNASDPWTIVSVSDDCESTGGGGTLQIWRMSDLIYRPEEEVLAELEKFKSHILTCSSKS

SEQ ID NO: 18034 - protein, 516 aa, Oryza sativa
MLCSALAFGHKRGGISEREPRARVQSKRSSYDRESVTARGGSEAGAGDGGGGGRQRAAKGALEMKEKGSRAAVDERYAQWKSLIPVLYDWFANHNLVWPSLSCRWGPQFEKATYKNRQRLYLSEQTDGTVPNTLVIANCEVVKPRVAAAEHISQFNEEARSPFVKKYKTIIHPGEVNRIRELPQNSKIIATHTDSPDVLIWDVEAQPNRQAQLAQMESRPDLILRGHKDIAEFALAMCPAEPYVLSGGKDKSVVWWSIQDHISALGDSSKTESSPGASGSKGKTANDKDSPKVDPRGIFLGHDSTVEDVQFCPSSAQEFCSVGDDSCLILWDARSGTGPAVKVEKAHGGDVHCVDWNLHDVNYILTGSADNSVRMWDRRNLGSGGAGIPVHKFEGHKAAVLCVQWSPDKASVFGSSAEDGFLNVWDHEKVGNKKNPNAPAGLFFQHAGHRDKIVDFHWNSSDPWTIVSVSDDGESTGGGGTLQIWRMSDLIYRPEDEVLAELENFKTHLASCAPRS

SEQ ID NO: 18035 - protein, 467 aa, Cocos nucifera
MRERGKAEQPTVDERYSQWKTLIPVLYDWLANHNLVWPSLSCRWGPQLEQATYKNRQRLYLSEQTDGSVPNTLVIANCEVVKPRVAAAEHISQFNEEARSPFVKKFKTIIHPGEVNRIRELPQNSKIVATHTDSPDVLIWDVEAQPNRHAVLGAADSRPDLILTGHKENAEFALSMCPSDPFVLSGGKDKLVVLWSIQDHISTLAESSTAKSPATPASSSGKQPAKAGNEKSSDSPTAGPRGVYQGHEDTVEDVQFCPSSAQEFCSVGDDSCLILWDARAGTGPAIKIEKAHNADLHCVDWNPHDENLILTGSADNSVRMFDRRNLTSGGVGTPIYKFEGHKAAVLCVQWSPDKASVFGSAAEDGLLNIWDHEKVGKKKERVGTKMPNSPPGLFFQHAGHRDKVVDFHWNSSDPWTIVSVSDDGESTGGGGTLQIWRMSDLIYRPEEEVLAELEKFKSHILTCAPNS

SEQ ID NO: 18036 - protein, 701 aa, Sorghum bicolor
MPALAVDATTPVAHAIASCDAAARFPAPPVVGPAAAAAADPVPWSADLSAALYNVDGWGAPYFFVNDDGDVAVRPHGPATLPGQEIDLAKVVAKAAGPREGGGLGLPLPLLVRFPDVLRHRVETLNAAFGYAVRSTGYGSRYQGVYPVKCNQDRYVVEDIVEFGAPFGFGLEAGSKPELLLAMSCLAARGNPDALLICNGYKDDGYVSLALMARSMGLNTVIVLEQEEELDIVVEASRRLGVRPVVGMRAKLRTKHAGHFGSTSGEKGKFGLNAAQILSVVTKLKAIAMLDCLQLLHFHIGSQIPTTALLSDGVGEAAQIYCELARLGADMRVIDVGGGLGIDYDGTHSAQTDMSVAYSLEEYATAVVAAVGRVCDRKVVQHPIICSESGRALVSHHSVLVFEAFSATAPGRLDAATAYLLDELTDDCRGDYRNVMAAAVRGDYDTCALYADQLKRRSAEQFKEGVLGLEHLAAVDAFCELVARGMGAPEPPRTYHINLSVFTSLPDMWAIGQQFPIIPIQRLQERPAVDGVLSDLTCDSDGKVSEFIGGRHSLPLHELPTHATRGYYLGMFLGGAYQEALGGLHNLFGGPSVVRVSQCDGPHCFAVTRAAAGPSCADVLRAMQHEPEVMYEVLKQRTDGATAAALARAFGAMPYLVFDPEAAVLSSGESSGMSSDSEGSAAGAAEEEDDEEWEFMRGLTV

SEQ ID NO: 18037 - protein, 704 aa, Setaria italica
MPALAVDAATPVAHAFASCDAARFPAPLMAVPTSATAAADKPEAAAWSADLSAALYNVDGWGAPYFFVNDDGDVAVRPHGAATLPGQEIDLAKVVAKAAGPRDGGGLGLPLPLLVRFPDVLRHRVETLNAAFDYAVRSTGYGSRYQGVYPVKCNQDRYVVEDIVEFGEPFRFGLEAGSKPELLLAMSCLAARGNPDALLVCNGYKDDGYVSLALTARTMGLNTVIVLEQEEELDIVLEASRRLGVRPVVGMRAKLRTKHAGHFGSTSGEKGKFGLNAAQILSVVTKLKAVGMLDCLQLLHFHIGSQIPTTALLSDGVGEAAQIYCELARLGAGMRVIDVGGGLGIDYDGTHSAQTDMSVAYSLEEYAVAVVAAVGRVCDRKGVQHPIICSESGRALVSHHSVLVFEAFSATAPGQLDAATAYLLDELTDDCRADYRNVMAAAVRGDYDTCGLYVDQLKRRSAEQFKEGVLGLEHLAAVDAFCEIVARGMGAPEAPRTYHINLSVFTSLPDMWAIGQQFPIIPIQRLQERPAVDGVLSDLTCDSDGKVCEFIGGRHSLPLHELPTHATRGYYLGMFLGGAYQEALGGLHNLFGGPSVVRVTQSDGPHCFAVTRAAAGPSCADVLRAMQHEPEVMFEVLKQRTDDATAASLARAFGAMPYLVFDPEAAVMSSGESSGMSSDSEGSAAGAAEEEDEEEWEFMRGLTV

SEQ ID NO: 18038 - protein, 696 aa, Panicum virgatum
MPALAVDAATPVAHAFASCDAARFPAAPLMATDKPEAAAWSADLSAALYNVDGWGAPYFFVNDDGDVAVRPHGAATLPGQEIDLAKVVAKAAGPRQAGGLGLPMPLLVRFPDVLRHRVETLNAAFDYAVRSTGYGSRYQGVYPVKCNQDRYVVEDIVEFGEPFRFGLEAGSKPELLLAMSCLVARGNPDALLVCNGYKDDGYVSLALTARTMGLNTVIVLEQEEELDIVIEASRRLGVRPVVGMRAKLRAKHAGHFGSTSGEKGKFGLNAAQILSVVTKLKAIGMLDCLQLLHFHIGSQIPTTALLSDGVGEAAQIYCELARLGAGMRVIDVGGGLGIDYDGTHSAQTDMSVAYSLEEYAVAVVAAVGRVCDRKGVPHPIVCSESGRALVSHHSVLVFEAFSATAPGQLDAATAYLLDELTDDCRADYRNVMAAAVRGDYDTCGLYADQLKRRSAEQFKEGVLGLEHLAAVDAFCEIVARGMGAPEPPRTYHINLSVFTSLPDMWAIGQQFPIIPIQRLQERPAVDGVLSDLTCDSDGKVCEFIGGRHSLPLHELPTHATRGYYLGMFLGGAYQEALGGLHNLFGGPSVVRVSQSDGPHCFAVTRAAAGPSCADVLRAMQHEPEVMFEVLKQRTDDATAASLARAFGAMPYLVFDPEAAVMSGGESSGMSSDSEGSAAGAAEEDDDEWEFMRGLTV

SEQ ID NO: 18039 - protein, 701 aa, Echinochloa colona
MPALAVDAATPVAHAFASCDAARFPAPLVAGPAAAAADKPDAAAWSADLSAALYNVDGWGAPYFFVNDDGDVAVRPHGAATLPGQEIDLAKVVAKAAGPRAGGGLGLPLPLLVRFPDVLRHRVETLNAAFDYAVRSTGYGNRYQGVYPVKCNQDRYVVEDIVEFGEPFRFGLEAGSKPELLLAMSCLAARGNPDALLVCNGYKDDGYVSLALMARTMGLNTVIVLEQEEELDIVVEASRRLGMRPVVGMRAKLRTKHAGHFGSTSGEKGKFGLNAAQILSVVTKLKALGMLDCLQLLHFHIGSQIPTTALLSDGVGEAAQIYCELARLGAGMRVIDVGGGLGIDYDGTHSAQTDMSVAYSLEEYAVAVVAAVGRVCDRKGVPHPVVCSESGRALVSHHSVLVFEAFSATAPGQLDAATAYLLDELTDDCRADYRNVMAAAVRGDYDTCGLYADQLKRRSAEQFKEGLLGLEHLAAVDAFCEIVARGMGAAEPPRTYHINLSVFTSLPDMWAIGQQFPIIPIQRLGERPAVDGVLSDLTCDSDGKVCEFIGGRHSLPLHELPTHATRGYYLGMFLGGAYQEALGGLHNLFGGPSVVRVTQSDGPHCFAVTRAAAGPSCADVLRAMQHEPEVMFEVLKQRTDDATAASIARVFGAMPYLVFDPEAAVMSSGESSGMSSDSEGSAAGAAEEDDEDWEFMRGLTV

SEQ ID NO: 18040 - protein, 695 aa, Panicum virgatum
MPALAVDAATPVAHAFASCDAARFPAAPLMADKPEAAAWSPDLSAALYNVDGWGAPYFFVNDDGDVAVRPHGAATLPGQEIDLAKVVAKAAGPREAGGLGLPMPLLVRFPDVLRHRVETLNAAFDYAVRSTGYGSRYQGVYPVKCNQDRYVVEDIVEFGEPFRFGLEAGSKPELLLAMSCLVARGNPDALLVCNGYKDDGYVSLALMARTMGLNTVIVLEQEEELDIVIDASRRLGVRPVVGLRAKLRTKHAGHFGSTSGEKGKFGLNAAQILSVVTKLKAIGMLDCLQLLHFHIGSQVPTTALLSDGVGEAAQIYCELARLGAGMRVIDVGGGLGIDYDGTHSAQTDMSVAYSLEEYAVAVVAAVGRVCDRKGVPHPIVCSESGRALVSHHSVLVFEAFSATAPGQLDAAAAYLLDELTDDCRADYRNVMAAAVRGDSDTCGLYADQLKRRSAEQFKEGVLGLEHLAAVDALCEFVARGMGAPEPPRTYHINLSVFTSLPDMWAIGQQFPILPIQRLQERPAVDGVLSDLTCDSDGKVCEFIGGRHSLPLHELPTHATRGYYLGMFLGGAYQEALGGLHNLFGGPSVVRVSQSDGPHCFAVTRAAAGPSCADVLRAMQHEPEVMFEVLKRRTDDATAASLARAFGAMPYLVFDPEAAVMSSGESSGMSSDSEGSAAGAAEEDDEEWEFMRGLTV

SEQ ID NO: 18041 - protein, 702 aa, Oryza sativa
MPALAVDAAAPVAHAFACDAARFPAPLLGPAAAAAAVAEKPDAAAWSADLSSALYNVDGWGAPYFFVNDDGDVAVRPHGAATLPGQEIDLAKVVAKAAGPRSGGGLGLPLPLLVRFPDVLRHRVEALNAAFDYAVRSTGYGGRYQGVYPVKCNQDRHVVEDIVEFGEPFRFGLEAGSKPELLLAMSCLAARGNPDALLICNGYKDDEYVSLALIARTMGLNTVIVLEQEEELDIVVDASRRLGVRPVVGMRAKLRTKHAGHFGSTSGEKGKFGLNAAQILSVVAKLKTLGMLDCLQLLHFHIGSQIPTTALLGDGVGEAAQIYCELARLGAAMRVIDVGGGLGIDYDGSHSAQTDMSVAYSLEEYAAAVVAAVGRVCDRKGVAHPIICSESGRALVSHHSVLVFEAFSASAPGRIDPATGYLLDELTDDCHADYRNLMAAAVRGDFDTCALYADQLKRRCADQFKDGVLGLEHLAAVDSLCEIVARGMGAAEPPRTYHINLSVFTSLPDMWAIGQMFPIIPIQRLGERPAVDGVLSDLTCDSDGKVDHFIGGRHSLPLHELPVHGTRGYYLGMFLGGAYQEALGGLHNLFGGPSVVRVSQSDGPHCFAVTRAAAGPSCADVLRSMQHEPEVMFEVLKQRTDGATAAALARAFGAMPYLSFDPEAAAMASGESSGMSSDSEGSAAGAAEEDDDEWEFMRGLTV

SEQ ID NO: 18042 - protein, 701 aa, Leymus cinereus x Leymus triticoides
MPALAVDAAAPVAHAFAACDAARFAAPLLGPAAEKPEMAAWSADLSSALYNVDGWGAPYFFVNDDGDVAVRPHGAATLPGQEIDLAKVVARAAGARTGGGLGLALPLLVRFPDVLRHRVETLNAAFDYAVRSTGYGGRYQGVYPVKCNQDRFVVEDIVEFGAPYGFGLEAGSKPELLLTMSCLVARGSPDALLICNGYKDLEYVSLALIARTMGLNTVIVLEQEEELDIVVEASRRLNIRPVVGMRAKLRTKHAGHFGATSGEKGKFGLNAAQILSVVAKLKALGMLDCLQLLHFHIGSQIPTTALLADGVGEAAQIYCELARLGAAMRVIDVGGGLGIDYDGTHSAQTDMSVAYSLEEYAAAVVAAVGRVCDRKGVQHPVICSESGRALVSHHSVLIFEAFSATAPASDMMDPATAYLLDELTDDCRNDYRNLMASAVRGDFDTCGLYADQLKRRCAEQFKEGLLGLEHLAAVDGLCEIVARGMGAVEGPRRYHINLSVFTSLPDMWAIEQLFPIIPIQRLQERPAVNGVLSDLTCDSDGKVDQFIGGRNSLPLHELPSHGTRGYYLGMFLGGAYQEALGGLHNLFGGPSVVRVSQSDGPHCFAVTRAAPGPSCADVLRAMQHEPEVMFEVLKQRTTDDGATATALARAFGSMPYLSFDSEEAAMSGAESSGMSSDSEGSAAGAAEDDDEEWEFMRGLTV

SEQ ID NO: 18043 - protein, 708 aa, Secale cereale
MPALAVDAAAPVAHAFAACGDAAHFAAPLLGPAAVVAAAEKPEMAAWSADLSSALYNVDGWGAPYFFVNDDGDVAVRPHGAATLPGQEIDLAKVVARAAGARAAGGLGLALPLLVRFPDVLRHRVETLNAAFDYAVRSTGYGGRYQGVYPVKCNQDRYVVEDIVEFGAPFGFGLEAGSKPELLLTMSCLVARGSPDALLICNGYKDLEYVSLALIARTMGLNTVIVLEQEEELDIVVEASRRLNIRPVVGMRAKLRTKHAGHFGATSGEKGKFGLNAAQILSVVAKLKALGMLDCLQLLHFHIGSQIPTTALLADGVGEAAQIYCELARLGAAMRVIDVGGGLGIDYDGTHSAQTDMSVAYSLEEYAAAVVAAVGRVCDRKGVQHPVICSESGRALVSHHSVLIFEAFSATAPASNMMDPATAYLLDELTDDCRSDYRNLMASAVRGDFDTCGLYADQLKRRCAEQFKEGVLGLEHLAAVDGLCEIVARGMGAAEGPRRYHINLSVFTSLPDMWAIEQLFPIIPIQRLQERPAVNGVLSDLTCDSDGKVDQFIGGRSSLPLHELPSHGTRGYYLGMFLGGAYQEALGGLHNLFGGPSVVRVSQSDGPHCFAVTRAAPGPSCADVLRAMQHEPEVMFEVLKQRTTDDGATAAALARAFGSMPYLSFDAEEASAMSGAESSGMSSDSEGSAAGAAEDDDEEWEFMRGLTV

SEQ ID NO: 18044 - protein, 711 aa, Hordeum vulgare
MPALAVDAAAPVAHAFAACDASPRFAAPLLGPAAVVVAAAAAEKPEMAAWSADLSSALYNVDGWGAPYFFVNDDGDVAVRPHGAATLPGQEIDLAKVVARAAGARSGGGLGLALPLLVRFPDVLRHRVETLNAAFDYAVRSTGYAGRYQGVYPVKCNQDRYVVEDIVEFGAPFGFGLEAGSKPELLLTMSCLVARGSPDALLICNGYKDLEYVSLALIARTMGLNTVIVLEQEEELDIVVEASRRLNIRPVVGMRAKLRTKHAGHFGATSGEKGKFGLNAAQILSVVAKLKALGMLDCLQLLHFHIGSQIPTTALLADGVGEAAQIYCELARLGAAMRVIDVGGGLGIDYDGTHSAETDMSVAYSLEEYAAAVVAAVGRVCDRKGVQHPVICSESGRALVSHHSVLIFEAFSATAPASNMMDPATAYLLDELTDDCRNDYRNLMASAVRGDFDTCGLYADQLKRRCAEQFKEGVLGLEHLAAVDGLCEIVARGMGAAEGPRRYHINLSVFTSLPDMWAIEQLFPIIPIQRLQERPAVDGVLSDLTCDSDGKVDQFIGGRSSLPLHELPSHGTRGYYLGMFLGGAYQEALGGLHNLFGGPSVVRVSQSDGPHCFAVTRAAPGPSCADVLRAMQHEPEVMFEVLKQRTTDDGATAAALARAFGSMPYLSFDAEEAAAMSSAESSGMSSDSEGSAAGAAEDDDEEWEFMRGLTV

SEQ ID NO: 18045 - protein, 712 aa, Triticum aestivum
MPALAVDAAAPVAHAFAACCDASPRFAAPLLGPAAAVVAATAAEKPEMAAWSADLSSALYNVDGWGAPYFFVNDDGDVAVRPHGAATLPGQEIDLAKVVARAAGARAGGGLGLALPLLVRFPDVLRHRVETLNAAFAYAVRSTGYAGRYQGVYPVKCNQDRYVVEDIVEFGAPFGFGLEAGSKPELLLTMSCLVARGSPDALLICNGYKDLEYVSLALIARTMGLNTVIVLEQEEELDIVVEASRRLNIRPVVGMRAKLRTKHAGHFGATSGEKGKFGLNAAQILSVVAKLKALAMLDCLQLLHFHIGSQIPTTALLADGVGEAAQIYCELARLGAAMRVIDVGGGLGIDYDGTHSAQTDMSVAYSLEEYAAAVVAAVGRVCDRKGVQHPVICSESGRALVSHHSVLIFEAFSATAPASNMMDPATAYLLDELTDDCRSDYRNLMASAVRGDFDTCGLYADQLKRRCAEQFKEGVLGLEHLAAVDGLCEIVARGMGAAEGPRRYHINLSVFTSLPDMWAIEQLFPIIPIQRLQERPAVDGVLSDLTCDSDGKVDQFIGGRSSLPLHELPTHGTRGYYLGMFLGGAYQEALGGLHNLFGGPSVVRVSQSDGPHCFAVTRAAPGPSCADVLRAMQHEPEVMFEVLKQRTTDDGATAAALARAFGSMPYLSFDAEEASAMSGAESSGMSSDSEGSAAGAAEDDDEEWEFMRGLTV

SEQ ID NO: 18046 - protein, 697 aa, Avena sativa
MPALAVDATAPVAHAFGACDAARFAAPLLGPADVLPAAEKPAWSPDLSSALYNVDGWGAPYFFVNDDGDIAVRPHGAATLPGQEIDLAKVVSRAAGQLSAGGLGLPLPLLVRFPDVLRHRVETLNAAFNYAVSSTGYGGRYQGVYPVKCNQDRYVVEDIVEFGAPFGFGLEAGSKPELLLTMSCLAARGSPDALLICNGYKDLEYISLALIARTMGLNTVIVLEQEEELDIVVEASRRLNIRPVVGMRAKLRTKHAGHFGATSGEKGKFGLNAAEILSVVSKLKALGMLDCLQLLHFHIGSQIPTTALLADGVGEAAQIYCELARLGAAMRVIDVGGGLGIDYDGTHSAETDMSVAYSLEEYAAAVVAAVGRVCDRKGVQHPVICSESGRALVSHHSVLVFEAFSASAPASNIDSATAYLLDELTDDCRGDYRNLMAAAVRGDFETCALYADQLKRRCAEQFKEGVLGLEHLAAVDGLCEIVARGMGAVERPRTYNINLSVFTSIPDMWAIEQLFPIIPIQRLQERPAVDGILSDLTCDSDGKVDHFIGGRNSLPLHELPSHGTCGYYLGMFLGGAYQEALGGLHNLFGGPSVVRVSQSDGPHCFAVTRAAPGPSCADVLRAMHHEPEVMFEVLKQRTDDGATAAALARAFGAMPYLSFDNEVVEMASGMSSDSEGSAAGAAEDDDEEWEFMRGLTV

SEQ ID NO: 18047 - protein, 710 aa, Brachypodium distachyon
MPALAVDAAATVAHAFTTCDAAARFPAAPLFAPAAVVAAAAAAADKPDVGAAAWSADLSSALYNVDGWGAPYFFVNDDGDIAVRPHGAATLPGQEIDLAKVVARAAGPSAGGGLGLPLPLLVRFPDVLRHRVESLNAAFDYAVRSTGYGGRYQGVYPVKCNQDRYVVEDIVEFGAPFGFGLEAGSKPELLLTMSCLVARGSPDALLVCNGYKDLEYVSLALIARTMGLNTVIVLEQEEELDIVVEASRRLDIRPVVGMRAKLRTKHAGHFGATSGEKGKFGLNAAQILSVVSKLKALGMLDCLQLLHFHIGSQIPTTALLADGVGEAAQIYCELARMGAAMRVIDVGGGLGIDYDGTHSAQTDMSVAYSLEEYAAAVVAAVGRVCDRKGVQHPVICSESGRALVSHHSVLVFEAFSASAPAANIDSATAYLLDELTDDCRNDYRNLMAAAVRGDFETCALYADQLKRRCAEQFKEGVLGLEHLAAVDGLCEIVARGMGVAERPRTYNINLSVFTSLPDMWAIEQQFPIIPIQRLQERPAIDGILSDLTCDSDGKVDQFIGGRHSLPLHELPSHGTRGYYLGMFLGGAYQEALGGLHNLFGGPSVVRVSQSDGPHCFAVTRAAPGPSCADVLRAMQHEPEVMFEVLKQRITDDGATAAALARAFGAMPYLSFGGSEVSLESSGMSSDSEGSAAGAAEDDDDEWEFMRGLTV

SEQ ID NO: 18048 - protein, 634 aa, Secale cereale
VRPHGAATLPGQEIDLAKVVARAAGARAAGGLGLALPLLVRFPDVLRHRVETLNAAFDYAVRSTGYAGRYQGVYPVKCNQDRYVVEDIVEFGAPFGFGLEAGSKPELLLTMSCLVARGSPDALLICNGYKDLEYVSLALIARTMGLNTVIVLEQEEELDIVVEASRRLNIRPVVGMRAKLRTKHAGHFGATSGEKGKFGLNAAQILSVVAKLKALGMLDCLQLLHFHIGSQIPTTALLADGVGEAAQIYCELARLGAAMRVIDVGGGLGIDYDGTHSAQTDMSVAYSLEEYAAAVVAAVGRVCDRKGVQHPVICSESGRALVSHHSVLIFEAFSATAPASNMMDPATAYLLDELTDDCRSDYRNLMASAVRGDFDTCGLYADQLKRRCAEQFKEGVLGLEHLAAVDGLCEIVARGMGAAEGPRRYQINLSVFTSLPDMWAIEQLFPIIPIQRLQERPAVDGVLSDLTCDSDGKVDQFIGGRSSLPLHELPSHGTRGYYLGMFLGGAYQEALGGLHNLFGGPSVVRVSQSDGPHCFAVTRAAPGPSCADVLRAMQHEPEVMFEVLKQRTTDDGATAAALARAFGSMPYLSFDAAEEASAMSGAESSGMSSDSEGSAAGAAEDDDEEWEFMRGLTV

SEQ ID NO: 18049 - protein, 531 aa, Saccharum officinarum
MMKSLLPQSQLRRSSAAAVRSSGGGAAGADGAMADGGGAGPRAPASSTFWFLLHALCCLISLFLGFRFSRLLFFMLFSTTALYHSTTSSSSDAVLRAITTTTTTTTTTTTTTNTFTLCFAAGNTPPSGPANRTALEAADNKGAASSGNPQSHVVVGRHGIRIRPWPHPDPVEVMRAHRIMERVQEEQRRWYGVKEPRQVLVVTPTYSRAFQALHLTGLLHSLRNVPYPLTWIVVEAGGTTNATASMLARSGLTFVHIPFPDRMPHEWADRHATENRMRLHALRVIRERKMDGVVVFADDSNVHSMELFDEVQKVQWMGAVSVGILAHTGTADQLRLSEEDKQNMPLPVQGPACNSSGHLAGWHTFNSLPFSGKTATVVGEAAPVLPRGLEWAGFVLNSRMLWKEADGKPDWVKDLDAVGENGEEIENPLTLLNDPSSVEPLGNCGKKVLLWWLRVEARADSKFPQGWVIEPPLEVVVPAKRTPWPETTTELPSELLDDKQEQEDRRLSRANKSSRPRGTTKRKGDPQGQDN

SEQ ID NO: 18050 - protein, 533 aa, Sorghum bicolor
MMKSLLPQSQLRRSSAAAARSSSGGGAAGGDGAMADGGGAGPRAPASSTFWFLLHALCCLISLFLGFRFSRLLFFLLFSTTALYHSTTSSSSAAVLRATTTTTTTTTTTTTTTNTFTLSFAAANTPPSGPANRTALEAAGDNKGAASSGNPQSHVVVGRHGIRIRPWPHPDPVEVMRAHRIMERVQEEQRRWYGVKEPRQVLVVTPTYSRAFQALHLTGLLHSLRNVPYPLTWIVVEAGGTTNATASMLARSGLTFVHIPFPDRMPHEWADRHATENRMRLHALRVIRERKMDGVVVFADDSNVHSMELFDEVQKVQWMGAVSVGILAHTGTADQLRLSEEDKQNMPLPVQGPACNSSGHLAGWHTFNSLPFSGKTATVVGEAAPVLPRGLEWAGFVLNSRMLWKEADGKPDWVKDLDAVGENGEEIENPLALLNDPSSVEPLGNCGKKVLLWWLRVEARADSKFPQGWVIEPPLEVVVPAKRTPWPETTTELPSELLDDKQEQEDRRLSRANKSSRPRGTTKRKADPQGQEN

SEQ ID NO: 18051 - protein, 531 aa, Zea mays
MKSLLPRSELRRSSAAAVRSSAGGAAGGDGAVADGGGAGPRAPASSTFWFLLHALCCLISLFLGFRFSRLLFFMLFSTTALYHSTSSSSSAAVLRATTTTTTTTTTTTTTTNTFTLSFAAANTPPSGPANRTALEAAAEADKAAASGNPQSHVVVGRHGIRIRPWPHPDPVEVMRAHGIMERVQEEQRRWYGVKEPRQVLAVTPTYSRAFQALHLTGLLHSLRNVPYPLTWIVVEAGGTTNATASMLARSGLTVVHIPFPDRMPTEWADRHATENRMRLHALRVIRERKMDGVVVFADDSNVHSMELFDEVQKVQWMGAVSIGILAHTGTADQLRLSEEDKQNMPLPVQGPACNSSGHLAGWHTFNSLPFSGKTATVVGEAAPVLPRGLEWAGFVLNSRMLWKEAEGKPDWVKDLDAVGENGEEIENPLTLLNDPSSVEPLGNCGKKVLLWWLRVEARADSKFPQGWVIEPPLEVVVPAKRTPWPETTPELPSELLDDKQKLEDRHLSRGNKSSQPRGTTKRKGDPQGQDN

SEQ ID NO: 18052 - protein, 530 aa, Setaria italica
MMKSLLPQSQLRRSSAAAARSAGGGGAAGGGDGAAGADGGGAGSRAPASSTFWFLLHTFCCLLSLYLGFRFSRLLFFLLFSTTALYHATTSSSSAAVLRATTTTTTTTTTTTTTTNTFTLSFAAANPPPSNPANRTALEAAAAAEGNPQSHVVVGRHGIRIRPWPHPDPVEVMRAHRIMERVQEEQRRWYGVKEPRQVLVVTPTYSRAFQALHLTGLLHSLRNVPYPLTWIVVEAGGTTNATASLLARSGLTFVHIPFPDRMPHDWADRHATENRMRLHALRVIRERKMDGVVVFADDSNVHSMELFDEVQKVQWMGAVSVGILAHTGAAEQPRLSEEDKQNMPLPVQGPACNSSGHLAGWHTFNSLPFSGKTATVVGEAAPVLPRGLEWAGFVLNSRMLWKEAEGKPDWVKDLDAVGENGEEIENPLTLLNDPSSVEPLGNCGKKVLLWWLRVEARADSKFPQGWVIEPPLDIVVPAKRTPWPETTNELPSELLNDKKDQEDRRLSRANKSSRPRSTTKRKGDLQGQEN

SEQ ID NO: 18053 - protein, 528 aa, Pennisetum glaucum
LLPQSQLRRSSAAAARSAGGGGAAGGDGAAGADGGGAGSRAPASSTFWFLLHALCCLVSLFLGFRFSRLLFFLLFSTTALYHSTSSSSSAAVLRATTTTTTTTTTTTTTTNTFTLSFAAGNPPPSNPSNRTALETAAAAAADKGNPQSHVVVGRHGIRIRPWPHPDPVEVMRAHRIMERVQEEQRRWYGVKEPRQVLVVTPTYSRAFQALHLTGLLHSLRNVPYPLTWIVVEAGGTTNATASLLARSGLTFVHIPFPDRMPHDWADRHATENRMRIHALRVIRERKMDGVVVFADDSNVHSMELFDEVQKVQWMGAVSVGILAHTGAAEQPRLSEEDKQNMPLPVQGPACNSSGHLAGWHTFNSLPFSGKTATVVGEAAPVLPRGLEWAGFVLNSRMLWKEAEGKPDWVKDLDAVGENGEEIENPLTLLNDPSSVEPLGNCGKKVLLWWLRVEARADSKFPQGWVIEPPLDIVVPAKRTPWPETTNELPSELLDDKQDQQDRRLSRANKSSRPRSTTKRKADLQGQVN

SEQ ID NO: 18054 - protein, 519 aa, Panicum virgatum
RRSSARPSGAAAAAGGDGAAADGGGALARAPASGTFWFLLHALCCLISLFLGFRFSRLLFFLLFSTTALYHSTTSSSSAAVLRATTTTTTTTTTTTTTTNIFTLSFAAANPPPSNPANRTALEAASAADKGATSGNPQSHVVVGRHGIRIRPWPHPDPVEVMRAHQIMERVQEEQRRWYGVKEPRQVLVVTPTYSRAFQALHLTGLLHSLRNVPYPLTWIVVEAGGTTNATASLLGRSGLTFVHVPFPDHMPHDWADRHATENRMRLHALRVIRERKMDGVVVFADDSNVHSMELFDEVQKVQWMGAVSVGILAHTGAADQPHLSEEDKQNMPLPVQGPACNSSGHLAGWHTFNSLPFSGKTATVVGEAAPVLPRGLEWAGFVLNSRMLWKEAEGKPDWVKDLDAVGENGEEIENPLTLLNDPSSVEPLGNCGKKVLLWWLRVEARADSKFPQGWVIEPPLDIVVPAKRTPWPETTTELPSELLDDKQDQEDRRLSRANKSSRPRSTTKRKGDLQGQVN

SEQ ID NO: 18055 - protein, 501 aa, Panicum virgatum
AAADGGGAGARAPASSTFWFLLHALCCLISLFLGFRFSRLLFFLLFSTTALYHSTTSSSSAAVLRATTTTTTTTTTTTTTTNTFTLSFAAANPPPSNPANRTALEAAAAADKGATSGNPQSHVVVGRHGIRIRPWPHPDPVEVMRAHRIMERVQEEQRRWYGVKEPRQVLVVTPTYSRAFQALHLTGLLHSLRNVPYPLTWIVVEAGGTTNATASLLARSGLTFVHIPFPDRMPHVWADRHATENRMRLHALRAIRERKMDGVVVFADDSNVHSMELFDEVQKVQWMGAVSVGILAHTGAADQPRLSKEDKQNMPLPVQGPACNSSGHLAGWHTFNSLPFSGKTATVVGEAAPVLPRGLEWAGFVLNSRMLWKEAEGKPDWVKDLDAVGENGEEIENPLTLLNDPSSVEPLGNCGKKVLLWWLRVEARADSKFPQGWVIEPPLDIVVPAKRTPWPETTTELPSELLDDKQDQEDRRLSRANKSSRPRSTTKRKGDLQGQEN

SEQ ID NO: 18056 - protein, 524 aa, Oryza sativa
MMKSLLPQSQLRRSAAAASAARSSGGGTGSGGADGAGSDGGAGGRAPATSTFWFLLHALCCLVSLFLGFRFSRLLFFLLFSTTALYSSTSSSSSSAVLRATTTTTTTTTTTTTTTNTFTLSFQANPNPPPSNLSNHTALDAAGAAGHTQSHVVVGRHGIRIRPWPHPDPVEVMRAHRIMERVQEEQRRWYGVKEPRHVLVVTPTYSRAFQALHLTGLLHSLRNVPYPLTWIVVEAGGTTNATASILARSGLTIVHIPFPDRMPHDWADRHATENRMRLHALRVIRERKMDGVIVFADDSNVHSLELFDEVQKVQWMGAVSVGILAHTGTADQPRLSEEDKQNMPLPVQGPACNSSGHLAGWHTFNSLPFAGKTATVVGEAAPVLPRGLEWAGFVLNSRMLWKEAEGKPDWVKDLDAVGENGEEIENPLILLNDPSSVEPLGNCGKKILLWWLRVEARADSKFPQGWVIEPPLDIVVPAKRTPWPETTAELSAELVDSKQDQEGRRLSRTDRSSRSRSTTKRKEN

SEQ ID NO: 18057 - protein, 521 aa, Oryza sativa
MMKSLLPQSQLRRSAAAASAARSSGGGAGSGGADGAGSDGGAGGRAPATSTFWFLLHALCCLVSLFLGFRFSRLLLFSTTALYSSTSSSSSSAVLRATTTTTTTTTTTTTTTNTFTLSFQANPNPPPSNLSNHTALDAAGAAGHTQSHVVVGRHGIRIRPWPHPDPVEVMRAHRIMERVQEEQRRWYGVKEPRHVLVVTPTYSRAFQALHLTGLLHSLRNVPYPLTWIVVEAGGTTNATASLLARSDLTIVHIPFPDRMPHDWADRHATENRMRLHALRVIRERKMDGVIVFADDSNVHSLELFDEVQKVQWMGAVSVGILAHTGTADQPRLSEEDKQNMPLPVQGPACNSSGHLAGWHTFNSLPFAGKTATVVGEAAPVLPRGLEWAGFVLNSRILWKEAEGKPDWVKDLDAVGENGEEIENPLILLNDPSSVEPLGNCGKKILLWWLRVEARADSKFPQGWVIEPPLDIVVPAKRTPWPETTAELSAELVDSKQDQEGRRLSRTDRSSRSRSTTKRKEN

SEQ ID NO: 18058 - protein, 493 aa, Echinochloa colona
GGARAPASSTFWFLLHALCCLISLFLGFRFSRLLFFLLFSTTALYHSTTSSSAAAVLRATTTTTTTTTTTTTTTNTFTLSFAAANPPPSNPANRTALEAGAAAAADKGNNPQSHVVVGRHGIRIRPWPHPDPVEVMRAHQIMERVQEEQRRWYGVKEPRQVLVVTPTYSRAFQALHLTGLLHSLRNVPYPLTWIVVEAGGTTNATASLLARSGLTFVHIPFPDRMPHDWADRHATENRMRLHALRVIRERKMDGVVVFADDSNVHSMELFDEVQKVQWMGAVSVGILAHTGASEQPRLSEDDKQNMPLPVQGPACNSSGHLAGWHTFNSLPFSGKTATVVGEAAPVLPRGLEWAGFVLNSRMLWKEAEGKPDWVKDLDAVGENGEEIENPLTLLNDPSSVEPLGNCGKKVLLWWLRVEARADSKFPQGWVIDPPLDIVVPAKRTPWPETTTELPSELLDDKQDQEDRRLSRANKSSRPRSTTKRKGDLQGQEN

SEQ ID NO: 18059 - protein, 528 aa, Brachypodium distachyon
MKSLLPQSQLRRSAAAASAAAARSSGGGAEGAASDGGAGAGARAASSSTFWFLLHALCCFISLFLGFRFSRLLFFLLFSSSALYAASNNKSAAVLRAITTTTTTTTTTTTTTNTFTLSFAAAGNPPPSNPDNYTALDAAGDAATSGSTQSHVVVGRHGIRIRPWPHPDPVEVMRAHRIMERVQEEQRRWYGIREPRQVLVVTPTYSRAFQALHLTGLLHSLRNVPYPLTWLVVEAGGTTNGTASLLARSGLTFVHIPFPDRMPLEWADRHATENSMRLHALRVIRERKMDGVVVFADDSNVHSMELFDEVQKVQWMAAVSVGILAHTGTAEQPRLSEEDKQNMPLPVQGPACNSSGHLAGWHTFNSLPFSGKTATVVGEAAPVLPRGLEWAGFVLNSRMLWKEAEGKPDWVKDLDAVGENGEEIENPLTLLNDPSFVEPLGNCGKKILLWWLRVEARADSKFPQGWVIDPPLEVVIPAKRTPWPETTTELSSELSGAKQEQEDRRLTRTSRSTRPRSTTTKRKADIQN

SEQ ID NO: 18060 - protein, 485 aa, Echinochloa colona
ARAPASSTFWFLLHALCCLISLFLGFRFSRLLFFLLFSTTALYHSTTSSSSAAVLRATTTTTTTTTTTTTTTNTFTLSFAAANPPPSNPANRTALEAGAAAAADKGNNPQSHVVVGRHGIRIRPWPHPDPVEVMRAHQIMERVQEEQRRWYGVKEPRQVLVVTPTYSRAFQALHLTGLLHSLRNVPYPLTWIVVEAGGTTNATASLLARSGLTFVHIPFPDRMPHDWADRHATENRMRLHALRVIRERKMDGVVVFADDSNVHSMELFDEVQKVQWMGAVSVGILAHTGAAEQPRLSEEDKQNMPLPVQGPACNSSGHLAGWHTFNTLPFSGKTATVVGEAAPVVPRGLEWAGFVLNSRMLWKDAEGKPDWVKDLDAVGENGEEIENPLTLLNDPSSVEPLGNCGKKVLLWWLRVEARADSKFPQGWVIDPPLDIVVPAKRTPWPETTTELPSELLDDKQDQEDRRLSRANKSSRPRSTTKRKGD

SEQ ID NO: 18061 - protein, 526 aa, Triticum aestivum
MMKQLLPQSQLRRSAAASAARSSGGGVEGAGGPDGVGAGAGGRTASSSTFWFLLHALCCLISLFLGFRFSRLLFFLLFSSSALYAATSNNKSAVLRAITTTTTTTTTTTTTTNTFTLSFAAAGNPPPSNPDNLTAAALEEAAGSTQSHVVVGRHGIRIRPWPHPDPVEVMRAHRIMERVQEEQRRWYGVREPRQVLVVTPTYSRAFQALHLTGLLHSLRNVPYPLTWIVVEAGGVTNATAAMLARSSLTFVHVPFPEKMPLEWADRHATENRMRLHALRVIRERKMDGVVVFADDSNVHSMELFDEVQKVQWMAAVSVGILAHTGTAEQPRLTEEDKKNMPLPVQGPACNSSGHLAGWHTFNTLPFSGKTATVVGEAAPVLPKGLEWAGFVMNSRMLWKEAEGKPDWVKDLDAVGENGEEIENPLTLLNDASYVEPLGNCGKKVLLWWLRVEARADSKFPQGWVIEPPLEVVVPAKRTPWPETTMDVSSEMLDAKQEQEDRQLPRTNNRSARPRSTTTKRKGDVHN

SEQ ID NO: 18062 - protein, 530 aa, Triticum aestivum
MMKQLLPQSQLRRSAAASAARSSGGGVGAEGAGGPDGVGAGAGAGGRTASSSTFWFLLHALCCLISLFLGFRFSRLLFFLLFSSSALYAATSNNKSAVLRAITTTTTTTTTTTTTTNTFTLSFAAAGNPPPSNPDNLTAAALEEAAGSTQSHVVVGRHGIRIRPWPHPDPVEVMRAHRIMERVQEEQRRWYGVREPRQVLVVTPTYSRAFQALHLTGLLHSLRNVPYPLTWIVVEAGGVTNATASMLARSSLTFVHVPFPEKMPLEWADRHATENRMRLHALRVIRERKMDGVVVFADDSNVHSMELFDEVQKVQWMAAVSVGILAHTGTAEQPRLTEEDKKNMPLPVQGPACNSSGHLAGWHTFNTLPFSGKTATVVGEAAPVLPKGLEWAGFVMNSRMLWKEAEGKPDWVKDLDAVGENGEEIENPLTLLNDASYVEPLGNCGKKVLLWWLRVEARADSKFPQGWVIEPPLEVVVPAKRTPWPETTMDVSSEMLDAKQEQEDRQLPRTNNRSARPRSTTTKRKGDVHN

SEQ ID NO: 18063 - protein, 526 aa, Hordeum vulgare
MMKTLLPQSQLRRTAPRSSVGGVEGAGAPDGVGAGAGAGSGGRTASSSTFWFLLHAVCCLISLFLGFRFSRLLFFLLFSSSALYAATSNNKSAVLRAITTTTTTTTTTTTTTNTFTLSFAAAGNPPPANPDNLTAAALEEAAGSTQSHVVVGRHGIRIRPWPHPDPVEVMRAHRIMERVQEEQRRWYGVREPRQVLVVTPTYSRAFQALHLTGLLHSLRNVPYPLTWIVVEAGGVTNATAALLARSSLTFVHVPFPEKMPLEWADRHATENRMRLHALRVIRERKMDGVVVFADDSNVHSMELFDEVQKVQWMAAVSVGILAHTGTAEQPRLTEEDKKNMPLPVQGPACNSSGHLAGWHTFNTLPFSGKTATVVGEAAPVLPRGLEWAGFVMNSRMLWKEAEGKPDWVKDLDAVGENGEEIENPLTLLNDASYVEPLGNCGKKVLLWWLRVEARADSKFPQGWVIEPPLEVVVPAKRTPWPEATMDISSELLDAKQEQEDRQLPRTNNRSARPRSTTTKRKGDVQN

SEQ ID NO: 18064 - protein, 1197 aa, Sorghum bicolor
MVAMEGKGDASVTPVRTSDRLRQRPKYYGRGYMYYKPPMRKKVKSKKRTTASQIVKKLLRKPAARPPPADSIAANLRRSTRKRRISVNLEGYDTDSSSTGDHDLMRPRYRSSKSKGGNNAAHDEVSARPKRQKLSNSMPRREGLRPRRSLRGQRLHPYHESEDDQESSEEQGAEDQRENGNEIEEDVGDEEVDGGDEAEGDGDDEDGEEEQEGRRRYDLRERSEVRRPSPRKEGKHRPQSPRRVLVHGIGPKNSKYLKKGGSRMHKRPRFSLPDDSDDSLLVDEPDEGPSMPWMRSGRGGMPWLMGGLDMHSPAAWGLSVGASGWGHQGDTSTSLMPGVQTAGPSSKGGADIQPLQVDENVSFKDIGGLSEYIDALKEMVFFPLLYPDFFANYHITPPRGVLLCGPPGTGKTLIARALACAASKAGQKVSFYMRKGADVLSKWVGEAERQLKLLFEEAQKNQPSIIFFDEIDGLAPVRSSKQEQIHNSIVSTLLALMDGLDSRGQVVLIGATNRIDAIDGALRRPGRFDREFYFPLPGYEARSEILDIHTRKWKDPPPKELKMELAASCVGYCGADLKALCTEAAIRAFREKYPQVYTSDDKFVIDVDSVTVEKYHFLEAMSTITPAAHRGSIVHSRPLSTVIAPCLKRHLEKIMEQISDIFPFLSSIDFSKFSALSYGSSIPLVYRPRLLICGGESVGLDHVGPAVLHELEKFSVHSLGLPSLLSDPSAKTPEEALVHIFGEAKRTTPSILYLPQFHLWWETAHEQLRAVLLTLLNELPSNLPVLLLGTSSVAFTDLEEECASIFSSRNVYQVDHPSYDDKLRYFSILFESLLSFQSEESRNKSKKQKSAIDLPKAPKEVEGPKASELKAKAEAEQHAVRRMRMCLRDICNRILYNKRFNVFHFPVSEEEVPDYRSIIHKPMDMATVLQRVDSGQYLTRAAFMKDIDLIVSNAKTYNGDDYNGSRIVSRACELRDVVQGMLSQMDPCLVSFCDKIALQGGPQQVVDDEDSSILQAAPVAQLVSGTRISARLRNVLPEVNLSQSYEVLKRQKKSAENEQSMTKDVAARDEKSPEDVDLSKPTDPEEAAKEPELNGTTKEANESPAEEPEVPTPEPMESDNVQVATTVATGDDLLGQLEALKQRFMELTAGYGVPQLERLYSRIMKGAIELTSKESNEDHRRLVVRYLLTFVENSNNF

SEQ ID NO: 18065 - protein, 1199 aa, Panicum virgatum
MVAMEGKGDASVTPLRTSDRLRQRPKYYARGYMYYKPAMRKKVKSKKRTAASQIAKKLLRKPAARPPPADSIAANLRRSTRKRRISVNLEGYDTDSSSMEDDDLMRPRYRSSKSKGENNAAHDEVSARPKRQKLSNSIPRREGLRPRRSLRGKRLHAYQESEDEQESSDEQGAEDQRENGNEIEEDAGDDDEVDGGDEAEADGDDEDGEEEQEGRRRYDLRDRSEVRRPSPRKEGKHRPQSPRRVLVHGIGPKNSKYLKKGGSRMHKRPRFSLPDDSDDSLLVDEPDEGPSMPWMRSGRGGMPWLMGGLDMHSPAAWGLNVGASGWGHQGDSSTSLMPGVQTAGPSSKGGADIQPLQVDESVSFKDIGGLSEYIDALKEMVFFPLLYPDFFANYHITPPRGVLLCGPPGTGKTLIARALACAASKAGQKVSFYMRKGADVLSKWVGEAERQLKLLFEEAQKNQPSIIFFDEIDGLAPVRSSKQEQIHNSIVSTLLALMDGLDSRGQVVLIGATNRIDAIDGALRRPGRFDREFYFPLPGYEARAEILDIHTRKWKDPPPKELKMELAVSCVGYCGADLKALCTEAAIRAFREKYPQVYTSDDKFVIDVDSVSVEKYHFLEAMSTITPAAHRGSIVHSRPLSSVIAPCLKRHLDKIMERISDIFPFLSSVDFSKFSALSYGSSIPLVYRPRLLICGGESVGLDHVGPAVLHELEKFSVHSLGLPSLLSDPSAKTPEEALVHIFGEAKRTTPSILYLPQFHLWWDTAHEQLRAVLLTLLNELPSNLPVLLLGTSSVAFTDLEEECASIFSSRNMYQVDQPSYDDRLRYFNILFESLLSFQTEESRNKLKKQKSAIDLPKAPKVVEGPKVSELKARAEAEQHAVRRMRMCLRDICNRILYNKRFNVFHFPVSEEEVPDYRSVIHKPMDMATVLQRVDSGQYLTRAAFMNDIDLIVSNAKTYNGNDYNGSRIVSRACELRDVVQGMLSQMDPSLVSFCDKIASQGGPLQVMDDEDSSILQAAPVAQLVSGTRISARLRNVQPEVNLSQSYEVLKRQKKSAENEQGLTKDVAARDERSPEDVDLSKPISPEETPKEPDSNGTLKEADNSPAEAAEVPARPEPMETDSSEVATTVSTGDDLLGQLEALKQRFMEHTAGYGVPQLERLYSRIMKGVIELTSKESNEDHRRLVVRYLLTFVENSDNF

SEQ ID NO: 18066 - protein, 1198 aa, Setaria italica
MVAMEGKGDASVTPVRTSDRLRQRPKYYARGYMYYKPAMRKKVKSKKRTAASQIAKKLLRKPAARPPPADSIAANLRRSTRKRRIPVNLEGYDTDSSSMEDDDLMRPRYRTSKNKGGNDAAHDEVSARPKRQKLSNSIPRREGLRPRRSLRGRRLHPYQESEDEQESSEEQGAEDRRENGNDIEEDGDDDEVDGGDEAEADGDDEDGEEEQEGRRRYDLRDRSEVRRPSPRKEGKHRPQSPRRVLVHGIGPKNNKYLKKGGSRMHKRPRFSLPDDSDDSLLVDEPDEGPSMPWMRSGRGGMPWLMGGLDMHSPAAWGLNVGASGWGHQGDSSTSLMPGVQTAGPSSKGGADIQPLQVDESVSFKDIGGLSEYIDALKEMVFFPLLYPDFFANYHITPPRGVLLCGPPGTGKTLIARALACAASKAGQKVSFYMRKGADVLSKWVGEAERQLKLLFEEAQKNQPSIIFFDEIDGLAPVRSSKQEQIHNSIVSTLLALMDGLDSRGQVVLIGATNRIDAIDGALRRPGRFDREFYFPLPGYEARAEILDIHTRKWKDPPPKELKMELAASCVGYCGADLKALCTEAAIRAFREKYPQVYTSDDKFVIDVDSVSVEKYHFLEAMSTITPAAHRGSIVHSRPLSSVIAPCLKRHLDKIMERISDIFPFLSSVDVSKFSALSYGSSIPLVYRPRLLICGGESVGLDHVGPAVLHELEKFSVHSLGLPSLLSDPSAKTPEEALVHIFGEAKRTTPSILYLPQFHLWWDTAHEQLRAVLLTLLNELPSNLPVLLLGTSSVAFTDLEEECASIFTSRNVYQVDQPSYDDRLRYFNILFESLLSFQTEESRNKSKKQKSAIDLPKAPKEVEGPKISELKAKAEAEQHAVRRMRMCLRDICNRILYNKRFNVFHFPVSEEEVPDYRSVIHKPMDMATVLQRVDSGQYLTRAAFMKDIDLIVLNAKTYNGDDYNGSRIVSRACELRDVVQGMLSQMDPSLVSFCDKIASQGGPLQVVDDEDSSILQAAPVAQLVSGTRISARLRNVQPEVNLSQSYEVLKRQKKSSENDQGMTKDAAARDERSPEDVDLSKPISPEEAPKEPDSNGTLKETDNSPAEAPEVPAPPEPMETDSSEVATTLTTGDDLLGQLEALKQRFMELTAGYGVPQLERLYSRIMKGAIELTSKESNEDHRGLVVRYLLTFVENSDNF

SEQ ID NO: 18067 - protein, 1199 aa, Panicum virgatum
MVAMEGKGDASVTPLRTSDRLRQRPKYYARGYMYYKPAMRKKVKSKKRTAASQIAKKLLRKPAARPPPADSIAANLRRSTRKRRISVNLEGYDTDSSSMEDDDLMRPRYLSSKSKGENNAAHDEVSARPKRQKLSNSIPRREGLRPRRSLRGQRLHAYQESEDEQESSEEQGAEDQRENGNEIEEDVGDDDEVDGGDEAEADGDDEDGEEEQEGRRRYDLRDRSEVRRPSPRKEGKHRPQSPRRVLVHGIGPKNSKYLKKGGSRMHKHPRFSLPDDSDDSLLVDEPDEGPSMPWMRSGRGGMPWLMGGLDMHSPAAWGLNVGASGWGHQGDSSTSLMPGVQTAGPSSKGGADIQPLQVDESVSFKDIGGLSEYIDALKEMVFFPLLYPDFFANYHITPPRGVLLCGPPGTGKTLIARALACAASKAGQKVSFYMRKGADVLSKWVGEAERQLKLLFEEAQKNQPSIIFFDEIDGLAPVRSSKQEQIHNSIVSTLLALMDGLDSRGQVVLIGATNRIDAIDGALRRPGRFDREFYFPLPGYEARAEILDIHTRKWKDPPPKELKMELAASCVGYCGADLKALCTEAAIRAFREKYPQVYTSDDKFVIDVDSVSVEKYHFLEAMSTITPAAHRGSIVHSRPLSSVIAPCLKRHLDKIMERISDIFPFLSSVDFSKFSALSYGSSIPLVYRPRLLICGGESVGLDHVGPAVLHELEKFSVHSLGLPSLLSDPSAKTPEEALVHIFGEAKRTTPSILYLPQFHLWWDTAHEQLRAVLLTLLNELPSNLPVLLLGTSSVAFTDLEEECASIFSSRNMYQVDQPSYDDRLRYFNILFESLLSFQTEESRNKSKKQKSAIDLPKAPKVVEGPKVSELKARAEAEQHAVRRMRMCLRDICNRILFNKRFNVFHFPVSEEEVPDYRSVIQKPMDMATVLQRVDSGQYLTRAAFMKDIDLIVSNAKTYNGNDYNGSRIVSRACELRDVVQGMLSQMDPSLVSFCDKIASQGGPLQVMDDEDSSILQAAPVTQLVSGTRISARLRNVQPEVNLSQSYEVLKRQKKSAENEQGMTKDVAVRGERSPEDVDLSKPISPEEAPKEPDSNGTLEEADNSPTEAAEIPARPEPMETDSSEVAATVSTGDDLLGQLEALKQRFMEHTAGYGVPQLERLYSRIMKGVIELTSKESNEDHRRLVVRYLLTFVENSDNF

SEQ ID NO: 18068 - protein, 1198 aa, Oryza sativa
MVGMEGKGDASVTPVRTSDRLRKRPKYFGRNYMYYNPAIRKKMKSKKRAAASQIAKKLLRKSAARAPPADSIAANLRRSTRKRRMSVNLEDYDTDSSSMEDDDLMRPRYRSSKNKVDDEVSARPKRKKLSNSSSIPRREGLRPRRSIRGQRLHPYQESEDDQESSEEQPAQDRRENGNDIEEDGNEEEVDGGDEAEADGDDEDGEEEQEGRRRYDLRDRSEVRRPSPRKEGKHRTQSPRRVLVHGIGPKNSKYLKKGGSRMHKRPRFSLPDDSDDSLLVDEPDEGPSMPWMRGGRGGMPWFLGGLDMHCPGAWGLNVGASGWGHQGDNTVSTSSLMPGIQTAGPSSKGGADIQPLQVDGSVSFNDIGGLSDYIDALKEMVFFPLLYPDFFANYHITPPRGVLLCGPPGTGKTLIARALACAASKAGQKVSFYMRKGADVLSKWVGEAERQLKLLFEEAQKNQPSIIFFDEIDGLAPVRSSKQEQIHNSIVSTLLALMDGLDSRGQVVLIGATNRIDAIDGALRRPGRFDREFFFPLPGYEARAEILDIHTRKWKDPPPKELKTELAASCVGYCGADLKALCTEAAIRAFREKYPQVYTSDDKFVIDVDSVRVEKYHFLEAMSTITPAAHRGSIVHSRPLSPVIAPCLKRHHEKIMERIADIFPFLSSVDVSKFSALSYGSSIPLVYRPRLLMCGGVSVGLDHVGPAVLHELEKFSVHSLGLPSLLSDPSAKTPEEALVHIFGEARRTTPSILYLPQFHLWWDTAHEQLRAVLLTLLNELPSNLPVLLLGTSSVAFGDLEEECASIFSSRNVYEVDQPSDDDRMRYLHALFESLLSFQMEESRSKSKDQKSSVDLPKAPKEVDGPKLSELKAKAEAEQHAVRRMRMCLRDICNRILYNKRFNVFHFPVSEEEVPDYRSVVHNPMDMATVLQQVDSGQYLTRASFMKDIDLIVSNAKTYNGSDYNGSRIVSRACELRDVVQGMLSQMDPSLVSFCDKIAEQGGPLQVTDDGDSSILQAAPVAQLVSGTRMSARLRNVQPEVNLSRSYEALKRQKKSTETEQGMVKESTTRDDKSLGDVDLSKPISPEEAPKEPDSNGVLKETDNPPTELPELPELNPEPMVTDNGENAAMPASDDIPEQLEVVKRRFMELTTGYGVPQLERLCTRVMKGMIELSGKESNEDHRRLVVRYLLTFVENSDNF

SEQ ID NO: 18069 - protein, 1199 aa, Oryza sativa
MVGMEGKGDASVTPVRTSDRLRKRPKYFGRNYMYYNPAIRKKMKSKKRAAASQIAKKLLRKSAARAPPADSIAANLRRSTRKRRMSVNLEDYDTDSSSMEDDDLMRPRYRSSKNKVDDEVSARPKRKKLSNSSSIPRREGLRPRRSIRGQRLHPYQESEDDQESSEEQPAQDRRENGNDIEEDGNEEEEVDGGDEAEADGDDEDGEEEQEGRRRYDLRDRSEVRRPSPRKEGKHRTQSPRRVLVHGIGPKNSKYLKKGGSRMHKRPRFSLPDDSDDSLLVDEPDEGPSMPWMRGGRGGMPWFLGGLDMHCPGAWGLNVGASGWGHQGDNTVSTSSLMPGIQTAGPSSKGGADIQPLQVDGSVSFNDIGGLSNYIDALKEMVFFPLLYPDFFANYHITPPRGVLLCGPPGTGKTLIARALACAASKAGQKVSFYMRKGADVLSKWVGEAERQLKLLFEEAQKNQPSIIFFDEIDGLAPVRSSKQEQIHNSIVSTLLALMDGLDSRGQVVLIGATNRIDAIDGALRRPGRFDREFFFPLPGYEARAEILDIHTRKWKDPPPKELKTELAASCVGYCGADLKALCTEAAIRAFREKYPQVYTSDDKFVIDVDSVRVEKYHFLEAMSTITPAAHRGSIVHSRPLSPVIAPCLKRHLEKIMERIADIFPFLSSVDISKFSALSYGSSIPLVYRPRLLMCGGVSVGLDHVGPAVLHELEKFSVHSLGLPSLLSDPSAKTPEEALVHIFGEARRTTPSILYLPQFHLWWDTAHEQLRAVLLTLLNELPSNLPVLLLGTSSVAFGDLEEECASIFSSRNVYEVDQPSDDDRMRYLHALFESLLSFQMEESRSKSKDQKSSVDLPKAPKEVDGPKLSELKAKAEAEQHAVRRMRMCLRDICNRILYNKRFNVFHFPVSEEEVPDYRSVVHNPMDMATVLQQVDSGQYLTRASFMKDIDLIVSNAKTYNGSDYNGSRIVSRACELRDVVQGMLSQMDPSLVSFCDKIAEQGGPLQVTDDGDSSILQAAPVAQLVSGTRMSARLRNVQPEVNLSRSYEALKRQKKSTETEQGMVKESTTRDDKSLGDVDLSKPISPEEAPKEPDSNGVLKEIDNPPTELPELPELNPEPMVTDNGENAAMPASDDIPEQLEVVKRRFMELTTGYGVPQLERLCTRVMKGMIELSGKESNEDHRRLVVRYLLTFVENSDNF

SEQ ID NO: 18070 - protein, 1195 aa, Brachypodium distachyon
MVGMDGKGDASVAPVRTSDRLRQRPKYYGRGYLYYSPNMRKKIKSKKRTAASQIAKKLLHKPAAPADSIAANLRRSTRKRRMSVTLEDYGTDTSSSEDDDLMRPRYRSSKSKVNDEVSPRPKRKMSNSNSIPRREGLRPRRSLRGQRHHPYQDSDDDQESSEEQHTQDQRENGNDVEEDDANEDEVDGGDEAEADGDDEDGEEEQEGRRRYDLRDRSEVRRPSPRKEGKHRPQSPRRVLVHGIGPKNSKYLKKGGSRMHKRPRFSLPDDSDDSLLVDEPDEGPSMPWMRSGRGGMPWFLGGLDMHSSAAWGLNAGASGWGHQGDSTVSTSSLMPGAQTAGPSSKGGADIQPLQIDESVSFNDIGGLSEYIDALKEMVFFPLLYPDFFANYHITPPRGVLLCGPPGTGKTLIARALACAASKAGQKVSFYMRKGADVLSKWVGEAERQLKLLFEEAQKNQPAIIFFDEIDGLAPVRSSKQEQIHNSIVSTLLALMDGLDSRGQVVLIGATNRIDAIDGALRRPGRFDREFYFPLPGYEARAEILDIHTRKWKDPPPKELKLELAASCVGYCGADLKALCTEAAIRAFREKYPQVYTSDDKFVIDVDSVRVEKNHFLEAMSTITPAAHRGSIVHARPLSSVVAPCLKRHLEKIMERISDVFPFISSLDVSKFSSLSYGSSIPLVYRPRLLICGVEGVGLDHVGPAVLHELEKFSVHSLGLPSLLSDPSAKTPEEALVHIFGEARRTTPSILYLPQFHLWWDTAHEQLRAVLLTLLNELASNLPVFLLGTSSVAFDDLEEECASIFSSRNVYQVDRPSDDDRLRYFSILFESLFSLQMDDSRCKSKDKKASIDLPKAPKEVDGPKVSELKAKAEAEQHAVRRMRMCLRDICNRILYNKRFNAFHFPVSEEEVPDYRVIVHNPMDMASVLQRVDSGQYFTRATFMKDIDLIVSNAKTYNGDDYNGSRIVSRACELRDVVQGMLSQMDPSLVSFCDKIAAQGGPLQAMDDEDSSILQAAPVVQLVSVTRTSARLRNVQPEVDLSRSYEVLKRHKKSTENEQGMTIKESTARDERSPGDIVLPKPTSPEEALKEPDSNGPLKDTDNVPAEAPASSGSPPEPMVTDNGYPAMHTSDDTLEQLEAVKQRFMELTVGYGVPQLERLYSRIMKGVIELGGKESKEDHRRLVVRHLLVFVENSDNF

SEQ ID NO: 18071 - protein, 1196 aa, Triticum aestivum
GDESVAPVRSSDRLRQRPKYYGRGYLYYSPNMRNKMNSNKKRTAASQIAKKLLRKPAAREPPADSIAANLRRSTRKRRMSVTLEDYGTDSSSMEDDDLMRPRYRSSSKSKGDDQVSARPKRKKMSNSNSIPRREGLRPRRSLRGQRHLPYQVSDDDQESSEEEHEQDQRENGNEIEEDGANEEEIDGGDEAEEDGDDEDGEEEQEVRRRYDLRDRAEVRRPSPQKEGKHRPQSPRRVLVQGVGPKNSKYLKKGGSRMHKRPRFSMPDDSDDSLLVDEPDEGPSMPWMRSGRGGMPPWLMGGLDMHNSAAWGLNAGASGWGHQGDTGVSTSSLMPGAQTAGPSSKGGADIQPLQIDESVSFNDIGGLSEYIDALKEMVFFPLLYPDFFANYHITPPRGVLLCGPPGTGKTLIARALACAASKAGQKVSFYMRKGADVLSKWVGEAERQLKLLFEEAQKNQPAIIFFDEIDGLAPVRSSKQEQIHNSIVSTLLALMDGLDSRGQVVLIGATNRIDAIDGALRRPGRFDREFYFPLPGYEARAEILDIHTRKWKEPPPKELKMELAASCVGYCGADLKALCTEAAIRAFREKYPQVYTSDDKFVIDVDSVRVERNHFLEAMSTITPAAHRGSIVHSRPLSPVIAPCLKRHLEKIMERISDIFPYLSALDLSKYSTLSYGSSIPLVYRPRLLMCGVEGVGLDHVGPAVLHELEKFPVHSLGLPSLLSDPSAKTPEEALVHIFGEARRTTPSILYLPQFHLWWDTAHEQLRAVLLTLLNELASNLPVLLLGTSSVAFDDLEEECASIFSSRNVYQVDRPSDDDRLRYFSILFESLLSLQMEDSRSKSKEQKSIDLPKAPKKVDGPKVSELKAKAEAEQHAVRRMRMCLRDICNRILYNKRFTAFHFPVSEEEVPDYRTIVHNPMDMAAVLQRVDSGQYFSQAAFLKDINLIVTNAKTYNGDDYNGSRIVSRACELRDVVQGMLSQMDPSLVSFCDKIAAQGGPLQAMDDEDSSILQAPPVVQLVSVTRTSARLRNVQPEVDLSRSYEVLKRHKKSTENEHGTSAKESTARDGTSSGDVDLSKPTSPEEAPKGPHSNGPLKEADKAPDEAPPILPGSPPDPMETDNGEDSAMPTSDDTLEQLEGLKQRFMELTVGYGVPQLERLYSRIMKGAIELTGKETNKDHRRLVVRHLLAFVENSDNF

SEQ ID NO: 18072 - protein, 1211 aa, Hordeum vulgare
MAGMAGKGDDSVAPVRSSDRLRQRTKYYSRGYLYYSPSMRNKMKSNKKRTAASQIAKKLLGKPAAREPPADSIAANLRRSTRKRRMSVTLEDYGTDSSSMEDDDLMRPRYRSSSKSKGDDQVSSRPKCKKMSNSNSIPRREGLRPRRSLRGQRHLPYQVSDDDQESSEEEHEQDQRENGNEVEEDGANEEEIDGGDEAEEDGGDEAEEDGDDEDGEEEQEVRRRYDLRDRAEVRRPSPQKEGKHRPQSPRRVLVQGIGPKNSKYLKKGGSRTHKRPRFSVPDDSDDSLLVDEPDEGPSMPWMRSGRGGMPPWLMGGLDMHNSTAWGLNAGASGWGHQGDTGVSTSSLMPGAQTAGPSSKGGADIQPLQIDESVSFNDIGGLSEYIDALKEMVFFPLLYPDFFANYHITPPRGVLLCGPPGTGKTLIARALACAASKAGQKVSFYMRKGADVLSKWVGEAERQLKLLFEEAQKNQPAIIFFDEIDGLAPVRSSKQEQIHNSIVSTLLALMDGLDSRGQVVLIGATNRIDAIDGALRRPGRFDREFYFPLPGYEARAEILDIHTRKWKEPPPKELKMELAASCVGYCGADLKALCTEAAIRAFREKYPQVYTSDDKFVIDVDSVRVERNHFLEAMSTITPAAHRGAIVHSRPLSPVIAPCLKRHLEKIMQRISDTFPYLSALDISKYSTLSYGSSIPLVYRPRLLMCGVEGVGLDHVGPAVLHELEKFPVHSLGLPSLLSDPSAKTPEEALVHIFGEARRTTPSILYLPQFHLWWDTAHEQLRAVLLTLLNELASNLPVLLLGTSSVAFDDLEEECASIFSSRNVYQVDRPSDDDRSRYFSILFESLLSLQMEDSRSKSKEQKSVDLPKAPKKVDGPKVSELKAKAEAEQHAVRRMRMCLRDICNRILYNKRFSAFHFPVSEEEVPDYRTIVHNPMDMAAVLQRVDSGQYFSQAAFLKDINLIVTNAKTYNGDDYNGSRIVSRACELRDVVQGMLSQMDPSLVSFCDKIAAQGGPLQAMDDEDSSILQAPPVVQLVSVTRTSARLRNVQPEVALSRSYEVLKRHKKSTENDHGTAAKESTARDERSPGDVDLSKPTSPEEAPKGSHPNGPSKKADKAPAESPPILPGSPPDPMETDNGEDSAMPTSDDTLEQLEGVKQRFMELTVGYGVPQLERLYSRIMRGAIELTGKETNKDHRRLVVRHLLAFVENSDNF

SEQ ID NO: 18073 - protein, 1174 aa, Secale cereale
RGYLYYSPNMRNKMNSNKKRTAASQIAKKLLRKPAAREPPADSIAANLRRSTRKRRMSVTLEDYGTDSSSMEDDDLMRPRYRSSSKSKGDDQVSERPKRKKMSNSNSIPRREGLRPRRSLRGQRHLPYQVSDDDQESSEEEHEQDQRENGNEIEEDGANEEEVDGGDEAEEDGDDEDGEEEQEVRRRYDLRDRAEVRRPSPQKEGKHRPQSPRRVLVQGIGPKNSKYLKKGGSRMHKRPRFSMPDDSDDSLLVDEPDEGPSMPWMRSGRGGVPPWLMGGLDMHNSAAWGLNAGASGWGHQGDTGVSTSSLMPGAQTAGPSSKGGADIQPLQIDESVSFNDIGGLSQYIDALKEMVFFPLLYPDFFANYHITPPRGVLLCGPPGTGKTLIARALACAASKAGQKVSFYMRKGADVLSKWVGEAERQLKLLFEEAQKNQPAIIFFDEIDGLAPVRSSKQEQIHNSIVSTLLALMDGLDSRGQVVLIGATNRIDAIDGALRRPGRFDREFYFPLPGYEARAEILDIHTRKWKEPPPKELKMELAASCVGYCGADLKALCTEAAIRAFREKYPQVYTSDDKFVIDVESVRVERNHFLEAMSTITPAAHRGSIVHSRPLSPVIAPCLKRHLEKIMERISDIFPYLSALDLSKYSTLSYGSSIPLVYRPRLLMCGVEGVGLDHVGPAVLHELEKFPVHSLGLPSLLSDPSAKTPEEALVHIFGEARRTTPSILYLPQFHLWWDTAHEQLRAVLLTLLNELASNLPVLLLGTSSVAFDDLEEECASIFSSRNVYQVDRPSDDDRLRYFSILFESLLSLQMEDSRSKSKEQKSIDLPKAPKKVDGPKVSELKAKAEAEQHAVRRMRMCLRDICNRILYNKRFTAFHFPVSEEEVPDYRTIVHNPMDMAAVLQRVDSGQYFSQAAFLKDINLIVTNAKTYNGDDYNGSRIVSRACELRDVVQGMLSQMDPSLVSFCDKIAAQGGPLQAMDDEDSSILQAPPVVQLVSVTRTSARLRNVQPEVDLSRSYEVLKRHKKNTENEHGTATKESTARDGRSPGDVDLSKPTSPEEAPKGPHSNGPSKEAHKAPDVAPPILPGSPPDPMETDNGEDSAMPTSDDMLEQLEGVKQRFMELTVGYGVPQLERLYSRIMKGAIELTGKETNKDHRRLVVRHLLAFVENSDNF

SEQ ID NO: 18074 - protein, 1134 aa, Triticum aestivum
ADSIAANLRRSTRKRRMSVTLEDYGTDSSSMEDDDLMRPRYRSSSKSKGDDQVSARPKRNKMSNSNSIPRREGLRPRRSLRGQRHLPYQVSDDDQESSEEEHEQDQRENGNEVEEDGANEEEIDGGDEAEEDGDDEDGEEEQEVRRRYDLRDRAEVRRPSPQKEGKHRPQSPRRVLVQGIGPKNSKYLKKGGSRMHKRPRFSMPDDSDDSLLVDEPDEGPSMPWMRSGRGGMPPWLMGGLDMHNSAAWGLNAGASGWGHQGDTGVSTSSLMPGAQTAGPSSKGGADIQPLQIDESVSFNDIGGLSEYIDALKEMVFFPLLYPDFFANYHITPPRGVLLCGPPGTGKTLIARALACAASKAGQKVSFYMRKGADVLSKWVGEAERQLKLLFEEAQKNQPAIIFFDEIDGLAPVRSSKQEQIHNSIVSTLLALMDGLDSRGQVVLIGATNRIDAIDGALRRPGRFDREFYFPLPGYEARAEILDIHTRKWKEPPPKELKMELAASCVGYCGADLKALCTEAAIRAFREKYPQVYTSDDKFVIDVDSVRVERNHFLEAMSTITPAAHRGSIVHSRPLSPVIAPCLKRHLEKIMERISDIFPYLSALDLSKYSTLSYGSSIPLVYRPRLLMCGVEGVGLDHVGPAVLHELEKFPVHSLGLPSLLSDPSAKTPEEALVHIFGEARRTTPSILYLPQFHLWWDTAHEQLRAVLLTLLNELASNLPVLLLGTSSVAFDDLEEECASIFSSRNVYQVDRPSDDDRSRYFSILFESLLSLQMEDSRSKSKEKKSIDLPKAPKKVDGPKVSELKAKAEAEQHAVRRMRMCLRDICNRILYNKRFTAFHFPVSEEEVPDYRTIVHNPMDMAAVLQRVDSGQYFSQAAFLKDINLIVTNAKTYNGDDYNGSRIVSRACELRDVVQGMLSQMDPSLVSFCDKIAAQGGPLQAMDDEDSSILQAPPVVQLVSVTRTSARLRNVQPEVDLSRSYEVLKRHKKSTKNEHGTAAKESTARDGKSPGDVDLSKPTSPEEAPKGPHSNGPLKEADKAPDEAPPTLPGSPPDPMETDNGEDSAMPTSDDMLEQLEGVKQRFMELTVGYGVPQLERLYSRIMKGAIELTGKETNKDHRRLVVRHLLAFVENSDNF

SEQ ID NO: 18075 - protein, 1090 aa, Echinochloa colona
MSVWNYVVTAHKPTSVSHSCVGNFTSSNQLNLIIAKCTRIEIHLLTPQGLQPMLDVPIYGRIATIELFRPHNETQDFLFIATERYKFCVLQWDAEKSELLTRSMGDVSDRIGRPTDNGQIGIIDPDCRLIGLHLYDGLFKVIPFDNKGQLKEAFNIRLEELQVLDIKFLHGCVKPTIVVLYQDNKDARHVKTYEVALKDKDFVEGPWSQNNLDNGAGLLIPVPAPLGGVIIIGEETIVYCNANATFKAIPIKQSIIRAYGRVDPDGSRYLLGDNTGILHLLVLTHERERVTGLKVEYLGETSIASSISYLDNGVVYVGSRFGDSQLVKLNLQADASGSFVEVLERYVNLGPIVDFCVVDLDRQGQGQVVTCSGAFKDGSLRVVRNGIGINEQASVELQGIKGLWSLKSSFNDPYDMYLVVSFISETRFLAMNMEDELEETEIEGFDAQTQTLFCQNAINDLLIQVTANSVRLVSCTSRELVDQWNAPSGFSVNVASANASQVLLATGGGHLVYLEIRDAKLVEVKHAQLEHEISCLDLNPIGESPQYSSLAAVGMWTDISVRIFSLPDLELIKKENLGGEIVPRSVLLCTLEGVSYLLCALGDGNLFSFLLNASTGELTDRKKVSLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSRTIAFCSFKYNQTSMEESETHYIRLLDHQTFEFLSTYPLDQYECGCSIISCSFADDSNVYYCVGTAYVIPEENEPTKGRILVFAVEDGRLQLIVEKETKGAVYSLNAFNGKLLAAINQKIQLYKWMLRDDSSHELQSECGHHGHILALYTQTRGDFIVVGDLMKSISLLVYKHEESAIEERARDYNANWMTAVEMLDDEAYIGAENSYNLFTVRKNSDAATDDERARLEVVGEYHLGEFVNRFRHGSLVMRLPDSEIGQIPTVIFGTINGVIGIIASLPHDQYVFLEKLQSTLVKFIKGVGNLSHEQWRSFHNDKKTAEARNFLDGDLIESFLDLSRSKMEEVSKAMGVPVEELSKRVEELTRLH

SEQ ID NO: 18076 - protein, 1090 aa, Oryza sativa
MSVWNYVVTAHKPTSVTHSCVGNFTGPNQLNLIVAKCTRIEIHLLTPQGLQPMIDVPIYGRIATLELFRPHNETQDFLFIATERYKFCVLQWDGEKSELLTRAMGDVSDRIGRPTDNGQIGIIDPDCRLIGLHLYDGLFKVIPFDNKGQLKEAFNIRLEELQVLDIKFLYGCVKPTIVVLYQDNKDARHVKTYEVALKDKDFVEGPWSQNNLDNGAGLLIPVPAPLGGVIIIGEETIVYCNANSTFRAIPIKQSIIRAYGRVDPDGSRYLLGDNAGILHLLVLTHERERVTGLKIEYLGETSIASSISYLDNGVVYVGSRFGDSQLVKLNLQADPNGSYVEVLERYVNLGPIVDFCVVDLDRQGQGQVVTCSGAFKDGSLRVVRNGIGINEQASVELQGIKGLWSLKSSFNDPYDMYLVVSFISETRFLAMNMEDELEETEIEGFDAQTQTLFCQNAINDLLIQVTANSVRLVSCTSRELVDQWNAPEGFSVNVASANASQVLLATGGGHLVYLEIKDSKLVEVKHIQLEHEISCVDLNPIGENPQYSSLAAVGMWTDISVRILSLPDLELIRKENLGGEIVPRSVLLCTLEGVSYLLCALGDGHLFSFLLNASTGELTDRKKVSLGTQPISLRTFSSKGTTHVFASSDRPTVIYSSNKKLLYSNVNLKEVNHMCPFNTAAIPDSLAIAKEGELSIGTIDDIQKLHIRTIPLNEQARRICHQEQSRTLAFCSFKHNQTSIEESETHFVRLLDHQTFEFLSIYQLDQYEHGCSIISCSFSDDNNVYYCVGTAYVLPEENEPSKGRILVFAVEDGRLQLIVEKETKGAVYSLNAFNGKLLAAINQKIQLYKWMLREDGSHELQSECGHHGHILALYTQTRGDFIVVGDLMKSISLLVYKHEESAIEELARDYNANWMSAVEMLDDEIYIGAENNYNIFTVRKNSDAATDEERGRLEVVGEYHLGEFVNRLRHGSLVMRLPDSEMGQIPTVIFGTINGVIGIIASLPHEQYVFLEKLQSTLVKFIKGVGNLSHEQWRSFHNDKKTSEARNFLDGDLIESFLDLSRNKMEEVAKGMGVPVEELSKRVEELTRLH

SEQ ID NO: 18077 - protein, 1090 aa, Hordeum vulgare
MSTWNYVVTAHKPTSVSHSCVGNFTGPHQLNLIVAKCTRIEIHLLTPQGLQPMLDVPIYGRIATIELFRPHNEAQDFLFIATERYKFCVLQWDAEKSELLTRSMGDVSDRIGRPTDNGQIGIIDPDCRLIGLHLYDGLFKVIPFDNKGQLKEAFNIRLEELQVLDIKFLYGCLRPTIVVLYQDNKDARHVKTYEVALKEKDFVEGPWSQNNLDNGAGLLIPVPAPLGGVIIIGEETIVYCNANSTFRAIPIKQSITRAYGRVDPDGSRYLLGDNSGILHLLVLTQERERVTGLKIEHLGETSVASSISYLDNGVVYVGSRFGDSQLVKLNLQPDATGSFVEILERYVNLGPIVDFCVVDLDRQGQGQVVTCSGAFKDGSIRVVRNGIGINEQASVELQGIKGLWSLKSSFSDLYDMYLVVSFISETRFLAMNMEDELEEIEIEGFDAQIQTLFCQNAINDLLIQVTANSVRLVSCTSRELVDQWNAPEGFSVNVASANASQVLLATGGGHLVYLEIRDAKLVEVKHAQLEHEISCVDLNPVGENPQYSSLAAIGMWTDISVSIFSLPDLELIRKENLGGEIVPRSVLMCTLEGISYLLCALGDGHLFSFLLNASTGELTDRKKVSLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSRTLAFCSFKYTQNSMEESEAHFIRLMDHQTFEFLSTHPLDQYECGCSMISCSFSDDNNFYYCVGTAYVLPEENEPTKGRILVFAVEDGRLQLIVEKETKGAVYSLNAFNGKLLAAINQKIQLYKWMTREDGSHELQSECGHHGHILALYTQTRGDFIVVGDLMKSISLLVYKHEESAIEELARDYNANWMTAVEMIDDDIYVGAENSYNLFTVRKNSDAATDEERGRLEVVGEYHLGEFVNRFRHGSLVMRLPDSEMGQIPTVIFGTINGVIGIIASLPHDHYVFLEKLQATLVKFIKGVGSLSHEQWRSFHNDKKTSEARNFLDGDLIESFLDLNRSKMEEVAKAMAVPVEELSKRVEELTRLH

SEQ ID NO: 18078 - protein, 1090 aa, Triticum aestivum
MSTWNYVVTAHKPTSVSHSCVGNFTGPHQLNLIVAKCTRIEIHLLTPQGLQPMLDVPIYGRIATIELFRPHNEAQDFLFIATERYKFCVLQWDAEKSELLTRSMGDVSDRIGRPTDNGQIGIIDPDCRLIGLHLYDGLFKVIPFDNKGQLKEAFNIRLEELQVLDIKFLYGCLRPTIVVLYQDNKDARHVKTYEVALKEKDFVEGPWSQNNLDNGAGLLIPVPAPLGGVIIIGEETIVYCNANSTFKAIPIKQSITRAYGRVDPDGSRYLLGDNSGILHLLVLTQERERVTGLKIEHLGETSVASSISYLDNGVVYVGSRFGDSQLVKLNLQPDATGSFVEILERYVNLGPIVDFCVVDLDRQGQGQVVTCSGAFKDGSIRVVRNGIGINEQASVELQGIKGLWSLKSSFSDLYDMYLVVSFISETRFLAMNMEDELEEIEIEGFDAQIQTLFCQNAINDMLIQVTANSVRLVSCTSRELVDQWNAPEGFSVNVASANASQVLLATGGGHLVYLEIRDAKLVEVKHAQLEHEISCVDLNPVGENPQYSSLAAIGMWTDISVSIFSLPDLELIRKENLGGEIVPRSVLMCTLEGISYLLCALGDGHLFSFLLNASTGELTDRKKVSLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSRTLAFCSFKYTQNSMEESEAHFIRLMDHQTFEFLSTHPLDQYECGCSMISCSFSDDNNFYYCVGTAYVLPEENEPTKGRILVFAVEDGRLQLIVEKETKGAVYSLNAFNGKLLAAINQKIQLYKWMTREDGSHELQSECGHHGHILALYTQTRGDFIVVGDLMKSISLLVYKHEESAIEELARDYNANWMTAVEMIDDDIYVGAENSYNLFTVRKNSDAATDEERGRLEVVGEYHLGEFVNRFRHGSLVMRLPDSEMGQIPTVIFGTINGVIGIIASLPHDHYVFLEKLQTTLVKFIKGVGSLSHEQWRSFHNDKKTSEARNFLDGDLIESFLDLNRSKMEEVAKAMAVPVEELSKRVEELMRLH

SEQ ID NO: 18079 - protein, 1090 aa, Triticum aestivum
MSTWNYVVTAHKPTSVSHSCVGNFTGPHQLNLIVAKCTRIEIHLLTPQGLQPMLDVPIYGRIATIELFRPHNEAQDFLFVATERYKFCVLQWDAEKSELLTRSMGDVSDRIGRPTDNGQIGIIDPDCRLIGLHLYDGLFKVIPFDNKGQLKEAFNIRLEELQVLDIKFLYGCLRPTIVVLYQDNKDARHVKTYEVALKEKDFVEGPWSQNNLDNGAGLLIPVPAPLGGVIIIGEETIVYCNANSTFKAIPIKQSITRAYGRVDPDGSRYLLGDNSGILHLLVLTQERERVTGLKIENLGETSVASSISYLDNGVVYVGSRFGDSQLVKLNLQPDATGSFVEILERYVNLGPIVDFCVVDLDRQGQGQVVTCSGAFKDGSIRVVRNGIGINEQASVELQGIKGLWSLKSSFNDLYDMYLVVSFISETRFLAMNMEDELEEIEIEGFDAQIQTLFCQNAINDMLIQVTANSVRLVSCTSRELVDQWNAPEGFSVNVASANASQVLLATGGGHLVYLEIRDAKLVEVKHAQLEHEISCVDLNPVGENPQYSSLAAIGMWTDISVSIFSLPDLELIRKENLGGEIVPRSVLMCTLEGISYLLCALGDGHLFSFLLNASTGELTDRKKVSLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSRTLAFCSFKYTQNSMEESEAHFIRLMDHQTFEFLSTHPLDQYECGCSMISCSFSDDNNFYYCVGTAYVLPEENEPTKGRILVFAVEDGRLQLIVEKETKGAVYSLNAFNGKLLAAINQKIQLYKWMTREDGSHELQSECGHHGHILALYTQTRGDFIVVGDLMKSISLLVYKHEESAIEELARDYNANWMTAVEMIDDDIYVGAENSYNLFTVRKNSDAATDEERGRLEVVGEYHLGEFVNRFRHGSLVMRLPDSEMGQIPTVIFGTINGVIGIIASLPHDHYVFLEKLQTTLVKFIKGVGSLSHEQWRSFHNDKKTSEARNFLDGDLIESFLDLNRAKMEEVAKAMAVPVEELSKRVEELMRLH

SEQ ID NO: 18080 - protein, 1090 aa, Secale cereale
MSTWNYVVTAHKPTSVSHSCVGNFTGPHQLNLIVAKCTRIEIHLLTPQGLQPMLDVPIYGRIATIELFRPHNEAQDFLFVATERYKFCVLQWDAEKSELLTRSMGDVSDRIGRPTDNGQIGIIDPDCRLIGLHLYDGLFKVIPFDNKGQLKEAFNIRLEELQVLDIKFLYGCVRPTIVVLYQDNKDARHVKTYEVALKEKDFVEGPWSQNNLDNGAGLLVPVPAPLGGVIIIGEETIVYCNANSTFKAIPIKQSITRAYGRVDPDGSRYLLGDNSGILHLLVLTQERERVTGLKIEHLGETSVASSISYLDNGVVYVGSRFGDSQLVKLNLQPDATGSFVEILERYVNLGPIVDFCVVDLDRQGQGQVVTCSGAFKDGSIRVVRNGIGINEQASVELQGIKGLWSLKSSFSDLYDMYLVVSFISETRFLAMNMEDELEEIEIEGFDAQIQTLFCQNAINDLLIQVTANSVRLVSCTSRELVDQWNAPEGFSVNVASANASQVLLATGGGHLVYLEIRDAKLVEVKHAQLEHEISCVDLNPVGENPQYSSLAAIGMWTDISVSIFSLPDLELIRKENLGGEIVPRSVLMCTLEGISYLLCALGDGHLFSFLLNASTGELTDRKKVSLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSRTLAFCSFKYTQNSMEESEAHFIRLMDHQTFEFLSTHPLDQYECGCSMISCSFSDDNNFYYIVGTAYVLPEENEPTKGRILVFAVEDGRLQLIVEKETKGAVYSLNAFNGKLLAAINQKIQLYKWMTREDGSHELQSECGHHGHILALYTQTRGDFIVVGDLMKSISLLVYKHEESAIEELARDYNANWMTAVEMIDDDIYVGAENSYNLFTVRKNSDAATDEERGRLEVVGEYHLGEFVNRFRHGSLVMRLPDSEMGQIPTVIFGTINGVIGIIASLPHDHYVFLEKLQTTLVKFIKGVGSLSHEQWRSFHNDKKTSEARNFLDGDLIESFLDLNRAKMEEVAKAMAVPVEELSKRVEELTRLH

SEQ ID NO: 18081 - protein, 1090 aa, Brachypodium distachyon
MSTWNYVVTAHKPTSVSHSCVGNFTSNTQLNLIVAKCTRIEIHLLTPQGIQPLLDVPIYGRIATIELFRPPTEAQDFLFIATERYKFCVLQWDAEKSELITRSVGDVSDRIGRPTDNGQIGIIDPDCRLIGLHLYDGLFKVIPFDNKGQLKEAFNIRLEELQVLDIKFLYGCLRPTIVVLYQDNKDARHVKTYEVALKDKDFVEGPWSQNNLDNGAGLLIPVPAPLGGVIIIGEETIVYCNANSTFKAIPIKQSIIRAYGRVDPDGSRYLLGDNTGILHLLVLTQERERVTGLKIEHLGETSVASSISYLDNGVVYVGSRFGDSQLVKLNLQADATGSFVEVLERYVNLGPIVDFCVVDLDRQGQGQVVTCSGAFKDGSIRVVRNGIGINEQASVELQGIKGLWSLKSSFNDPYDTFLVVSFISETRFLAMNMEDELEETEIEGFDAQIQTLFCQNAISDLLIQVTANSVRLVSCASRELVDHWNAPDGFSVNVASANASQVLLATGGGHLVYLEIRDAKLVEVKHAQLEHEISCVDLNPIGENPQYSSLAAIGMWTDISVSLLSLPDLELIRKENLGGEIVPRSVLLCTLEGVSYLLCALGDGHLFSFLLNVSTGELTDKKKVSLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSRTLAFCSFKYNPNSMEESEAHFIRLLDHQTFEFLSTHPLDQYECGCSMISCSFSDDNNFYYCVGTAYVLPEENEPTKGRILVFAVEDGRLQLIVEKETKGAVYSLNAFNGKLLAAINQKIQLYKWMTREDGSHELQSECGHHGHILALFTQTRGDFIVVGDLMKSISLLVYKHEESAIEELARDYNANWMTAVEMIDDDIYVGAENSYNLFTVRKNSDAATDEERGRLEVVGEYHLGEFVNRFRHGSLVMRLPDTEMGQIPTVIFGTINGVIGIIASLPHDQYVFLEKLQSILGKFIKGVGSLSHDQWRSFHNEKKTAEARNFLDGDLIESFLDLNRSKMEEVSKGMGVSVENLSKRVEELTRLH

SEQ ID NO: 18082 - protein, 1090 aa, Lolium multiflorum
MSTWNYVVTAHKPTSVSHSCVGHFTGPNQLNLIVAKCTRIEIHLLTPQGLQPMLDVPIYGRIATIELFRPGNEAQDFLFIATERYKFCILQWDAEKSELLTRSMGDVSDRIGRPTDNGQIGIVDPDCRIIGLHLYDGLFKVIPFDNKGQLKEAFNIRLEELQVLDIKFLYGCLRPTIVVLYQDNKDARHAKTYEVALKDKDFVEGPWSQNNLDNGAGLLIPVPAPLGGVIIIGEETIVYCNANSTFKAIPIKQSIIRAYGRVDPDGSRYLLGDNTGTLHLLVLTQERERVTGLKIEHLGETSVASSISYLDNGVVYVGSRFGDSQLVKLNLQPDASGSFVEVLERYVNLGPIVDFCVVDLDRQGQGQVVTCSGAFKDGSIRVVRNGIGINEQASVELQGIKGLWSLKSSFNDPYDMYLVVSFISETRFLAMNMEDELEETEIEGFDAQIQTLFCQNAINDLLIQVTANSVRLVSCTSRELVDQWNAPEGFSVNVASANASQVLLATGGGHLVYLEIRDAKLVEVKHAQLEHEISCVDLNPVGENPQYSSLAAIGLWTDISVSIYSLPDLELIRKESLGGEIVPRSVLLCTLEGVSYLLCALGDGHLFSFLLNASTGELTDRKKVSLGTQPISLRTFSSKGTTHVFASSDRPTVIYSSNKKLLYSNVNLKEVNHMSPFNTAAFPDSLAIAKEGELSIGTIDDIQKLHIRTIPLNEQARRICHQEQSRTLAFCSFKYNHDSMEQSEAHFIRLLDHQTFEFLSTHPLDPYECGCSMISCSFSDDNNFYYCVGTAYVLPEESEPTKGRILVFAVEDGRLQLIVEKETKGAVYSLNAFNGKLLAAINQKIQLYKWMTRDDGSHELQSECGHHGHILALYTQTRGDFIVVGDLMKSISLLVYKHEESAIEELARDYNANWMTAVEMIDDDIYVGAENSYNLFTVRKNSDAATDEERGRLEVVGEYHLGEFVNRFRHGSLVMRLPDSEMGQIPTVIFGTINGVIGIIASLPHDHYVFLEKLQATLVKFIKGVGSLSHEQWRSFHNDKKTSEARNFVDGDLIESFLDLNRGKMEEVAKVMAVPVEELSKRVEELTRLH

SEQ ID NO: 18083 - protein, 1090 aa, Avena sativa
MSTWNYVVTAHKPTSVSHSCVGHFTGPHQLNLIVAKCTRIEIHLLTPQGLQPMLDVPIYGRIATIELFRPINEAQDFLFIATERYKFCVLQWDAEKSELLTRSMGDVSDRIGRPTDNGQIGIVDPDCRIIGLHLYDGLFKVIPFDNKGQLKEAFNIRLEELQVLDIKFLYGCIRPTIVVLYQDNKDARHVKTYEVALKDKDFVEGPWSQNNLDNGAGLLIPVPNPLGGVIIIGEETIVYCNANSTFRAIPIKQSIIRAYGRVDPDGSRYLLGDNTGTLHLLVLTQERERVTGLKIEHLGETSVASSISYLDNGVVYIGSRFGDSQLVKLNLQPDVTGSFVEVLERYVNLGPIVDFCVVDLDRQGQGQVVTCSGAFKDGSIRVVRNGIGINEQASVELQGIKGLWSLKSSFNDPYDMYLVVSFISETRFLAMNMEDELEETEIEGFDAQIQTLFCQNAINDLLIQVTANSVRLVSCTSRELVDQWNAPEGFSVNVASANASQVLLATGGGHLVYLEIRDAKLVEVKHAQLEHEISCVDLNPVGENPQYSSLAAIGLWTDISVSIYSLPDLELIRKESLGGEIVPRSVLLCTLEGVSYLLCALGDGHLFSFLLNASTGELTDRKKVSLGTQPISLRTFSSKGTTHVFASSDRPTVIYSSNKKLLYSNVNLKEVNHMCPFNTAAFPDSLAIAKEGELSIGNIDDIQKLHIRTIPLNEQARRICHQEQSRTLAFCSFKYNHDSMEQSEAHFIRLLDHQTFEFLSTHPLDQYECGCSMISCSFSDDNNFYYCVGTAYVLPEENEPTKGRILVFAVEDGRLQLIVEKETKGAVYSLNAFNGKLLAAINQKIQLYKWMTRDDGSHELQSECGHHGHILALYTQTRGDFIVVGDLMKSISLLAYKHEESAIEELARDYNANWMTAVEMIDDDVYIGAENSYNLFTVRKNSDAATDEERGRLEVVGEYHLGEFVNRFRHGSLVMRLPDSEMGQIPTVIFGTINGVIGIIASLPHDHYVFLEKLQATLVKFIKGVGSLSHEQWRSFHNDKKTSEARNFLDGDLIESFLDLNRGKMEEVAKIMAVPVEELSKRVEELTRLH

SEQ ID NO: 18084 - protein, 1063 aa, Avena sativa
MSTWNYVVTAHKPTSVSHSCVGHFTGPHQLNLIVAKCTRIEIHLLTPQGLQPMLDVPIYGRIATIELFRPINEAQDFLFIATERYKFCVLQWDAEKSELLTRSMGDVSDRIGRPTDNGQIGIVDPDCRIIGLHLYDGLFKVIPFDNKGQLKEAFNIRLEELQVLDIKFLYGCIRPTIVVLYQDNKDARHVKTYEVALKDKDFVEGPWSQNNLDNGAGLLIPVPNPLGGVIIIGEETIVYCNANSTFRAIPIKQSIIRAYGRVDPDGSRYLLGDNTGTLHLLVLTQERERVTGLKIEHLGETSVASSISYLDNGVVYIGSRFGDSQLVKLNLQPDVTGSFVEVLERYVNLGPIVDFCVVDLDRQGQGQVVTCSGAFKDGSIRVVRNGIGINEQASVELQGIKGLWSLKSSFNDPYDMYLVVSFISETRFLAMNMEDELEETEIEGFDAQIQTLFCQNAINDLLIQVTANSVRLVSCTSRELVDQWNAPEGFSVNVASANASQVLLATGGGHLVYLEIRDAKLVEVKHAQLEHEISCVDLNPVGENPQYSSLAAIGLWTDISVSIYSLPDLELIRKESLGGEIVPRSVLLCTLEGVSYLLCALGDGHLFSFLLNASTGELTDRKKVSLGTQPISLRTFSSKGTTHVFASSDRPTVIYSSNKKLLYSNVNLKEVNHMCPFNTAAFPDSLAIAKEGELSIGNIDDIQKLHIRTIPLNEQARRICHQEQSRTLAFCSFKYNHDSMEQSEAHFIRLLDHQTFEFLSTHPLDQYECGCSMISCSFSDDNNFYYCVGTAYVLPEENEPTKGRILVFAVEDGRLQLIVEKETKGAVYSLNAFNGKLLAAINQKIQLYKWMTRDDGSHELQSECGHHGHILALYTQTRGDFIVVGDLMKSISLLAYKHEESAIEELARDYNANWMTAVEMIDDDVYIGAENSYNLFTVRKNSDAATDEERGRLEVVGEYHLGEFVNRFRHGSLVMRLPDSEMGQIPTVIFGTINGVIGIIASLPHDHYVFLEKLQATLVKFIKGVGSLSHEQWRSFHNDKKTSEARNFLDGDLIESFLDLNRG

SEQ ID NO: 18085 - protein, 1089 aa, Elaeis guineensis
MSVWNYVVTAHKPTNVTHSCVGNFTSPQELNLIIAKCTRIEIHLLTPHGLQPMLDVPIYGRIATLELFRPHGEPQDFLFIATERYKFCVLQWDAETSELITRAMGDVSDRIGRPTDNGQIGIIDPDCRLIGLHLYDGLFKVIPFDNKGQLKEAFNIRLEELQVLDIKFLYGCAKPTIVVLYQDNKDARHVKTYEVALKDKDFVEGPWAQNNLDNGAGLLIPVPMPLGGVIIIGEETIVYCSATAFKAIPIRPSIIRAYGRVDVDGSRYLLSDNAGLLHLLVITHERERVTGLKIEHLGETSVASTISYLDNAVVYVGSSYGDSQLIKLNLQPDAKGSYVEVLERYVNLGPIVDFCVVDLERQGQGQVVTCSGAYKDGSLRVVRNGIGINEQASVELQGIKGLWSLRSSTSDPYDTFLVVSFISETRILAMNMDDELEETEIEGFYAQAQTLFCHNAMHDQLVQVTANSVRLVSSTSRDLLDQWNAPSGFSVNVATANASQVLLATGGGHLVYIEIGNGKLVEAKHIQLEYEISCLDINPIGENSNYSSLAAVGMWTDISVRIFSLPSLEILTKENLGGEIIPRSVLLCTFEGVSYLLCALGDGHLFNFLLNTGTGELSNRKKVSLGTQPITLRTFSSKDTTHVFAASDRPTVIYSSNKKLLYSNVNLKEVSHICPFNSAAFPDSLAIAKEGELSIGAIDDIQKLHIRTIPLGEHARRICHQEQSRTFAVCSLKNCQTSTEETEMHFVRLLDDQSFEFISTYPLDTYEYGCSIISCSFSDDNNVYYCVGTAYVLPEENEPSKGRILVFLVEDGKLQLIAEKETKGAVYSLNAFNGKLLAAINQKIQLYKWMLRDDGSRELQSECGHHGHILALYVQTRGDFIIVGDLMKSISLLLYKHEEGAIEELARDYNANWMTAVEILDDDIYLGAENNFNLFTVRKNSDAATDEERGRLEVVGEYHLGEFVNRFRHGSLVMRLPDSEAGHIPTVIFGTVNGVIGIVASLPHDQYVFLEKLQSNLVKVIKGVGGLSHEQWRSFNNEKKTVDARNFLDGDLIESFLDLSRSRMEEISKAMGVSVEELCKRVEELTRLH

SEQ ID NO: 18086 - protein, 1089 aa, Ananas comosus
MSVWNYVVTAHKPTNVTHSCVGNFTGPQELNLIIAKCTRIEIHLLAPHGLQPMLDVPIYGRIATLELFRPHGEAQDFLFVATERYKFCVLQWDAESSELITRAMGDVSDRIGRPTDNGQIGIIDPDCRLIGLHLYDGLFKVIPFDNKGQLKEAFNIRLEELQVLDVKFLYGCSRPTIAVLYQDNKDARHVKTYEVALKDKDFVEGPWSQNNLDNGAGLLIPVPMPLGGVIIIGEETIVYCSGTSFKAIPIRPSITRAYGRVDADGSRYLLSDNTGLLHLLVITHERERVTGLRIEQLGETSVASTISYLDNAVVFVGSSYGDSQLIKLNLQPDAKGSYVEVLERYVNLGPIVDFCVVDLERQGQGQVVTCSGAYKDGSLRIVRNGIGINEQASVELQGIKGLWSLRSSMNDPHDTFLVVSFISETRILAMNMEDELEETEIEGFNSQTQTLLCQNVVYDQLVQVTAISVGLVSSTTRELLDQWNAPAGFSVNVAAANASQVLLATGGGHLVYLEIGNAKLVEVKHIQLEYEISCLDINPIGENPNYSSLAAVGMWTDISVRVFSLPSLELMTKENLGGEIIPRSVLLCNLEGVSYLLCALGDGHLFNFLLNTKTGELSDRKKVSLGTQPISLRTFSSKDATHVFAASDRPTVIYSSNKKLLYSNVNLKEVSHMCPFNSAAFPDSLAIAKEGELSIGTIDDIQKLHIRTIPLGEHARRICHQEQSRTFAICSLKNNQNSTEETETHFVRLLDDQSFDFISTYALDTYEYGCSIISCSFSDDNNVYYCVGTAYVLPEENEPTKGRILVFLVEDGKLQLIAEKETKGAVYSLNAFNGKLLAAINQKIQLYKWVHREDASRELQSECGHHGHILALYVQTRGDFIVVGDLMKSISLLIYKHEEGAIEERARDYSANWMTALEILDDDIYLGAENNFNLFTVRRNSDAATDEERGRLEVVGEYHLGEFVNRFRHGSLVMRLPDSEAGRIPTVIFGTVNGVIGVVASLPHDQYLFLERLQSNLVKVIKGVGGLSHEQWRSFNNEKKTADARNFLDGDLIESFLDLSRSRMEEVSKAMGVPVEELCRRVEEMTRLH

SEQ ID NO: 18087 - protein, 1089 aa, Musa acuminata
MSVWNYVVTAHKPTNVTHSCVGNFTSPQELNLIIAKCTRIEIHLLTPHGLQPMLDVPIYGRIATLELFRPHGEPQDFLFIATERYKFCVLQWDAETSELITRAMGDVSDRIGRPTDNGQIGLIDPDCRLIGLHLYDGLFKVIPFDNKGQLKEAFNIRLEELQVLDIKFLYGCLKPTIVVLYQDNKDARHAKTYEIALKDKDFVEGPLSHTNLDNGAGILIPVPMPLGGVIIIGEETIVYCSVTAFKAIPIRPSITRAYGRVDADGSRYLLGDNAGLLHLLVITHERERVTGLKIEHLGETSVASTISYLDNAVVYIGSSYGDSQLIKLNLQPDAKGSYVEVLEKYVNLGPIVDFCVVDLERQGQGQVVTCSGAYKDGSLRIVRNGIGINEQASVELQGIKGLWSLRSSTNDPYDTFLVVSFINETRVLAMNMDDELEESEIEGFCAEAQTLFCQNAIHDQLVQVTANSVRLVSSTTRELLHEWNAPSGYSVNVATANASQVLLATGGGHLVYLEIGNGKLAEVKHVQLDYEISCLDINPSGENPNYSTLAAVGMWTDISVRIFSLPSLELLAKENLGGEIIPRSVLLCTFEGVSYLLCTLGDGHLLNFLLNLSTGELSNRKKVSLGTQPIMLRTFSSKDTTHVFAASDRPTVIYSSNKKLLYSNVNLKEVSHMCPFNSAAFPDSLAIAKEGELSIGTIDDIQKLHIRTIPLGEHARRICHQEQSRTFAICSLKNCQTSNEETEMHFVRLLDDQTFEFISTYPLDTYEYGCSIISCSFSDDNNAYYCVGTAYVLPEENEPSKGRILVFVVEDGKLQLIAEKETKGAVYSLNAFNGKLLAAINQKIQLYKWMLREDGSRELQAECGHHGHILALYVQTRGDFIVVGDLMKSISLLLYKHEEGAIEELARDYNANWMSAVEILDDDVFLGAENNYNLFTVRKNSDAATDEERGRLEVVGEYHLGEFVNRFRHGSLVMRLPDSEAGHIPTVIFGTINGVIGVVASLPHDQYVFLEKLQANLVKVIKGVGGLSHEQWRSFNNEKKTVDARNFLDGDLIESFLDLSRSRMDEIASSMGVPLEELCKRVEELTRLH

SEQ ID NO: 18088 - protein, 1088 aa, Citrus clementina
MSIWNYVVTAHKPTNVTHSCVGNFTSPQELNLIIAKCTRIEIHLLTPQGLQPMLDVPIYGRIATLELFRPHGEAQDFLFIATERYKFCVLQWDAESSELITRAMGDVSDRIGRPTDNGQIGIIDPDCRLIGLHLYDGLFKVIPFDNKGQLKEAFNIRLEELQVLDIKFLYGCAKPTIVVLYQDNKDARHVKTYEVALKDKDFVEGPWSQNNLDNGADLLIPVPPPLCGVLIIGEETIVYCSANAFKAIPIRPSITKAYGRVDADGSRYLLGDHAGLLHLLVITHEKEKVTGLKIELLGETSIASTISYLDNAVVYIGSSYGDSQLIKLNLQPDAKGSYVEVLERYVNLGPIVDFCVVDLERQGQGQVVTCSGAYKDGSLRIVRNGIGINEQASVELQGIKGMWSLRSSTDDPFDTFLVVSFISETRILAMNLEDELEETEIEGFCSQTQTLFCHDAIYNQLVQVTSGSVRLVSSTSRELRNEWKSPPGYSVNVATANASQVLLATGGGHLVYLEIGDGILTEVKHAQLEYEISCLDINPIGENPSYSQIAAVGMWTDISVRIFSLPDLNLITKEHLGGEIIPRSVLLCAFEGISYLLCALGDGHLLNFLLNMKTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHPRRICHQEQSRTFAICSLKNQSCAEESEMHFVRLLDDQTFEFISTYPLDTFEYGCSILSCSFSDDSNVYYCVGTAYVLPEENEPTKGRILVFIVEDGKLQLIAEKETKGAVYSLNAFNGKLLAAINQKIQLYKWMLRDDGTRELQSECGHHGHILALYVQTRGDFIVVGDLMKSISLLIYKHEEGAIEERARDYNANWMSAVEILDDDIYLGAENNFNLFTVRKNSEGATDEERGRLEVVGEYHLGEFVNRFRHGSLVMRLPDSDVGQIPTVIFGTVNGVIGVIASLPHEQYLFLEKLQTNLRKVIKGVGGLNHEQWRSFNNEKKTVDAKNFLDGDLIESFLDLSRSRMDEISKTMNVSVEELCKRVEELTRLH

SEQ ID NO: 18089 - protein, 1088 aa, Citrus sinensis
MSIWNYVVTAHKPTNVTHSCVGNFTSPQELNLIIAKCTRIEIHLLTPQGLQPMLDVPIYGRIATLELFRPHGEAQDFLFIATERYKFCVLQWDAESSELITRAMGDVSDRIGRPTDNGQIGIIDPDCRLIGLHLYDGLFKVIPFDNKGQLKEAFNIRLEELQVLDIKFLYGCAKPTIVVLYQDNKDARHVKTYEVALKDKDFVEGPWSQNNLDNGADLLIPVPPPLCGVLIIGEETIVYCSANAFKAIPIRPSITKAYGRVDADGSRYLLGDHAGLLHLLVITHEKEKVTGLKIELLGETSIASTISYLDNAVVYIGSSYGDSQLIKLNLQPDAKGSYVEVLERYVNLGPIVDFCVVDLERQGQGQVVTCSGAYKDGSLRIVRNGIGINEQASVELQGIKGMWSLRSSTDDPFDTFLVVSFISETRILAMNLEDELEETEIEGFCSQTQTLFCHDAIYNQLVQVTSGSVRLVSSTSRELRNEWKSPPGYSVNVATANASQVLLATGGGHLVYLEIGDGILTEVKHAQLEYEISCLDINPIGENPSYSQIAAVGMWTDISVRIFSLPDLNLITKEHLGGEIIPRSVLLCAFEGISYLLCALGDGHLLNFLLNMKTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHPRRICHQEQSRTFAICSLKNQSCAEESEMHFVRLLDDQTFEFISTYPLDTFEYGCSILSCSFSDDSNVYYCVGTAYVLPEENEPTKGRILVFIVEDGKLQLIAEKETKGAVYSLNAFNGKLLAAINQKIQLYKWMLRDDGTRELQSECGHHGHILALYVQTRGDFIVVGDLMKSISLLIYKHEEGAIEERARDYNANWMSAVEILDDDIYLGAENNFNLFTVRKNSEGATDEERGRLEVVGEYHLGEFVNRFRHGSLVMRLPDSDVGQIPTVIFGTVNGVIGVIASLPHEQYLFLEKLQTNLRKVIKGVGGLNHEQWRSFNNEKKTVDAKNFLDGDLIESFLDLSRTRMDEISKTMNVSVEELCKRVEELTRLH

SEQ ID NO: 18090 - protein, 1089 aa, Quercus alba
MSIWNYVVTAHKPTNVNHSCVGNFTSPQELNLIIAKCTRIEIHLLTPQGLQPMLDVPIYGRIATLELFRPHGEAQDFLFIATERYKFCVLQWDAETSELITRAMGDVSDRIGRPTDNGQIGIIDPDCRLIGLHLYDGLFKVIPFDNKGQLKEAFNIRLEELQVLDIKFLYGCSKPTIVVLYQDNKDARHVKTYEVALKDKDFVEGPWSQNNLDNGANLLIPVPPPLCGVIIIGEETIVYCSANAFKAIPIRPSITRAYGRVDADGSRYLLGDHTGLLHLLVITHEKEKVTGLKIELLGETSIASTISYLDNAFVYIGSSYGDSQLVKLNLHPDAKGSYVEVLERYVNLGPIVDFCVVDLERQGQGQVVTCSGAYKDGSLRIVRNGIGINEQASVELQGIKGMWSLRSSTDDPFDTFLVVSFISETRILAMNIEDELEETEIEGFCSQVQTLFCHDAVFNQLVQVTSSSVRLVSSTSRELRNEWNARPGYSINVATANATQVLLATGGGHLVYLEIGDGVLTEVKHAQLEYEISCLDINPIGENPNYSQLAAVGMWTDISVRIFSLPDLNLITKEPLGGEIIPRSVLLCVFEGISYLLCALGDGHLLNFLLNTSTGELADRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHARRICHQEQSRTFAICSLKSNQSSTEDSETHYIRLLDDQTFEFISTYQLDTFEYACSILSCSFSDDSNVYYCAGTAYVLPEENEPTKGRILVFIVEDGKLQLIAEKETKGSVYSLNAFNGKLLAGINQKIQLYKWMLRDDGTRELQSECGHHGHILALYVQTRGDFIVVGDLMKSISLLIYKHEEGAIEERARDYNANWMSAVEILDDDIYLGAENNFNLLTVRKNSEGATDEERGRLEVAGEYHLGEFVNRFRHGSLVMRLPDSDVGQIPTVIFGTVNGVIGVIASLPHEQYLFLEKLQSNLRKVIKGVGGLSHEQWRSFNNEKKVVDARNFLDGDLIESFLDLNRSKMDEVSKAMNVTVEELCKRVEELTRLH

SEQ ID NO: 18091 - protein, 1088 aa, Theobroma cacao
MSVWNYVVTAHKPTNVTHSCVGNFTSPQELNLIIAKCTRIEIHLLTPQGLQPMLDVPIYGRIATLELFRPHGEAQDFLFIATERYKFCVLQWDAETSELITRAMGDVSDRIGRPTDNGQIGIIDPDCRLIGLHLYDGLFKVIPFDNKGQLKEAFNIRLEELQVLDIKFLYGCSKPTIVVLYQDNKDARHVKTYEVALKEKDFVEGPWSQNNLDNGADLLIPVPPPLCGVLIIGEETIVYCSANAFKAIPIRPSITKAYGRVDADGSRYLLGDHAGLLHLLVITHEKEKVTGLKIELLGETSIASTISYLDNAFVYIGSSYGDSQLIKLNLQPDAKGSYVEVLERYVNLGPIVDFCVVDLERQGQGQVVTCSGAYKDGSLRIVRNGIGINEQASVELQGIKGMWSLRSSTDDPFDTFLVVSFISETRILAMNLEDELEETEIEGFNSQVQTLFCHDAVYNQLVQVTSSSVRLVSSISRELRHEWNAPPGYSVNVATANATQVLLATGGGHLVYLEIGDGTLTQVKHVQLEYEISCLDINPIGENSNYSQLAAVGMWTDISVRIFSLPDLNLITKEQLGGEIIPRSVLLCSFEGISYLLCALGDGHLLNFQLNMSSGELTDRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHARRICHQEQSRTFAICSLKNQPSADESEMHFIRLLDDQTFEFISTYPLDTFEYGCSILSCSFSDDPNVYYCVGTAYVLPEENEPTKGRILVFIVEDGKLQLIAEKETKGAVYSLSAFNGKLLAAINQKIQLYKWMLREDGTRELQSECGHHGHILALYVQTRGDFIVVGDLMKSISLLIYKHEEGAIEERARDYNANWMSAVEILDDDIYLGAENNFNLFTVRKNSEGATDEERGRLEVVGEYHLGEFVNRFCHGSLVMRLPDSDVGQIPTVIFGTVNGVIGVIASLPHEQYAFLEKLQSNLRKVIKGVGGLSHEQWRSFNNEKKTVEAKNFLDGDLIESFLDLSRGKMEEISKAMSVSVEELSKRVEELTRLH

SEQ ID NO: 18092 - protein, 987 aa, Triticum aestivum
MGDVSDRIGRPTDNGQIGIIDPDCRLIGLHLYDGLFKVIPFDNKGQLKEAFNIRLEELQVLDIKFLYGCVRPTIVVLYQDNKDARHVKTYEVALKEKDFVEGPWSQNNLDNGAGLLIPVPAPLGGVIIIGEETIVYCNANSTFKAIPIKQSITRAYGRVDPDGSRYLLGDNAGILHLLVLTQERERVTGLKIEHLGETSVASSISYLDNGVVYVGSRFGDSQLVKLNLQPDATGSFVEILERYVNLGPIVDFCVVDLDRQGQGQVVTCSGAFKDGSIRVVRNGIGINEQASVELQGIKGLWSLKSSFSDLYDMYLVVSFISETRFLAMNMEDELEEIEIEGFDAQIQTLFCQNAINDMLIQVTANSVRLVSCTSRELVDQWNAPEGFSVNVASANASQVLLATGGGHLVYLEIRDAKLVEVKHAQLEHEISCVDLNPVGENPQYSSLAAIGMWTDISVSIFSLPDLELIRKENLGVEIVPRSVLMCTLEGISYLLCALGDGHLFSFLLNASTGELTDRKKVSLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSRTLAFCSFKYTQNSMEESEAHFIRLMDHQTFEFLSTHPLDQYECGCSMISCSFSDDNNFYYCVGTAYVLPEENEPTKGRILVFAVEDGRLQLIVEKETKGAVYSLNAFNGKLLAAINQKIQLYKWMTREDGSHELQSECGHHGHILALYTQTRGDFIVVGDLMKSISLLVYKHEESAIEELARDYNANWMTAVEMIDDDIYVGAENSYNLFTVRKNSDAATDEERGRLEVVGEYHLGEFVNRFRHGSLVMRLPDSEMGQIPTVIFGTINGVIGIIASLPHDHYVFLEKLQTTLVKFIKGVGSLSHEQWRSFHNDKKTSEARNFLDGDLIESFLDLNRSKMEEVAKAMAVPVEELSKRVEELMRLH

SEQ ID NO: 18093 - protein, 1089 aa, Phaseolus vulgaris
MSIWNYVVTAHKPTNVTHSCVGNFTSPQDLNLIIAKCTRIEIHLLSPQGLQPMLDVPIYGRIATLELFRPHGETQDYLFIATERYKFCVLQWDSETSELVTRAMGDVSDRIGRPTDNGQIGIIDPDCRLIGLHLYDGLFKVIPFDNKGQLKEAFNIRLEELQVLDIKFLYGCSKPTIVVLYQDNKDARHVKTYEVALKDKDFVEGPWSQNNLDNGADLLIPVPPPLCGVLIIGEETIVYCSANAFKAIPFGPSITKAYGRVDPDGSRYLLGDHTGLLSLLVITHEKEKVTGLKTEPLGETSIASTISYLDNAFVYIGSSYGDSQLIKLNLQPDAKGSYVEVLERYVNLGPIVDFCVVDLERQGQGQVVTCSGAYKDGSLRVVRNGIGINEQASVELQGIKGMWSLRSSTDDPFDTFLVVSFISETRILAMNLEDELEETEIEGFCSQVQTLFCHDAVHNQLVQVTSNSVRLVSSTTRELRNEWFAPSGYSVNVATANATQVLLATGGGHLVYLEIGDGILQEVKHAQLEYEISCLDINPIGENPNHSQLAAVGMWTDISVRIFSLPDLNLVTKEQLGGEIIPRSVLLCAFEGISYLLCALGDGHLLNFMLNTSTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHARRICHQEHSRTFAICSLKYNPTSGEDSEMHFVRLLDDQTFEFISTYSLDTYEYGCFIISCSFSDDNNVYYCVGTAYVLPEENEPTKGRILVFTVEDGKLQLIAEKETKGAVYCLNAFNGKLLAAINQKIQLYKWVLRDDGTHELQSECGHHGHILALYVQTRGDFIVVGDLMKSISLLIYKHEEGAIEERARDYNANWMSAVEILDDDIYLGAENNFNLFTVRKNSEGATDEERGRLEVVGEYHLGEFINRFRHGSLVMRLPDSDVGQIPTVIFGTINGVIGVIASLPHEQYVFLEKLQSNLRKVIKGVGGLSHEQWRSFNNEKKTVEARNFLDGDLIESFLDLNRSKMDEISKAMDVSVEELCKRVEELTRLH

SEQ ID NO: 18094 - protein, 1089 aa, Lupinus angustifolius
MSIWNYVVTAHKPTNVTHSCVGNFTSPHDLNLILAKCTRIEIHLLSPHGLQAMLDVPIYGRIATLELFRPYGEAQDYLFIATERYKFCVLQWDPDTSELITRAMGDVSDRIGRPTDNGQIGIIDPDCRLIGLHLYDGLFKVIPFDNKGQLKEAFNIRLEELQVLDIKFLYGCSKPTIVVLYQDNKDARHVKTYEVALKDKDFVEGPWSQNNLDNGADLLIPVPPPLCGVLIIGEETIVYCSANAFKAIPIRPSITKAYGRVDPDGSRYLLGDHTGLLSLLVITHEKEKVTGLKIEALGETSIASTISYLDNAFVYIGSSYGDSQLIKLNLQPDAKGSYVEVLERYVNLGPIVDFCVVDLERQGQGQVVTCSGAYKDGSLRIVRNGIGINEQASVELQGIKGMWSLRSSTDDPFDTFLVVSFISETRILAMNLEDELEETEIEGFCSQVQTLFCHDAIHNQLVQVTSNSVRLVSSTTRELRNEWHAPTGFSVNVATANASQVLLATGGGHLVYLEIGDGTLQEVKHAQLEYEISCLDINPIGENPNQSNLAAVGMWTDISVQIFSLPDLNLITKEHLGGEIIPRSVLLCAFEGISYLLCALGDGHLLNFMLNTSTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEQARRICHQEQSRTFAICSLKYNPTSAEESEMHFVRLLDDQTFEFISTYPLDTYEFGCFIISCSFSDDNNVYYCVGTAYVLPEENEPTKGRILVFSVEDGKLQLIAEKETKGAVYCLNAFNGKLLAAINQKIQLYKWVLRDDGTHELQSECGHHGHILALYVQTRGDFIVVGDLMKSISLLIYKHEEGAIEERARDYNANWMSAVEILDDDIYLGAENNFNLFTVRKNSEGATDEERGRLEVVGEYHLGEFVNRFRHGSLVMRLPDSDVGQIPTVIFGTINGVIGVIASLPNEQYVFLEKLQSNLRKVIKGVGGLNHEQWRSFNNEKKTVDARNFLDGDLIESFLDLNRSKMDDISKAMDVSVEELCKRVEELTRLH

SEQ ID NO: 18095 - protein, 1089 aa, Cajanus cajan
MSIWNYVVTAHKPTNVTHSCVGNFTSPQDLNLIIAKCTRIEIHLLSPQGLQPMLDVPIYGRIATLELFRPHGEAQDYLFIATERYKFCVLQWDSETGELVTRAMGDVSDRIGRPTDNGQIGIIDPDCRLIGLHLYDGLFKVIPFDNKGQLKEAFNIRLEELQVLDIKFLYGCSKPTIVVLYQDNKDARHVKTYEVALKDKDFVEGPWSQNNLDNGADLLIPVPPPLCGVLIIGEETIVYCSANAFKAIPIRPSITKAYGRVDPDGSRYLLGDHTGMISLLVITHEKEKVTGLKIEPLGETSIASTISYLDNAFVYIGSSYGDSQLIKLNLQPDAKGSYVEVLERYVNLGPIVDFCVVDLERQGQGQVVTCSGAYKDGSLRVVRNGIGINEQASVELQGIKGMWSLRSSTDDPFDTFLVVSFISETRILAMNLEDELEETEIEGFCSQVQTLFCHDAVHNQLVQVTSSSVRLVSSTTRELRNEWHAPSGYSVNVATANATQVLLATGGGHLVYLEIGDGILQEVKHAQLEYEISCLDINPIGENPNHSHLAAVGMWTDISVRVFSLPDLNLITKEQLGGEIIPRSVLLCAFEGISYLLCALGDGHLLNFMLNTSTGELTDRKKVSLGTQPITLRTFSSKNATHVFAASDRPTVIYSSNKKLLYSNVNLKEVSHMCPFNSAAFPDSLAIAKEGELTIGTIDDIQKLHIRSIPLGEHARRICHQEQSRTFAICSLKYNPTSGEDSEMHFVRLLDDQTFEFISTYSLDTYEYGCFIISCSFSDDNNVYYCVGTAYVLPEENEPTKGRILVFTVEDGKLQLIAEKETKGAVYCLNAFNGKLLAAINQKIQLYKWVLRDDGTHELQSECGHHGHILALYVQTRGDFIVVGDLMKSISLLIYKHEEGAIEERARDYNANWMSAVEILDDDIYLGAENSFNLFTVRKNSEGATDEERGRLEVVGEYHLGEFINRFRHGSLVMRLPDSDVGQIPTVIFGTINGVIGVIASLPHDQYVFLEKLQSNLRKVIKGVGGLSHEQWRSFNNEKKTVEARNFLDGDLIESFLDLNRSKMDEISKAMDVSVEELCKRVEELTRLH

SEQ ID NO: 18096 - protein, 1089 aa, Glycine max
MSIWNYVVTAHKPTNVTHSCVGNFTSPQDLNLIIAKCTRIEIHLLSPQGLQPMLDVPIYGRIATLELFRPHGEAQDYLFIATERYKFCVLQWDSETAELVTRAMGDVSDRIGRPTDNGQIGIIDPDCRLIGLHLYDGLFKVIPFDNKGQLKEAFNIRLEELQVLDIKFLYGCSKPTIVVLYQDNKDARHVKTYEVALKDKDFLEGPWSQNNLDNGADLLIPVPPPLCGVLIIGEETIVYCSANAFKAIPIRPSITKAYGRVDPDGSRYLLGDHTGLLSLLVITHEKEKVTGLKIEPLGETSIASTISYLDNAFVYIGSSYGDSQLIKLNLQPDAKGSYVEGLERYVNLGPIVDFCVVDLERQGQGQVVTCSGAYKDGSLRVVRNGIGINEQASVELQGIKGMWSLRSSTDDPFDTFLVVSFISETRILAMNLEDELEETEIEGFCSQVQTLFCHDAVHNQLVQVTSSSVRLVSSTTRELRNEWHAPSGYSVNVATANATQVLLATGGGHLVYLEIGDGILQEVKHAQLEYEISCLDINPIGENPNHSHLAAVGMWTDISVRIFSLPDLSLITKEQLGGEIIPRSVLLCAFEGISYLLCALGDGHLLNFMLNTSTGELADRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHARRICHQEQSRTFAICSLKYNPASGEDSEMHFVRLLDDQTFEFISTYSLDTYEYGCFIISCSFSDDNNVYYCVGTAYVLPEENEPTKGRILVFAVEDGKLQLIAEKETKGAVYCLNAFNGKLLAAINQKIQLYKWVLRDDGTHELQSECGHHGHILALYVQTRGDFIVVGDLMKSISLLIYKHEEGAIEERARDYNANWMSAVEIVDDDIYLGAENSFNLFTVRKNSEGATDEERGRLEVVGEYHLGEFVNRFRHGSLVMRLPDSDVGQIPTVIFGTINGVIGVIASLPHEQYVFLEKLQSNLRKVIKGVGGLSHEQWRSFNNEKKTVEARNFLDGDLIESFLDLNRSKMDEISKALDVSVEELCKRVEELTRLH

SEQ ID NO: 18097 - protein, 1089 aa, Chenopodium quinoa
MSIWNYVVTAHKPTNVTHSCVGNFTSPQDLNLIIAKCTRIEIHLLTPQGLQPMLDVPIYGRIATLELFRPHGEAQDFLFIATERYKFCVLQWDPETSELVTRAMGDVSDRIGRPTDNGQIGIIDPDCRLIGLHLYDGLFKVIPFDNKGQLKEAFNIRLEELQVLDIKFLYGCSRPTIVVLYQDNKDARHVKTYEISLKDKDFVEGPWSQNNLDNGADLLIPVPPPLCGVIIVGEETIVYCSATAFKAIPIRPSITRAYGRVDADGSRYLLGDHAGLLHLLVITHEKEKVTGLKIELLGDTSIASTISYLDNAFVFIGSSYGDSQLIKLNLQPDAKGSYVEVLERYVNLGPIVDFCVVDLERQGQGQVVTCSGAYKDGSLRIVRNGIGINEQASVELQGIKGMWSLRSSTDDVYDTFLVVSFISETRILAMNLEDELEETEIEGFDSQVQTLFCHDALHNQLVQVTSSSVRLVSSTSRELRNEWKAPTGYSVNVATANASQVLLATGGGHLVYLEIGDGVLTEVKHAQLEYEISCLDINTIGQDPNYSQLAAVGMWTDISVRIFSLPDLNLITKENLGGEIIPRSVLLCSFEGISYLLCALGDGHLLNFMLNMSSGELTDRKKVSLGTQPITLRTFSSKNATHVFAASDRPTVIYSSNKKLLYSNVNLKEVSHMCPFNSAAFPDSLAIAKEGELTIGTIDEIQKLHIRSIPLGEHARRICHQEQTRTFAICSLKYNQASAEESEMHFVRLLDDQTFEIISTYALDTYECGCSILSCSFSDDINVYYCVGTAYVLPEENEPTKGRILVFVVEDGKLQLIAEKETKGAVYSLNAFNGKLLAAINQKIQLYKWMLRDDGTHELQSECGHHGHILALYVQTRGDFIVVGDLMKSISLLIYKHEEGAIEERARDYNANWMSAVEILDDDVYLGAENSFNLFTVRKNSEGATDEERARLEVVGEYHLGEFINRFRHGSLVMRLPDSDIGQIPTVIFGTVNGVIGVIASLPNDQYIFLEKLQSNMRKVIKGVGGLSHEHWRSFHNEKKTVDARNFLDGDLIESFLDLSRGRMEEISKTMGVSIEELSKRIEELTRLH

SEQ ID NO: 18098 - protein, 1089 aa, Spinacia oleracea
MSIWNYVVTAHKPTNVTHSCVGNFTSPQELNLIVAKCTRIEIHMLTPQGLQPMLDVPIYGRIATLELFRPHGETQDFLFIATERYKFCVLQWDPETSELVTRAMGDVSDRIGRPTDNGQIGIIDPDCRLIGLHLYDGLFKVIPFDNKGQLKEAFNIRLEELQVLDIKFLYGCSRPTIVVLYQDNKDARHVKTYEVSLKDKDFVEGPWSQNNLDNGADLLIPVPPPFCGVIIVGEETIVYCSATAFKAIPIRPSITRAYGRVDADGSRYLLGDHAGLLHLLVITHEKEKVTGLKIELLGETSIASTISYLDNAFVFIGSSYGDSQLIKLNLQPDVKGSYVEVLERYVNLGPIVDFCVVDLERQGQGQVVTCSGAYKDGSLRIVRNGIGINEQASVELQGIKGMWSLRSSTDDVYDTFLVVSFISETRILAMNLEDELEETEIEGFDSQVQTLFCHDALYNQLVQVTSSSVRLVSSTSRELRNEWKAPTGYSVNVATANASQVLLATGGGHLVYLEIGDGILTEVKHAQLEYEISCLDINPIGPNPNFSQLAAVGMWTDISVRIFSLPDLNLIIKENLGGEIIPRSVLLCSFEGISYLLCALGDGHLLNFILNMSTGELTDRKKVSLGTQPITLRTFSSKNATHVFAASDRPTVIYSSNKKLLYSNVNLKEVSHMCPFNSAAFPDSLAIAKEGELTIGTIDDIQKLHIRSIPLGEHARRICHQEQTRTFAICSLKYNQASAEESEMHFVRFLDDQTFEIISTYALDTYECGCSILSCSFSDDIKVYYCVGTTYVLPEENEPTKGRILVFVVEDGKLQLIAEKETKGAVYSLNAFNGKLLAAINQKIQLYKWMLRDDGTHELQSECGHHGHILALYVQTRGDFIVVGDLMKSISLLIYKHEEGAIEERARDYNANWMSAVEILDDDVYLGAENNFNLFTVRKNSEGATDEERARLEVVGEYHLGEFINRFRHGSLVMRLPDSDIGQIPTVIFGTVNGVIGVIASLPNDQYIFLEKLQSNMRKVIKGVGGLNHEHWRSFHNEKKTADARNFLDGDLIESFLDLSRGRMEEISKTMGTSIEELSKRVEELTRLH

SEQ ID NO: 18099 - protein, 1089 aa, Trifolium pratense
MSTWNYVVTAHKPTNVTHSCVGNFTSPQDLNLIIAKCTRIEIHLLTPQGLQSILDVPLYGRIATLELFRPHGETQDFLFIATERYKFCVLQWDTEKSELFTRSMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVALKEKDFVEGPWSQNSLDNGADLLIPVPPPLCGVLIIGEETIVYCSANGFKAIPIRPSITKAYGRVDPDGSRYLLGDHTGLLSLLVITHEKEKVTGLKLEPLGETSIASTISYLDNAFVYIGSSYGDSQLIKLNLQPDAKGSHVEVLERYVNLGPIVDFCVVDLERQGQGQVVTCSGAYKDGSLRVVRNGIGINEQASVELQGIKGMWSLRSSTDDPFDTFLVVSFISETRILAMNLEDELEETEIEGFCSQVQTLFCHDAVHNQLVQVTSNSVRLVSSTTRELLNEWNAPSDYSVNVATANATQVLLATGGGHLVYLEIGDGILQEVKHAQLEYEISCLDINPIGENPNQSHLAAVGMWTDISVRLFSLPDLNLITKEHLGGEIIPRSVLLCSFEGMSYLLCALGDGHLLNFMLNTSTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRTIPLGEHARRICHQEQTRTFAICSLKYNSASAEESENHFVRLLDDQTFDFISVYPLDTYEYGCFIISCSFSDDNNVYYCVGTAYVLPEENEPTKGRILVFSVEEGKLQLIAEKETKGAVYCLNAFNGKLLAAINQKIQLYKWVLREDGTREFQSECGHHGHILALYVQTRGDFIVVGDLMKSISLLIYKHEEGAIEERARDYSANWMSAVEILDDDIYLGAENSFNLFTVRKNSEGATDEERSRLEVAGEYHLGEFINRFRHGSLVMRLPDSDVGQIPTVIFGTINGVIGVIASLPHEQYVFLEKLQSSLRKVIKGVGGLSHEQWRSFNNEKKTVEARNFLDGDLIESFLDLNRNKMDEVSQAMDVSVEELAKRVEELTRLH

SEQ ID NO: 18100 - protein, 1089 aa, Trifolium pratense
MSTWNYVVTAHKPTNVTHSCVGNFTSPQDLNLIIAKCTRIEIHLLTPQGLQSILDVPLYGRIATLELFRPHGETQDFLFIATERYKFCVLQWDTEKSELFTRSMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVALKEKDFVEGPWSQNSLDNGADLLIPVPPPLCGVLIIGEETIVYCSANGFKAIPIRPSITKAYGRVDPDGSRYLLGDHTGLLSLLVITHEKEKVTGLKLEPLGETSIASTISYLDNAFVYIGSSYGDSQLIKLNLQPDAKGSYVEVLERYVNLGPIVDFCVVDLERQGQGQVVTCSGAYKDGSLRVVRNGIGINEQASVELQGIKGMWSLRSSTDDPFDTFLVVSFISETRILAMNLEDELEETEIEGFSSQVQTLFCHDAVHNQLVQVTSNSVRLVSSTTRELLNEWNAPSDYSVNVATANATQVLLATGGGHLVYLEIGDGIVQEVKHAQLEYEISCLDINPIGDNPNQSHLAAVGMWTDISVRLFSLPDLNLITKEHLGGEIIPRSVLLCAFEGMSYLLCALGDGHLLNFILNTSTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRTIPLGEHARRICHQEQTRTFAICSLKYNPASAEESENHFVRLLDDQTFDFISVYPLDTYEYGCFIISCSFSDDNNVYYCVGTAYVLPEENEPTKGRILVFSVEEGKLQLIAEKETKGAVYCLNAFNGKLLAAINQKIQLYKWVLREDGTRELQSECGHHGHILALYVQTRGDFIVVGDLMKSISLLIYKHEEGAIEERARDYNANWMSAVEILDDDIYLGAENSFNLFTVRKNSEGATDEERGRLEVAGEYHLGEFINRFRHGSLVMRLPDSDVGQIPTVIFGTINGVIGVIASLPHEQYVFLEKLQSSLRKVIKGVGGLSHEQWRSFNNEKKTVEARNFLDGDLIESFLDLNRNKMDEVSQAMEVSVEELAKRVEELTRLH

SEQ ID NO: 18101 - protein, 1089 aa, Glycine max
MTIWNYVVTAHKPTNVTHSCVGNFTSPQDLNLIIAKCTRIEIHLLSPQGLQPMLDVPIYGRIATLELFRPHGEAQDYLFIATERYKFCVLQWDSETGELVTRAMGDVSDRIGRPTDNGQIGIIDPDCRLIGLHLYDGLFKVIPFDNKGQLKEAFNIRLEELQVLDIKFLYGCSKPTIVVLYQDNKDARHVKTYEVALKDKDFVEGPWSQNNLDNGADLLIPVPPPLCGVLIIGEETIVYCSANAFKAIPIRPSITKAYGRVDPDGSRYLLGDHTGLVSLLVIIHEKEKVTGLKIEPLGETSIASTISYLDNAFVYVGSSYGDSQLIKLNLQPDAKGSYVEVLERYVNLGPIVDFCVVDLERQGQGQVVTCSGAYKDGSLRVVRNGIGINEQASVELQGIKGMWSLRSSTDDPFDTFLVVSFISETRILAMNLEDELEETEIEGFCSQVQTLFCHDAVHNQLVQVTSSSVRLVSSTTRDLRNEWHAPSGYSVNVATANATQVLLATGGGHLVYLEIGDGILQEVKHAQLEYEISCLDINPIGENPNHSNLAAVGMWTDISVRIFSLPDLSLITKEQLGGEIIPRSVLLCAFEGISYLLCALGDGHLLNFMLNTSTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHARRICHQEQSRTFAICSLKYNPASGEDSEMHFVRLLDDQTFEFISTYSLDTYEYGCFIISCSFSDDNNVYYCVGTAYVLPEENEPTKGRIIVFAVEDGKLQLIAEKETKGAVYCLNAFNGKLLAAINQKIQLYKWVLRDDGTHELQSECGHHGHILALYVQTRGDFIVVGDLMKSISLLIYKHEEGAIEERARDYNANWMSAVEIVDDDIYLGAENSFNLFTVRKNSEGATDEERGRLEVVGEYHLGEFVNRFRHGSLVMRLPDSDVGQIPTVIFGTINGVIGVIASLPHEQYVFLEKLQSNLRKVIKGVGGLSHEQWRSFNNEKKTVEARNFLDGDLIESFLDLNRSKMDEISKAVDVSVEELCKRVEELTRLH

SEQ ID NO: 18102 - protein, 1089 aa, Tabernaemontana elegans
MSIWNYVVTAHKPTNVTHSCVGNFTGPQELNLIIAKCTRIEIHLLTPQGLQPMLDVPIYGRIATLELFRPHGETQDLLFIATERYKFCVLQWDIEAGEVVTRAMGDVSDRIGRPTDNGQIGIIDPDCRLIGLHLYDGLFKVIPFDNKGQLKEAFNIRLEELQVLDIKFLYGCAKPTIVVLYQDNKDARHIKTYEVALKDKDFVEGPWSQNNLDNGADLLIPVPPPLCGVLIIGEETIVYCSATAFKAIPIRPSITRAYGRVDADGSRYLLGDHNGLLHLLVITHEKEKVTGLKIELLGETSIASTISYLDNAFVYVGSSYGDSQLIKLNLQPDAKGSYVEVLERYVNLGPIVDFCVVDLERQGQGQVVTCSGAYKDGSLRIVRNGIGINEQASVELQGIKGMWSLRSATDDPYDTFLVVSFISETRILAMNLEDELEETEIEGFCSQVQTLFCHDAVYNQLLQVTSNSVRLVSSASRELRNEWFAPAGYSVNVATANATQVLLATGGGHLVYLEIGDGVLTEVKHAQLEYDISCLDINPIGDNPNYSHLAAVGMWTDISVRIFSLPDLNLVTKEHLGGEIIPRSVLLCSFEGVSYLLCALGDGHLLNFVLNMNNGELTDRKKVSLGTQPITLRTFSSKNATHVFAASDRPTVIYSSNKKLLYSNVNLKEVSHMCPFNSAAFPDSLAIAKEGELTIGTIDDIQKLHIRSIPLGEHARRICHQEQTRTFAICSLKYNQSSADDSDTHFIRLLDDQTFEFISTYALDQYEYGCSILSCSFSDDGNVYYCVGTAYVMPEENEPTKGRILVFIVEDGKLQLIAEKETKGAVYSLNAFNGKLLAAINQKIQLYKWMLRDDGSRELQSECGHHGHILALYVQTRGDFIVVGDLMKSISLLIYKHEEGAIEERARDYNANWMSAVEILDDDIYLGAENNYNLFTVRKNSEGATDEERSRLEVSGEYHLGEFVNRFRHGSLVMRLPDSDVGQIPTVIFGTVNGVIGVIASLPHDQYLFLEKLQTNLRRVIKGVGGLSHEQWRSFYNEKKTVDAKNFLDGDLIESFLDLSRARMEDISKAMAVPVEELMKRVEELTRLH

SEQ ID NO: 18103 - protein, 1089 aa, Trigonella foenum-graecum
MSIWNYVVTAHKPTNVTHSCVGNFTSPQDLNLILAKCTRIEIHLLTAQGLQSILDVPLYGRIATLELFRPHGETQDFLFIATERYKFCVLQWDTEKSELVTRSMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVALKDKDFVEGPWSQNSLDNGADLLIPVPPPLCGVLIIGEETIVYCSANGFKAIPIRAAITKAYGRVDPDGSRYLLGDHTGLLSLLVITHEKEKVTGLKIEPLGETSIASTISYLDNAFVYIGSSYGDSQLIKLNLQPDAKGSYVEVLERYVNLGPIVDFCVVDLERQGQGQVVTCSGAYKDGSLRVVRNGIGINEQASVELQGIKGMWSLRSSTDDPFDTFLVVSFISETRILAMNLEDELEETEIEGFCSQVQTLFCHDAVHNQLVQVTSNSVRLVSSTTRVLLNEWHAPSDYSVNVATANATQVLLATGGGHLVYLEIGDGILQEVKHAQLEYEISCLDINPIGENPNQSHLAAVGMWTDISVRLFSLPDLNLITKEHLGGEIIPRSVLLCAFEGISYLLCALGDGHLLNFMLNTSTGELTDRKKVSLGTQPIALRTFSSKNTTHVFAASDRPTVIYSSNKKLLYSNVNLKEVSHMCPFNSAAFPDSLAIAKEGELTIGTIDDIQKLHIRTIPLGEHARRICHQEQTRTFAICSLKYNSASAEESEMHFVRLLDDQTFDFISVYPLDTYEYGCFIISCSFSDDNNVYYCVGTAYVLPEENEPTKGRILVFSVEEGKLQLVAEKETKGAVYCLNAFNGKLLAAINQKIQLYKWVLREDGTRELQSECGHHGHILALYVQTRGDFIVVGDLMKSISLLIYKHEEGAIEERARDYNANWMSAVEILDDDVYLGAENSFNLFTVRKNSEGATDEERGRLEVAGEYHLGEFINRFRHGSLVMRLPDSDVGQIPTVIFGTINGVIGVIASLPNEQYVFLEKLQSNLRKVIKGVGGLSHEQWRSFNNEKKTVEARNFLDGDLIESFLDLKRSKMDEISKAMDVSVEELAKRVEELTRLH

SEQ ID NO: 18104 - protein, 1088 aa, Gossypium raimondii
MSTWNYVVTAHKPTNVTHSCVGNFTSPQELNLIVAKCTRIEIHLLTAQGLQPMLDVPIYGRIATLELFRPHGEAQDFLFIATERYKFCVLQWDSETSELITRAMGDVSDRIGRPTDNGQIGIIDPDCRLIGLHLYDGLFKVIPFDNKGQLKEAFNIRLEELQVLDIKFLYGCSKPTIVVLYQDNKDARHVKTYEVALKEKDFVEGPWAQNNLDNGADLLIPVPPPLCGVLIVGEETIVYCSANAFKAIPIRPSITKAYGRVDADGSRYLLGDHAGLLHLLVITHEKEKVTGLKIELLGETSIASTISYLDNAVVFIGSSYGDSQLIKLNLQPDAKGSYVEVLERFVNLGPIVDFCVVDLERQGQGQVVTCSGAYKDGSLRVVRNGIGINEQASVELQGIKGMWSLRSSTDDPFDTFLVVSFISETRILAMNLEDELEETEIEGFNSQVQTLFCHDAVYNQLVQVTSSSVRLVSSTSRELRNEWHAPSGYSVNVATANATQVLLATGGGHLVYLEIGDGTLTEVKHAQLEYEISCLDINPIGENSNYSHLAAVGMWTDISVRIFSLPELNLITKEQLGGEIIPRSVLLCSFEGTSYLLCALGDGHLLNFQVNMSNGELTDRKKVSLGTQPITLRTFSSKNTTHVFASSDRPTVIYSSNKKLLYSNVNLKEVGHMCPFNSAAFPDSLAIAKEGELTIGTIDDIQKLHIRTIPLGEHARRICHQEQSRTFAICCLKNQSSADESEMHFIRLLDDQTLECISTYPLDTFEYGCSILSCSFSDDTNVYYCVGTAYVLPEENEPTKGRILVFIVEDGKLQLIAEKETKGAVYSLNAFNGKLLAAINQKIQLYKWMLREDGSREIQTECGHHGHILALYVKTRGDFIVVGDLMKSISLLIYKHEEGAIEERARDYNANWMSAVEILDDDTYLGAENNFNLFTVRKNSEGATDEERGRLEVIGEYHLGEFVNRFRHGSLVMRLPDSEVGQIQTVIFGTVNGAIGVIASLPHDQYVFLEKLQSNLRKVIKGVGGLSHEQWRSFNNEKRTAEAKNFLDGDLIESFLDLSRGKMEEVSKGMGVSVEELSKRVEELTRLH

SEQ ID NO: 18105 - protein, 1089 aa, Medicago truncatula
MSIWNYVVTAHKPTNVTHSCVGNFTSPQDLNLILAKCTRIEIHLLTAQGLQSILDVPLYGRIATLELFRPHGETQDFLFIATERYKFCVLQWDTEKSELVTRSMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVALKDKDFVEGPWSQNSLDNGADLLIPVPPPLCGVLIIGEETIVYCSANGFKAIPIRAAITKAYGRVDPDGSRYLLGDHTGLLSLLVITHEKEKVTGLKIEPLGETSIASTISYLDNAFVYIGSSYGDSQLIKLNLQPDPKGSYVEVLERYVNLGPIVDFCVVDLERQGQGQVVTCSGAYKDGSLRVVRNGIGINEQASVELQGIKGMWSLRSSTDDPFDTFLVVSFISETRILAMNLEDELEETEIEGFCSQVQTLFCHDAVHNQLVQVTSNSVRLVSSSTRELLNEWHAPSDYSVNVATANATQVLLATGGGHLVYLEIGDGILQEVKHAQLEYEISCLDINPIGENPNQSQLAAVGMWTDISVRLFSLPELNLITKEHLGGEIIPRSVLLCAFEGISYLLCALGDGHLLNFMLNTSTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRTIPLGEHARRICHQEQTRTFAICSLKYNSASAEESEMHFVRLLDDQTFDFISVYPLDTYEYGCFIISCSFSDDNNVYYCVGTAYVLPEENEPTKGRILVFSVEEGKLQLVAEKETKGAVYCLNAFNGKLLAAINQKIQLYKWVLREDGTRELQSECGHHGHILALYVQTRGDFIVVGDLMKSISLLIYKHEEGAIEERARDYNANWMSAVEILDDDVYLGAENSFNLFTVRKNSEGATDEERGRLEVAGEYHLGEFINRFRHGSLVMRLPDSDVGQIPTVIFGTINGVIGVIASLPHEQYVFLEKLQSNLRKVIKGVGGLSHEQWRSFNNEKKTVEARNFLDGDLIESFLDLKRSKMDEISKAMEVSVEELAKRVEELTRLH

SEQ ID NO: 18106 - protein, 1088 aa, Populus trichocarpa
MSVWNYVVTAHKPTNVTHSCVGNFTSSQELNLIIAKCTRIEINLLTPQGLQPMLDVPIYGRIATLELFRPHGEAQDFLFIATERYKFCVLQWDAETSELITRAMGDVSDRIGRPTDNGQIGIIDPDCRLIGLHLYDGLFKVIPFDNKGQLKEAFNIRLEELQVLDIKFLHGCSKPTIVVLYQDNKDARHVKTYEVALKDKDFIEGPWSQNNLDNGADLLIPVPPPFCGVLIIGEETIVYCSANVFRAIPIRPSITKAYGRVDADGSRYLLGDHAGLLHLLVITHEKEKVTGLKIELLGETSIASTISYLDNAFVFIGSSYGDSQLVKLNLQPDAKGTYVEVLDRYVNLGPIVDFCVVDLERQGQGQVVTCSGAYKDGSLRIVRNGIGINEQASVELQGIKGMWSLRSLTDDPFDTFLVVSFISETRILAMNIEDELEETEIEGFCSQVQTLFCHCAVFNQLVQVTSSSVRLVSSTTRELRQEWNAPSGYSINVATANATQVLLATGGGHLVYLEIGDGTLTQAKHAQLECEISCLDINPIGENPNYSQLAAVGMWTDISVRIFSLPDLNLITKEPLGGEIIPRSVLLCSFEGISYLLCALGDGHLLNFLLNLSTGELKDRKKVSLGTQPITLRTFSSKNTTHVFAASDRPTVIYSSNKKLLYSNVNLKEVSHMCPFNSAAFPDSLAIAKEGELSIGTIDDIQKLHIRSIPLGEHARRICHQEQSRTFSICSMKNQSNAEESEMHFIRLLDDQTFEFISTYPLDTFEYGCSILSCSFSDDSNVYYCVGTAYVLPEENEPTKGRILVFIVEDGKLQLIAEKETKGAVYSLNAFNGKLLAAINQKIQLYKWMLRDDGTRELQSECGHHGHILALYVQTRGDFIVVGDLMKSISLLIYKHEEGAIEERARDYNANWMSAVEILDDDIYLGAENNFNLFTVRKNSEGATDEERGRLEVVGEYHLGEFVNRFRHGSLVMRLPDSDVGQIPTVIFGTVNGVIGVIASLPHEQYLFLEKLQSNLRKVIKGVGGLSHEQWRSFNNEKKTVDAKNFLDGDLIESFLDLSRSRMDEISKAMEISVEELCKRVEELTRLH

SEQ ID NO: 18107 - protein, 1088 aa, Manihot esculenta
MSIWNYVVTAQKPTNVTHSCVGNFTSPQELNLIIAKCTRIEIHLLTPQGLQPMLDVPIYGRIATLELFRPHGEAQDFLFIATERYKFCVLQWDAETSELITRAMGDVSDRIGRPTDNGQIGIIDPDCRLIGLHLYDGLFKVIPFDNKGQLKEAFNIRLEELQVLDIKFLYGCSKPTIVVLYQDNKDARHVKTYEVALKDKDFVEGPWSQNNLDNGADLLIPVPPPLCGVLIIGEETIVYCSANAFKAIPIRPSITRAYGRVDADGSRYLLGDHAGLLHLLVITHEKEKVTGLKIELLGETSIASTISYLDNAVVYIGSSYGDSQLIKLNLQPDAKGSYVEVLESYVNLGPIVDFCVVDLERQGQGQVVTCSGAYKDGSLRIVRNGIGINEQASVELQGIKGMWSLRSSTDDPFDTFLVVSFISETRILAMNLEDELEETEIEGFSSQVQTLFCHYAVYNQLVQVTSSCVRLVSSTTREFRTEWNAPSGYSINVATANATQVLLATGGGHLVYLEIGNGVLTEVKHAQLEYEISCLDINPIGENPNYSQLAAVGMWTDISVRIFSLPDLNVITKEHLGGEIIPRSVLLCSFEGISYLLCALGDGHLLSFLLNLNTGELSDRKKVSLGTQPITLRTFSSKNTTHVFAASDRPTVIYSSNKKLLYSNVNLKEVSHMCPFNSAAFPDSLAIAKEGELTIGTIDDIQKLHIRTIPLGEHARRICHQEQSRTFAICSLKNQSSAEESETHFIRLLDDQSFEFISTYQLDPFEYGCSMLSCSFSDDINVYYCVGTAYVLPEENEPTKGRILVFMVEEGKLQLITEKETKGAVYSLNAFNGKLLAAINQKIQLYKWMLRDDGSRELQSECGHHGHILALYVQTRGDFIVVGDLMKSISLLIYKHEEGAMEERARDYNANWMSAVEILDDDIYLGAENNFNLFTVRKNSEGATDEERGRLEVVGEYHLGEFVNRFRHGSLVMRMPDSEVGQIPTIIFGTVNGVIGVIASLPHEQYMFLEKLQTNLRKVIKGVGGLSHEQWRSFNNEKKTVDAKNFLDGDLIESFLDLSRARMDEISKAMSVSVEELSKRVEELTRLH

SEQ ID NO: 18108 - protein, 1089 aa, Daucus carota
MSTYNYVVTAHKPTNVTHSCVGNFTSPQELNLIIAKCTRIEIHLLTAQGLQPMLDVPIYGRIATLELFRPHGETQDLLFIATERYKFCVLQWDPEAGEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVALKDKDFIEGPWSQNNLDNGADLLIPVPPPLCGVLIIGEETIVYCSASAFKAIPIRPAITRSYGRVDADGSRYLLGDHNGLLHLLVITHEKEKVTGLKIELLGETSIASTISYLDNAFVYVGSSYGDSQLIKLNLQPDAKGSYVEALERYVNLGPIVDFCVVDLERQGQGQVVTCSGAFKDGSLRIVRNGIGINEQASVELQGIKGMWSLRSATDDPFDTFLVVSFISETRILAMNIEDELEETEIEGFSSQVQTLFCHDAVYDQLVQVTSSSVRLVSSTSRELRNEWKAPPGYSVNVATANSTQVLLAAGGGHLVYLEIGDGILNEVKHAQLEYDVSCLDINPIGGNSSYSSLAAVGMWTDISVRIFSLPDLNLVTKEHLGGEIIPRSVLLCTFEGISYLLCALGDGHLLNFLLNLTTGQLTDRKKVSLGTQPITLRTFSSKSTTHVFAASDRPTVIYSSNKKLLYSNVNLKEVSHMCPFNSAAFPDSLAIAKEGELTIGTIDDIQKLHIRSIPLGEHARRICHQEHSRTFALCSVKYNQSSAEDTEMHIIRLLDDQTFEFISSYSLDQFEYGCSILSCSFSDDNNVYYCVGTAYVMPEENEPSKGRILVFLVEDGKLQLVAEKETKGAVYSLNAFNGKLLAAINQKIQLYKWMLRDDGTRELQSECGHHGHILALYVQTRGDFIVVGDLMKSISLLIYKHEEGAIEERARDYNANWMTAVEILDDDIYLGAENNFNLFTVRKNSEGATDEERSRLEVVGEYHLGEFVNRFRHGSLVMRMPDSDVGQIPTCIFGTVNGVIGVVASLPQDQYSFLDKLQSNLRKVIKGVGGLSHEQWRSYSSEKKTADAKNFLDGDLIESFLDLSRSKMEEVSKAMTVPVEELMKRVEELTRLH

SEQ ID NO: 18109 - protein, 1089 aa, Eucalyptus grandis
MSVWNYVVTAHKPTNVTHSCVGNFTGPQELNLIIAKCTRIEIHLLTPQGLQAMLDVPIYGRIATLELFRPHGEAQDFLFIATERYKFCVLQWDAETSELVTRAMGDVSDRIGRPTDNGQIGIIDPDCRLIGLHLYDGLFKVIPFDNKGQLKEAFNIRLEELQVLDIKFLYGCSKPTIVVLYQDNKDARHVKTYEVALKDKDFVEGPWSQNNVDNGADLLIPVPPPLCGVLIIGEETIVYCSANAFKAIPIRPSITKAYGRVDADGSRYLLGDHAGLLHLLVITHEKEKVTGLKIELLGETSIASTISYLDNAFVFIGSSYGDSQLIKLNLQPDSKGSYVEVLERYVNLGPIVDFSVVDLERQGQGQVVTCSGAYKDGSLRIVRNGIGINEQASVELQGIKGMWSLRSSIDDTYDTFLVVSFISETRILAMNLEDELEETEIEGFCSQVQTLFCHDAVHNQLVQVTSSSVRLVSSMTRELRNEWHSPQGYSINVATANATQVLLATGGGNLVYLEIGDGILKEIKHVQLEYEISCLDINPIGENLHYSQLAAVGMWTDISIRIFSLPDLNLITKENLGGEIIPRSVLLCAFEGISYLLCALGDGHLLNFQLNMHSGELTDRKKVSLGTQPITLRTFSSKNTTHVFAASDRPTVIYSSNKKLLYSNVNLKEVSHMCQFNSAAFPDSLAIAKEGELTIGTIDDIQKLHIRSIPLGEHARRICHQEQSRTFAICSMKYNQSSAEESEVHFVRLLDDQTFEFMSTYPLDPFEHGCSILSCSFSDDSSVYYCVGTAYVLPEENEPTKGRILVFIVEDGKLQLIAEKETKGAVYSLNAFNGKLLAAINQKIQLYKWMLRDDGSRELQSECGHHGHILALYVQTRGDFIVVGDLMKSISLLIYKHEEGAIEERARDYNANWMSAVEILDDDTYLGAENNFNLFTVRKNSEGATDEERGRLEVVGEYHLGEFVNRFRHGSLVMRLPDSDVGQIPTIIFGTVNGVIGVIASLPHDQYVFLEKLQSNLRKVIKGVGGLSHEQWRSFYNEKKTVDARNFLDGDLIESFLDLSRGRMDEISKAMVVSVEELCKRVEELTRLH

SEQ ID NO: 18110 - protein, 1088 aa, Arabidopsis lyrata
MSSWNYVVTAHKPTSVTHSCVGNFTSPQELNLIVAKCTRIEIHLLTPQGLQPMLDVPIYGRIATLELFRPHGEAQDFLFIATERYKFCVLQWDAESSELITRAMGDVSDRIGRPTDNGQIGIIDPDCRLIGLHLYDGLFKVIPFDNKGQLKEAFNIRLEELQVLDIKFLFGCAKPTIAVLYQDNKDARHVKTYEVSLKDKDFVEGPWSQNNLDNGADLLIPVPPPLCGVLIIGEETIVYCSANAFKAIPIRPSITKAYGRVDVDGSRYLLGDHAGLIHLLVITHEKEKVTGLKIELLGETSIASTISYLDNAVVFVGSSYGDSQLVKLNLHPDAKGSYVEVLERYINLGPIVDFCVVDLERQGQGQVVTCSGAFKDGSLRVVRNGIGINEQASVELQGIKGMWSLKSSIDEAFDTFLVVSFISETRILAMNLEDELEETEIEGFLSQVQTLFCHDAVYNQLVQVTSNSVRLVSSTTRELRDEWHAPAGFTVNVATANASQVLLATGGGHLVYLEIGDGKLTEVQHALLEYEVSCLDINPIGDNPNYSQLASVGMWTDISVRIFSLPELTLITKEQLGGEIIPRSVLLCAFEGISYLLCALGDGHLLNFQLDTTTGQLKDRKKVSLGTQPITLRTFSSKSATHVFAASDRPTVIYSSNKKLLYSNVNLKEVSHMCPFNSAAFPDSLAIAREGELTIGTIDDIQKLHIRTIPLGEHARRICHQEQTRTFGICSLGNQSNAEESEMHFVRLLDDQTFEFMSTYPLDSFEYGCSILSCSFTDDKNVYYCVGTAYVLPEENEPTKGRILVFIVEDGRLQLIAEKETKGAVYSLNAFNGKLLAAINQKIQLYKWMLRDDGTRELQSECGHHGHILALYVQTRGDFIVVGDLMKSISLLLYKHEEGAIEERARDYNANWMSAVEILDDDIYLGAENNFNLVTVKKNSEGATDEERGRLEVVGEYHLGEFVNRFRHGSLVMRLPDSEIGQIPTVIFGTVNGVIGVIASLPQEQYTFLEKLQSSLRKVIKGVGGLSHEQWRSFNNEKRTAEARNFLDGDLIESFLDLSRNKMEDISKSMNVQVEELCKRVEELTRLH

SEQ ID NO: 18111 - protein, 1091 aa, Citrullus lanatus
MSVWNYVVTAHKPTNVTHSCVGNFTGPQELNLIIAKCTRIEIHLLTAQGLQPMLDVPIYGRIATLELFRPHGEAQDFLFIATERYKFCVLQWDTESSELITRAMGDVSDRIGRPTDSGQIGIIDPDCRLIGLHLYDGLFKVIPFDNKGQLKEAFNIRLEELQVLDIKFLYGCSRPTIVVLYQDNKDARHVKTYEVVLKDKDFVEGPWSQNNLDNGAAVLIPVPPPLCGVIIIGEETIVYCSATAFKAIPIRPSITRAYGRVDADGSRYLLGDHAGLLHLLVITHEKERVTGLKIELLGETSIASTISYLDNAFVYIGSSYGDSQLVKLNVQPDAKGSYVEVLERYVNLGPIVDFCVVDLERQGQGQVVTCSGAYKDGSLRVVRNGIGINEQASVELQGIKGMWSLRSSTDDPFDMFLVVSFISETRILAMNLEDELEETEIEGFNSQVQTLFCHDALFNQLVQVTSSSVRLVSSTTRELLNEWNAPSNYSINVATANASQVLLATGGGVLVHLEICDGLLVEKKHIQLEHEISCLDINPIGDNPNCSQLAAVGMWTDISVRIFSLPDLNLLTKEQLGGEIIPRSVLLCTFEGISYLLCALGDGHLLNFILNTNSNSCELMDRKKVSLGTQPITLRTFSSKNATHVFAASDRPTVIYSSNKKLLYSNVNLKEVSHMCPFNSAAFPDSLAIAKEGELTIGTIDDIQKLHIRSIPLGEHARRICHQEQSRTFAICSLRYNQSGTEDTEMHFIRLLDDQTFESISTYALDTYEYGCSILSCSFSDDSNVYYCVGTAYVMPEENEPTKGRILVFVVEEGKLQLIAEKETKGSVYSLNAFNGKLLAAINQKIQLYKWTLRDDGTRELQSECGHHGHILALYVQTRGDFIVVGDLMKSISLLIYKHEEGAIEERARDYNANWMSAVEILDDDIYLGAENYFNLFTVRKNSEGATDEERSRLEVVGEYHLGEFVNRFRHGSLVMRLPDSDVGQIPTVIFGSVNGVIGVIASLPHEQYVFLEKLQSNLRKVIKGVGGLSHEQWRSFNNEKRTAEAKNFLDGDLIESFLDLNRSKMEEISRAMGVSAEELCKRVEELTRLH

SEQ ID NO: 18112 - protein, 1089 aa, Aquilegia formosa
MSSWNYVVTAHKPTSVSHSCVGNFTGPQELNLIIAKCTRIEIHLLTPQGLQPMLDVPIYGRIATLELFRPYGEAQDLLFIATDKYRICVLQWDAETSEIITKSNGDVADRIGRPTDNGQLGMIDPDCRLIGLHLYDGLFKVIPFDNKGQLKEAFNIRLEELQVLDIKFLYGCSKPTIVVLYQDNKDARHVKTYEVALKEKDFVEGPWSQNNLDNGAGLVIPVPRPLGGVIIIGEETIVYCSATAFKAIPIRPSITRAYGRVDADGSRYLLSDHTGLLHLLVITHERERVTGLKIELLGETSIASTISYLDNAFVFVGSNYGDSQLIKLNLQPDAKGSYVEVLERYVNLGPIVDFCVVDLERQGQGQVVTCSGAYKDGSLRIVRNGIGINEQASVELQGIKGMWSLRSSTDDPFDTFLVVSFISETRILAMNPDDELEETEIEGFDSQVQTLCCHDAIHNQLLQVTASSVRLVSSTSRELRNEWKAPSGFSVNVATANATQVLLATGGGHLVFLEVGDGILTEVKHAQLEYEVSCLDINPIGENSNASQLAAVGMWTDMSVRIFSLPGLDLITKEHLGGEIIPRSVLLCAFEGVSYLLCALGDGHLFNFLLNLSSGELSDRKKVSLGTQPITLRTFSSKNTTHVFAASDRPTVIYSSNKKLLYSNVNLKEVSHMCPFNSAAFPDSLAIAKEGELTIGTIDDIQKLHIRTIPLGEHARRICHQEQSRTFAICSLKYCQSNAEESEMHFVRLLDDQTFDFISTYPLDTYEYGCCILSCSFADDSNTYYCVGTAYVLPEESEPTKGRILVFIVEDGKLQLIAEKETKGSVYSLNAFNGKLLAAINQKIQLYKWMLRDDGSRELQSECGHHGHILAIYVQTRGDFIVVGDLMKSISLLIYKHEEGAIEERARDYNANWMSAVEILDDDVYLGAENSFNLFTVRKNSEGATDEERGRLEVVGEYHLGEFVNRFRHGSLVMRLPDSDVGQIPTVIFGTVNGVIGVIASLPHAQYLFLEKLQSLLVEVIKGVGGLGHDQWRAFNNEKKNSEAKNFLDGDLIESFLDLSRSRMDEISKAMLISTEELCKRVEELTRLH

SEQ ID NO: 18113 - protein, 1089 aa, Allium cepa
MSMWNYVVTAHKPTNVTHSCVGNFTSPHELNLIIAKCTRIEIHCLTPLGLQPKLDVPIYGRIATLELFRPHGEQQDFLFIATERYKFCVLQWDPEASELVTRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVALKDKDFVEGLWSQNNLDNGAGLLIPVPMPLGGVIIIGEETIVYCSATAFKAIPIKPSITRAYGRVDADGSRYLLSDNTGFLHLLVITHDKERVTGLKIEHLGETSVASTISYLDNAVVYVGSSYGDSQLIKLNMQPDANGSYVEVLERYINLGPIVDFCVVDLERQGQGQVVTCSGAYRDGSLRVVRNGIGINEQAAVELQGVKGLWSLRASTDDPYDTFLVVSFISETRILAMNMEDELEETEIEGFQAQTQTLFCHNAIYDQLIQVTSNSVRLVSSASREMLDQWSAPSGYSVNVATANASQVLLATGGGHLVYLEIEEGKLIEKKYIKLDYEMSCLDINPIGEDSTRSSFAAVGMWTDISVKIYSLPDLDLITTENLGGEIIPRSVLLCKFEGISYLLCALGDGHLFNFQLNMSTGELSDRKKVSLGTQPITLRTFSSKDTTHVFAASDRPTVIYSSNKKLLYSNVNLKEVSHMCPFNSAAFPDSLAIAKEGELSIGTIDDIQKLHIRSIALGEHARRICHQEQSRTFAICSYKNCPTNTEETETHFLRLLDDQTFEFKSTYQLDTYENGCSIISCSFSDDNNVYYCVGTAYVLPEENEPTKGRILVFAVEDGKLQLITEKETKGAVYSLNAFNGKLLVAINQKIQLYKWMLREDGSRELQSECGHHGHILALYVQTRGDFIVVGDLMKSISLLLYKHEEGAIEERARDYNANWMTAVEILSDDIYLGAENNFNLFTVRRNSEGATDEERGRLEVVGEFHLGEFINRFRHGSLVMRLPDSEISQIPTVIFGTVNGVIGVIASLPHDLYLFLERLQGCLNKVIKGVGGLLHDQWRSFYNEKRTCEARNFLDGDLIESFLDLSRGKMEEVASAMDVPVEELCRKVEELTRLH

SEQ ID NO: 18114 - protein, 1090 aa, Capsicum annuum
MSVWNYVVTAHKPTNVTHSCVGNFTAPHDLNLIIAKCTRIEIHLLTPQGLQPMLDVPIYGRIATLELFRPHGETQDLLFIATERYKFCVLQWDAEASEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFIEGPWAQNNLDNGASLLIPVPPPLCGVLIIGEETIVYCSASAFKAIPIRPSITRAYGRVDADGSRYLLGDHNGLLHLLVITHEKEKVTGLKIELLGETSIASTISYLDNAFVFIGSSYGDSQLVKLNLQPDAKGSYVEVLERYVNLGPIVDFCVVDLERQGQGQVVTCSGAYKDGSLRIVRNGIGINEQASVELQGIKGMWSLRSATDDPYDTFLVVSFISETRVLAMNLEDELEETEIEGFNSQVQTLFCHDAVYNQLVQVTSNSVRLVSSSSRELKNEWFAPAGYSVNVATANATQVLLATGGGHLVYLEIGDGVLNEVKYAKLDYDISCLDINPIGESPNYSNIAAVGMWTDISVRIYSLPDLNLITKEQLGGEIIPRSVLMCSFEGISYLLCALGDGHLLNFVLSMSTGELTDRKKVSLGTQPITLRTFSSKDATHVFAASDRPTVIYSSNKKLLYSNVNLKEVSHMCPFNVAAFPDSLAIAKEGELTIGTIDEIQKLHIRSIPLGEHARRISHQEQTRTFALCSVKYTQSTADDPEMHFIRLLDDQTFEFISTYPLDQFEYGCSILSCSFSDDGNVYYCIGTAYVMPEENEPTKGRILVFIVEDGKLQLIAEKETKGAVYSLNAFNGKLLAAINQKIQLYKWASREDGGSRELQTECGHHGHILALYVQTRGDFIVVGDLMKSISLLIFKHEEGAIEERARDYNANWMSAVEILDDDIYLGAENNFNLFTVRKNSEGATDEERSRLEVVGEYHLGEFVNRFRHGSLVMRLPDSDVGQIPTVIFGTVNGVIGVIASLPHDQYLFLEKLQSNLRKVIKGVGGLSHEQWRSFYNEKKTVDAKNFLDGDLIESFLDLSRNRMEEISKAMSVPVEELMKRVEELTRLH

SEQ ID NO: 18115 - protein, 1089 aa, Prunus persica
MSVWNYVVTAHKPTNVTNSCVGNFTGPQELNLIIAKCTRIEILLLTPLGLQPILDVPIYGRIATLQLFRPHGEAQDFLFIATERYKFCVLQWDAETSELITRAMGDVSDRIGRPTDNGQIGIIDPDCRLIGLHLYDGLFKVIPFDNKGQLKEAFNIRLEELQVLDIQFLYGCSKPTIVVLYQDNKDARHVKTYEVALKDKDFVEGPWAQNNLDNGADLLIPVPPPLCGVLIIGEETIVYCSANAFKAIPIRPSITRAYGRVDADGSRYLLGDHAGLLHLLVITHEKEKVTGLKIELLGETSIASTISYLDNAFVYIGSSYGDSQLVKLNLQPDAKGSYVEVLERYVNLGPIVDFCVVDLERQGQGQVVTCSGAYKDGSLRVVRNGIGINEQASVELQGIKGMWSLRSSTDDPHDTFLVVSFISETRILAMNLEDELEETEIEGFCSQVQTLFCHDAVFNQLVQVTSSSVRLVSSTSRELKNEWFAPAGYSINVATANATQVLLATGGKHLVYLEIGDGVLTQKTHAQLDFEISCLDINPIGENPNYSQLAAVGMWTDISVQIYSLPDLSRITKEHLGGEIIPRSVLLCAFEGISYLLCALGDGHLLNFILNTSTGELTDRKKVSLGTQPITLRTFSSKSTTHVFAASDRPTVIYSSNKKLLYSNVNLKEVSHMCPFNSAAFPDSLAIAKEGELTIGTIDDIQKLHIRSIPLGEHARRICHQEQSRTFAISSVKYNQSSAEDSETHFIRLLDDQSFDLITYYQLDAFEYGCSILSCSFSDDSNVYYCVGTAYVLPEENEPTKGRILVFTVEDGKLQLVAEKETKGAVYSLNAFNGKLLAAINQKIQIYKWTLRDDGTRELQSECGHHGHILALYVQTRGDFIVVGDLMKSISLLIYKHEESSIEERARDYNANWMSAVEILDDDVYLGAENFFNLFSVRKNSEGATDEERGRLEVVGEYHLGEFVNRFRHGSLVMRLPDSDVGQIPTVIFGTVNGVIGVIASLPQEQYVFLEKLQSNLRKVIKGVGGLSHEQWRSFNNEKKTVDAKNFLDGDLIESFLDLSRSKMDEISKQMRVSVEELCKRVEELTRLH

SEQ ID NO: 18116 - protein, 1090 aa, Solanum phureja
MSVWNYVVTAHKPTNVTHSCVGNFTGPQELNLIIAKCTRIEIHLLTPQGLQPMLDVPIYGRIATLELFRPHGETQDLLFIATERYKFCVLQWDTEASEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFIEGPWAQNNLDNGASLLIPVPPPLCGVLIIGEETIVYCSASAFKAIPIRPSITRAYGRVDADGSRYLLGDHNGLLHLLVITHEKEKVTGLKIELLGETSIASTISYLDNAFVFIGSSYGDSQLVKLNLQPDTKGSYVEVLERYVNLGPIVDFCVVDLERQGQGQVVTCSGAYKDGSLRIVRNGIGINEQASVELQGIKGMWSLRSATDDPYDTFLVVSFISETRVLAMNLEDELEETEIEGFNSQVQTLFCHDAVYNQLVQVTSNSVRLVSSTSRDLKNEWFAPAGYSVNVATANATQVLLATGGGHLVYLEIGDGVLNEVKYAKLDYDISCLDINPIGENPNYSPIAAVGMWTDISVRIYSLPDLNLITKEQLGGEIIPRSVLMCSFEGISYLLCALGDGHLLNFVLSMSTGELTDRKKVSLGTQPITLRTFSSKDTTHVFAASDRPTVIYSSNKKLLYSNVNLKEVSHMCPFNVAAFPDSLAIAKEGELTIGTIDEIQKLHIRSIPLGEHARRISHQEQTRTFALCSVKYTQSNADDPEMHFVRLLDDQTFEFISTYPLDQFEYGCSILSCSFSDDSNVYYCIGTAYVMPEENEPTKGRILVFIVEDGKLQLIAEKETKGAVYSLNAFNGKLLAAINQKIQLYKWASREDGGSRELQTECGHHGHILALYVQTRGDFIVVGDLMKSISLLIFKHEEGAIEERARDYNANWMSAVEILDDDIYLGAENNFNLFTVRKNSEGATDEERSRLEVVGEYHLGEFVNRFRHGSLVMRLPDSDVGQIPTVIFGTVNGVIGVIASLPHDQYLFLEKLQTNLRKVIKGVGGLSHEQWRSFYNEKKTVDAKNFLDGDLIESFLDLSRNRMEEISKAMSVPVEELMKRVEELTRLH

SEQ ID NO: 18117 - protein, 1088 aa, Eutrema halophilum
MSSWNYVVTAHKPTSVTHSCVGNFTSPQELNLIVAKCTRIEIHLLTPQGLQPMLDVPMYGRIATLELFRPHGEAQDFLFIATERYKFCVLQWDAESSELITRAMGDVSDRIGRPTDNGQIGIIDPDCRLIGLHLYDGLFKVIPFDNKGQLKEAFNIRLEELQVLDIKFLFGCAKPTIAVLYQDNKDARHVKTYEVSLKDKDFVEGPWSQNNLDNGADLLIPVPPPLCGVLIIGEETIVYCSANAFKAIPIRPSITKAYGRVDVDGSRYLLGDHAGLIHLLVITHEKEKVTGLKIELLGETSIASTISYLDNAVVFVGSSYGDSQLVKLNLHPDAKGSYVEVLERYVNLGPIVDFCVVDLERQGQGQVVTCSGAFKDGSLRIVRNGIGINEQASVELQGIKGMWSLKSSIDEAFDTFLVVSFISETRVLAMNLEDELEETEIEGFLSQVQTLFCHDAVYNQLVQVTSNSVRLVSSTTRELRDEWHAPAGFTVNVATANASQVLLATGGGHLVYLEIGDGKLTEVQHAVLEYEVSCLDINPIGDNPNYSQLASVGMWTDISVRIFSLPELTLITKEQLGGEIIPRSVLLCAFEGISYLLCALGDGHLLNFQLDTTTGQLKDRKKVSLGTQPITLRTFSSKNATHVFAASDRPTVIYSSNKKLLYSNVNLKEVSHMCPFNSAAFPDSLAIAREGELTIGTIDDIQKLHIRTIPLGEHARRICHQEQTRTFGICSLGNQTNAEESEMHFVRLLDDQSFEFVSTYPLDAFEYGCSILSCSFADDKNVYYCVGTAYVLPEENEPTKGRILVFIVEDGKLQLIAEKETKGSVYSLNAFNGKLLAAINQKIQLYKWMLRDDGTRELQSECGHHGHILALYVQTRGDFIVVGDLMKSISLLIYKHEEGAIEERARDYNANWMSAVEILDDDIYLGAENNFNLLTVKKNSEGATDEERGRLEVVGEYHLGEFVNRFRHGSLVMRLPDSEIGQIPTVIFGTVNGVIGVIASLPQEQYMFLEKLQSSLRKVIKGVGGLSHEQWRSFNNEKRTAEARNFLDGDLIESFLDLSRNKMEDISKSMNVQVEELCKRVEELTRLH

SEQ ID NO: 18118 - protein, 1088 aa, Arabidopsis thaliana
MSSWNYVVTAHKPTSVTHSCVGNFTSPQELNLIVAKCTRIEIHLLTPQGLQPMLDVPIYGRIATLELFRPHGEAQDFLFIATERYKFCVLQWDPESSELITRAMGDVSDRIGRPTDNGQIGIIDPDCRLIGLHLYDGLFKVIPFDNKGQLKEAFNIRLEELQVLDIKFLFGCAKPTIAVLYQDNKDARHVKTYEVSLKDKDFVEGPWSQNSLDNGADLLIPVPPPLCGVLIIGEETIVYCSASAFKAIPIRPSITKAYGRVDVDGSRYLLGDHAGMIHLLVITHEKEKVTGLKIELLGETSIASTISYLDNAVVFVGSSYGDSQLVKLNLHPDAKGSYVEVLERYINLGPIVDFCVVDLERQGQGQVVTCSGAFKDGSLRVVRNGIGINEQASVELQGIKGMWSLKSSIDEAFDTFLVVSFISETRILAMNLEDELEETEIEGFLSQVQTLFCHDAVYNQLVQVTSNSVRLVSSTTRELRDEWHAPAGFTVNVATANASQVLLATGGGHLVYLEIGDGKLTEVQHALLEYEVSCLDINPIGDNPNYSQLAAVGMWTDISVRIFSLPELTLITKEQLGGEIIPRSVLLCAFEGISYLLCALGDGHLLNFQMDTTTGQLKDRKKVSLGTQPITLRTFSSKSATHVFAASDRPTVIYSSNKKLLYSNVNLKEVSHMCPFNSAAFPDSLAIAREGELTIGTIDDIQKLHIRTIPLGEHARRICHQEQTRTFGICSLGNQSNSEESEMHFVRLLDDQTFEFMSTYPLDSFEYGCSILSCSFTEDKNVYYCVGTAYVLPEENEPTKGRILVFIVEDGRLQLIAEKETKGAVYSLNAFNGKLLAAINQKIQLYKWMLRDDGTRELQSECGHHGHILALYVQTRGDFIVVGDLMKSISLLLYKHEEGAIEERARDYNANWMSAVEILDDDIYLGAENNFNLLTVKKNSEGATDEERGRLEVVGEYHLGEFVNRFRHGSLVMRLPDSEIGQIPTVIFGTVNGVIGVIASLPQEQYTFLEKLQSSLRKVIKGVGGLSHEQWRSFNNEKRTAEARNFLDGDLIESFLDLSRNKMEDISKSMNVQVEELCKRVEELTRLH

SEQ ID NO: 18119 - protein, 1090 aa, Solanum lycopersicum
MSVWNYVVTAHKPTNVTHSCVGNFTGPQELNLIIAKCTRIEIHLLTPQGLQPMLDVPIYGRIATLELFRPHGETQDLLFIATERYKFCVLQWDTEASEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFIEGPWAQNNLDNGASLLIPVPPPLCGVLIIGEETIVYCSASAFKAIPIRPSITRAYGRVDADGSRYLLGDHNGLLHLLVITHEKEKVTGLKIELLGETSIASTISYLDNAFVFIGSSYGDSQLVKLNLQPDTKGSYVEVLERYVNLGPIVDFCVVDLERQGQGQVVTCSGAYKDGSLRIVRNGIGINEQASVELQGIKGMWSLRSATDDPYDTFLVVSFISETRVLAMNLEDELEETEIEGFNSQVQTLFCHDAVYNQLVQVTSNSVRLVSSTSRDLKNEWFAPVGYSVNVATANATQVLLATGGGHLVYLEIGDGVLNEVKYAKLDYDISCLDINPIGENPNYSNIAAVGMWTDISVRIYSLPDLNLITKEQLGGEIIPRSVLMCSFEGISYLLCALGDGHLLNFVLSMSTGELTDRKKVSLGTQPITLRTFSSKDTTHVFAASDRPTVIYSSNKKLLYSNVNLKEVSHMCPFNVAAFPDSLAIAKEGELTIGTIDEIQKLHIRSIPLGEHARRISHQEQTRTFALCSVKYTQSNADDPEMHFVRLLDDQTFEFISTYPLDQFEYGCSILSCSFSDDSNVYYCIGTAYVMPEENEPTKGRILVFIVEDGKLQLIAEKETKGAVYSLNAFNGKLLAAINQKIQLYKWASREDGGSRELQTECGHHGHILALYVQTRGDFIVVGDLMKSISLLIFKHEEGAIEERARDYNANWMSAVEILDDDIYLGAENNFNLFTVRKNSEGATDEERSRLEVVGEYHLGEFVNRFRHGSLVMRLPDSDVGQIPTVIFGTVNGVIGVIASLPHDQYLFLEKLQTNLRKVIKGVGGLSHEQWRSFYNEKKTVDAKNFLDGDLIESFLDLSRNRMEEISKAMSVPVEELMKRVEELTRLH

SEQ ID NO: 18120 - protein, 1089 aa, Prunus mume
MSVWNYVVTAHKPTNVTNSCVGNFTGPQELNLIIAKCTRIEILLLTPLGLQPILDVPIYGRIATLQLFRPHGEAQDFLFIATERYKFCVLQWDAETSELITRAMGDVSDRIGRPTDNGQIGLIDPDCRLIGLHLYDGLFKVIPFDNKGQLKEAFNIRLEELQVLDIQFLYGCSKPTIVVLYQDNKDARHVKTYEVALKDKDFVEGPWAQNNLDNGADLLIPVPPPLCGVLIIGEETIVYCSANAFKAIPIRPSITRAYGRVDADGSRYLLGDHAGLLHLLVITHEKEKVTGLKIELLGETSIASTISYLDNAFVYIGSSYGDSQLVKLNLQPDAKGSYVEVLERYVNLGPIVDFCVVDLERQGQGQVVTCSGAYKDGSLRVVRNGIGINEQASVELQGIKGMWSLRSSTDDPHDTFLVVSFISETRILAMNLEDELEETEIEGFCSQVQTLFCHDAVFNQLVQVTSSSVRLVSSTSRELKNEWFAPAGYSINVATANATQVLLATGGKHLVYLEIGDGVLTQKTHAQLDFEISCLDINPIGENPNYSQLAAVGMWTDISVQIYSLPDLSRITKEHLRGEIIPRSVLLCAFEGISYLLCALGDGHLLNFILNTSTGELTDRKKVSLGTQPITLRTFSSKSTTHVFAASDRPTVIYSSNKKLLYSNVNLKEVSHMCPFNSAAFPDSLAIAKEGELTIGTIDDIQKLHIRSIPLGEHARRICHQEQSRTFAISSVKYNQSSAEDSETHFIRLLDDQSFDLITYYQLDAFEYGCSILSCSFSDDSNVYYCVGTAYVLPEENEPTKGRILVFTVEDGKLQLVAEKETKGAVYSLNAFNGKLLAAINQKIQIYKWTLRDDGTRELQSECGHHGHILALYVQTRGDFIVVGDLMKSISLLIYKHEESSIEERARDYNANWMSAVEILDDDVYLGAENFFNLFSVRKNSEGATDEERGRLEVVGEYHLGEFVNRFRHGSLVMRLPDSDVGQIPTVIFGTVNGVIGVIASLPQEQYVFLEKLQSNLRKVIKGVGGLSHEQWRSFNNEKKTVDAKNFLDGDLIESFLDLSRSKMDEISKQMRVSVEELCKRVEELTRLH

SEQ ID NO: 18121 - protein, 1089 aa, Panax ginseng
MSAYNYVVTAHKPTNVTHSCVGNFTSPQELNLITAKCTRIEIHLLTAQGLQPMLDVPIYGRIATLELFRPHGETQDLLFIATERYKFSVLQWDPEAAEVITRAMGDVSDRIGRPTDNGQIGIIDPDCRLIGLHLYDGLFKVIPFDNKGQLKEAFNIRLEELQVLDIKFLFGCLKPTIVVLYQDNKDARHVKTYEVALKDKDFIEGPWSQNNLDNGADLLIPVPPPLCGVLIIGEETIVYCSASAFKAIPIRPAITRSYGRVDADGSRYLLGDHNGLLHLLVITHEKEKVTGLKIELLGETSIASTISYLDNAFVYVGSSYGDSQLIKLNLQPDAKGSYVEVLERYVNLGPIVDFCVVDLERQGQGQVVTCSGAYKDGSLRIVRNGIGINEQASVELQGIKGMWSLRSATDDPFDTFLVVSFISETRILAMNLEDELEETEIEGFFSQVQTLFCHDAVYDQIVQVTSSSVRLVSSTSRELRNEWKAPPGYSVNVATANSTQVLLAAGGGHLVYLEIGDGILNEIKHAQLEYDVSCLDINPIGENLIYSNLAAVGMWTDISVRIFSLPGLNLITKEHLGGEIIPRSVLLCAFEGISYLLCALGDGHLLNFLLNMNTGELTDRKKVSLGTQPITLRTFSSKNTTHVFAASDRPTVIYSSNKKLLYSNVNLKEVSDMCPFNSAAFPDSLAIAKEGELTIGTIDDIQKLHIRSIPLGEHARRICHQEHSRTFALCCVKYNQSSTEDSEMHIIRLLDDQTFEFISSYSLDQFEYGCSILSCSFTDDSNVYYCVGTAYVMPEENEPSKGRILVFVVEDGKLQLIAEKETKGAVYSLNAFNGKLLAAINQKIQLYKWMLRDDGTRELQSECGHHGHILALYVQTRGDFVVVGDLMKSISLLIYKHEEGAIEERARDYNANWMTAVEILDDDIYLGAENNFNLFTVRKNSEGATDEERGRLEVVGEYHLGEFVNRFRHGSLVMRMPDSDVGQIPTFIFGTVNGVIGVVASLPQDQYGFLEKLQANLRRVIKGVGGLSHEQWRSYYSEKKTVDAKNFLDGDLIESFLDLSRSKMEEISKAMTVPVEELMKRVEELTRLH

SEQ ID NO: 18122 - protein, 1090 aa, Nicotiana benthamiana
MSIWNYVVTAHKPTNATHSCVGNFTAPHELNLIIAKCTRIEIHLLTPQGLQPMLDVPIYGRIATLELFRPHGETQDFLFIATERYKFCVLQWDAEASEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFIEGPWAQNNLDNGASLLIPVPPPLCGVLIIGEETIVYCSASAFKAIPIRPSITRAYGRVDADGSRYLLGDHNGLLHLLVITHEKEKVTGLKIELLGETSIASTISYLDNAFVFIGSSYGDSQLVKLNLQPDTKGSYVEVLERYVNLGPIVDFCVVDLERQGQGQVVTCSGAYKDGSLRIVRNGIGINEQASVELQGIKGMWSLRSATDDPYDTFLVVSFISETRVLAMNLEDELEETEIEGFNSQVQTLFCHDAIYNQLVQVTSNSVRLVSSISRDLKNEWFAPAGYSVNVATANATQVLLATGGGHLVYLEIGDGVLNEVKYAKLDYDISCLDINPIGENPNFSQIAAVGMWTDISVRIYSLPDLNLITKEQLGGEIIPRSVLMCSFEGISYLLCALGDGHLLNYVLSMSSGELTDRKKVSLGTQPITLRTFSSKDATHVFAASDRPTVIYSSNKKLLYSNVNLKEVSHMCPFNVAAFPDSLAIAKEGELTIGTIDEIQKLHIRSIPLGEHARRISHQEQTRTFALCSVKYTQSNADDPEVHFVRLLDDQTFEFISTYPLDQFEYGCSILSCSFSDDSTVYYCVGTAYVMPEENEPTKGRILVFIVEDGKLQLIAEKETKGAVYSLNAFNGKLLAAINQKIQLYKWASREDGGSRELQTECGHHGHILALYVQTRGDFIVVGDLMKSISLLIFKHEEGAIEERARDYNANWMSAVEILDDDIYLGSENNFNLFTVRKNSEGATDEERSRLEVVGEYHLGEFVNRFRHGSLVMRLPDSDVGQIPTVIFGTVNGVIGVIASLPHDQYLFLEKLQTSLRKVIKGVGGLSHEQWRSFYNEKKTVEAKNFLDGDLIESFLDLSRSRMEEISKAMAVPVEELMKRVEELTRLH

SEQ ID NO: 18123 - protein, 1089 aa, Rosmarinus officinalis
MSIWNYVVTAHKPTNVTHSCVGNFTGPQELNLIIAKCTRIEIHLLSPQGLQPMLDVPIYGRIATLELFRPHGETQDLLFIATERYKFCVLQWDAETGEVITRAMGDVSDRIGRPTDNGQIGIVDPDCRLIGLHLYDGLFKVIPFDNKGQLKEAFNIRLEELQVLDIKFLYGCPKPTIVVLYQDNKDARHVKTYEVALKDKDFVEGPWSQNNLDNGADLLIPVPPPLCGVLIIGEETIVYCSASTFKAIPIRPSITRAYGRVDADGSRYLLGDHNGLLHLLVITHEKEKVTGLKIELLGETSIASSISYLDNAVVFVGSSYGDSQLIKLNLQPDAKGSYVEVLERYVNLGPIVDFCVVDLERQGQGQVVTCSGAYKDGSLRIVRNGIGINEQASVELQGIKGMWSLRSATDDPYDTFLVVSFINETRILAMNIEDELEETEIEGFCSNVQTLFCHDAAYDQLVQVTSSTVRLVSSTTRDLRNEWFAPEGYSINVATANVTQVLLATGSGHLIYLEIGDGFLREVKHTQLEYDISCLDINPIGDNKNCSQLAAVGMWTDISVRIFSLPDLNLITKEHLGGEIIPRSVLLCAFEGISYLLCALGDGHLLNFVLTTSNGELTDRKKVSLGTQPITLRTFSSKNATHVFAASDRPTVIYSSNKKLLYSNVNLKEVSYMCPFNTAAFPDSLAIAKEGELTIGTIDDIQKLHIRSIPLGEHARRICHQEQTRTFAICSLKYNQSAADDSEMHFVRLLDDQTFEFISTYPLDQFECGCSVLSCSFSDDPNVYYCVGTAYVMPEENEPTKGRVLVFAVEDGKLQLIAEKETKGAVYSLNAFNGKLLAAINQKIQLYKWMPRDDGTHELQSECGHHGHILALYVQTRGDFIVVGDLMKSISLLIYKHEEGAIEERARDYNANWMSAVEILDDDIYLGAENNFNLFTVRKNSEGATDEERGRLEVVGEFHLGEFVNRFRHGSLVMRLPDSDVGQIPTVIFGTVNGVIGVIASLPHEQYIFLEKLQMNLRKVIKGVGGLSHEQWRSFYNEKKTVDAKHFLDGDLIESFLDLTRNRMEEISKSMSVPVDELMKRVEELTRLH

SEQ ID NO: 18124 - protein, 1089 aa, Malus domestica
MSVWNYVVTAHKPTNVTHSCVGNFTAPQELNLITAKCTRIEIQLLTPLGLQPILDVPIYGRIATLELFRPHGETQDFLFIATERYKFCVLQWDAEASELITRAMGDVSDRIGRPTDNGQIGIIDPDCRLIGLHLYDGLFKVIPFDNKGQLKEAFNIRLEELQVLDIKFLYGCSKPTIVVLYQDNKDVRHVKTYEVSLKDKDFVEGPWAQNNVENGADLLIPVPPPLCGVLIIGEDNIVYRSPNTFKAIPIRHSITRAYGRVDADGSRYLLGDHAGQLHLLVITHEKEKVSGLKIELLGETSIASTISYLDNAFVYIGSSYGDSQLVKLNLQPDAKGSYVEVLERYVNLGPIVDFCVVDLERQGQGQVVTCSGAFKDGSLRVVRNGIGINEQASVELQGIKGMWSLRSSTDDPFDTFLVVSFISETRILAMNLEDELEETEIEGFCSQVQTLFCHDAVCNQLVQVTSSSVRLVSSTTRELKHEWNAPAGNSINVATANATQVLLATGGKHLVYLEIGDGVLTEKNHAQLDFEISCLDINPIGDNPNYSQLAAVGMWTDISVQIYSLPALSRITKEHLGGEIIPRSVLLCAFEGISYLLCALGDGHLLNFILNTSTGELTDRKKVSLGTQPITLRTFSSKSTTHVFAASDRPTVIYSSNKKLLYSNVNLKEVSHMCPFNSAAFPDSLAIAKEGELTIGTIDDIQKLHIRSIPLGEHARRICHQEQSRTFAILSVKYNQSSAEDSETHFIRLLDDQSFDLITYYQLDAFEYACSILSCSFSDDSNLYYCVGTAYVLPEENEPTKGRILVFIVEDGKLQLVAEKETKGSVYSLNAFNGKLLAAINQKIQLYKWTLRDDGTRELQSECGHHGHILALYVQTRGDFIIVGDLMKSISLLMYKHEEGAIEERARDYNANWMSAVEILDDDVYIGAENFVNLFTVRKNSEGATDEERGRLEVVGEYHLGEFVNRFRHGSLVMRLPDSDVGQIPTVIFGTVNGVIGVIASLPQEHYAFLEKLQSNLRKVIKGVGGLNHEQWRSFSNEKKTVDAKNFLDGDLIESFLDLNRSKMDEISKQMRVSVEELCKRVEELTRLH

SEQ ID NO: 18125 - protein, 1090 aa, Nicotiana benthamiana
MSIWNYVVTAHKPTNATHSCVGNFTAPHELNLIIAKCTRIEIHLLTPQGLQPMLDVPIYGRIATLELFRPHGETQDFLFIATERYKFCVLQWDAEASEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFIEGPWAQNNLDNGASLLIPVPPPLCGVLIIGEETIVYCSASAFKAIPIRPSITRAYGLVDADGSRYLLGDHNGLLHLLVITHEKEKVNGLKIELLGETSVASTISYLDNAFVFIGSSYGDSQLVKLNLQPDAKGSYVEVLERYVNLGPIVDFCVVDLERQGQGQVVTCSGAYKDGSLRIVRNGIGINEQASVELQGIKGMWSLRSATDDPYDTFLVVSFISETRVLAMNLEDELEETEIEGFNSQVQTLFCHDAIYNQLVQVTSNSVRLVSSISRDLKNEWFAPAGYSVNVATANATQVLLATGGGHLVYLEIGDGVLNEVKYAKLDYDISCLDINPIGENPNYSQIAAVGMWTDISVRIYSLPDLNLITKEQLGGEIIPRSVLMCSFEGISYLLCALGDGHLLNYVLSMSTGELTDRKKVSLGTQPITLRTFSAKDATHVFAASDRPTVIYSSNKKLLYSNVNLKEVSHMCPFNVAAFPDSLAIAKEGELTIGTIDEIQKLHIRSIPLGEHARRISHQEQTRTFALCSVKYTQSNADDPEVHFVRLLDDQTFEFISTYPLDQFEYGCSILSCSFSDDSNVYYCVGTAYVMPEENEPTKGRILVFIVEDGKLQLIAEKETKGAVYSLNAFNGKLLAAINQKIQLYKWASREDGGSRELQTECGHHGHILALYVQTRGDFIVVGDLMKSISLLIFKHEEGAIEERARDYNANWMSAVEILDDDIYLGSENNFNLFTVRKNSEGATDEERSRLEVVGEYHLGEFVNRFRHGSLVMRLPDSDVGQIPTVIFGTVNGVIGVIASLPHDQYLFLEKLQTSLRKVIKGVGGLSHEQWRSFYNEKKTVEAKNFLDGDLIESFLDLSRSRMEDISKAMAVPVEELMKRVEELTRLH

SEQ ID NO: 18126 - protein, 1089 aa, Allium cepa
MSMWNYVVTAHKPTNVTHSCVGNFTSPHELNLIIAKCTRIEIHCLTPLGLQPKLDVPIYGRIATLELFRPHGEQQDFLFIATERYKFCVLQWDPEASELVTRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVALKDKDFVEGLWSQNNLDNGAGLLIPVPMPLGGVIIIGEETIVYCSATAFKAIPIKPSITRAYGRVDADGSRYLLSDNTGFLHLLVITHDKERVTGLKIEHLGETSVASTISYLDNAVVYVGSSYGDSQLIKLNMQPDANGSYVEVLERYINLGPIVDFCVVDLERQGQGQVVTCSGAYRDGSLRVVRNGIGINEQAAVELQGVKGLWSLRASTDDPYDTFLVVSFINETRILAMNMEDELEETDIEGFQAETQTLFCHNAIYDQLIQVTSNSVRLVSSASREMLDQWSAPSGYSVNVATANASQVLLATGGGHLVYLEIEEGKLIEKKYIKLDYEMSCLDINPIGEDSTRSSFVAVGMWTDISVKIYSLPDLDLITTENLGGEIIPRSVLLCKFEGISYLLCALGDGHLFNFQLNMNTGELSDRKKVSLGTQPITLRTFSSKDTTHVFAASDRPTVIYSSNKKLLYSNVNLKEVSHMCPFNSAAFPDSLAIAKEGELSIGTIDDIQKLHIRSIALGEHARRICHQEQSRTFAICSYKNCPTNTEETETHFLRLLDDQTFEFKSTYQLDTYENGCSIISCSFSDDNNVYYCVGTAYVLPEENEPTKGRILVFAVEDGKLQLITEKETKGAVYSLNAFNGKLLVAINQKIQLYKWMLREDGSRELQSECGHHGHILALYVQTRGDFIVVGDLMKSISLLLYKHEEGAIEERARDYNANWMTAVEILSDDIYLGAENNFNLFTVRRNSEGATDEERGRLEVVGEFHLGEFINRFRHGSLVMRLPDSEISQIPTVIFGTVNGVIGVIASLPRDLYLFLERLQGCLNKVIKGVGGLLHDQWRSFYNEKRTCEARNFLDGDLIESFLDLSRGKMEEVASAMDVPVEELCRKVEELTRLH

SEQ ID NO: 18127 - protein, 1089 aa, Fragaria vesca
MSVWNYVVTAHKPTNVTHSCVGNFTGPQELNLIIAKCTRIEILLLTPLGLQPVLDVPIYGRIATLKLFRPHGEAQDFLFIATERYKFCVLQWDVETQELVTKAMGDVSDRIGRPTDSGQIGIIDPDCRLIGLHLYDGLFKVIPFDNKGQLKEAFNIRLEELQVLDIKFLYGCSKPTIVVLYQDNKDARHVKTYEVALKDKDFVEGPWSQNNLDNGAELLIPVPPPLCGVLIIGEETIVYCSANAFKAIPIRPSITRAYGRVDADGSRYLLGDHAGLLHLLVITHEKEKVTGLKMELLGETSIASTISYLDNAFVYIGSSYGDSQLVKLNLQPDAKGSYVEVLERYVNLGPIVDFCVVDLERQGQGQVVTCSGAYKDGSLRVVRNGIGINEQASVELQGIKGMWSLRSSTDDPHDFFLVVSFISETRILAMNMEDELEETEIEGFSSEVQTLFCHDAVFNQLVQVTSSSVRLVSSTSRDLKNEWHAPAGYSINVATANATQVLLATGGKHLVYLEIGDGVLTEKKYVHLDFEISCLDINPIGENPNYSQLAAVGMWTDISVQIYSLPDLNRITKEHLGGEIIPRSVLLCTFEGISYLLCALGDGHLLNFTLNTTTGELTDRKKVSLGTQPITLRTFSSKSTTHVFAASDRPTVIYSSNKKLLYSNVNLKEVSHMCPFNSAAFPDSLAIAKEGELTIGTIDDIQKLHIRTIPLGEHARRICHQEQSRTFAICSVKNNQTGAEDSETHFIRLLDDQSFDLVTYYQLDAFEYACSILSCSFSDDSNVYYCVGTAYVLPEENEPTKGRILVFLVEDGKMQLIAEKETKGSVYSLNAFNGKLLAAINQKIQLYKWTLRDDGTRELQSECGHHGHILALYVQTRGDFIVVGDLMKSISLLIYKHEEGAIEERARDYNANWMSAVEILDDDVYLGAENFYNLFTVRKNSEGATDEERGRLEVVGEYHLGEFVNRFRHGSLVMRLPDSDVGQIPTVIFGTVNGVIGVIASLPRDHYSFLEKLQTNLRKVIKGVGGLSHDQWRSFCNEKKTSDTKNFLDGDLIESFLDLSRGKMDEISKQMSVPVEELCKRVEELTRLH

SEQ ID NO: 18128 - protein, 1089 aa, Malus domestica
MSIWNYVVTAHKPTNVTHSCVGNFTAPQELNLITAKCTRIEIQLLTPLGLQPILDVPIYGRIATLELFRPHGETQDFLFIATERYKFCVLQWDADASELITRAMGDVSDRIGRPTDNGQIGIIDPDCRLIGLHLYDGLFKVIPFDNKGQLKEAFNIRLEELQVLDIKFLYGCSKPTIVVLYQDNKDVRHVKTYEVSLKDKDFVEGPWAQNNVENGADLLIPVPPPLCGVLIIGEDNIVYRSPNTFKAIPIRHSITKAYGKVDADGSRYLLGDHAGLLHLLVITHEKEKVTGLKIELLGETSIASTISYLDNAFVYIGSSYGDSQLVKLNLHPDAKGSYVEVLERYVNLGPIVDFCVVDLERQGQGQVVTCSGAFKDGSLRVVRNGIGINEQASVELQGIKGMWSLRSSTDDPYDTFLVVSFISETRILAMNIEDELEETEIEGFCSQVQTLFCHDAVCNQLVQVTSSSVRLVSSTTRELKHEWNAPAGYSINVATANATQVLLATGGKHLVYLEIGDGILTEKNHAQLDFEISCLDINPIGDNPNYSQLAAVGMWTDISVQIYSLPDLNRITKEHLGGEIIPRSVLLCAFEGISYLLCALGDGHLLNFILNTSTGELTDRKKVSLGTQPITLRTFSSKSTTHVFAASDRPTVIYSSNKKLLYSNVNLKEVSHMCPFNSAAFPDSLAIAKEGELTIGTIDDIQKLHIRSIPLGEHARRICHQEQSRTFAILSVKYNQSSAEDSETHFIRLLDDQSFDLITYYQLDAFEYACSILSCSFSDDINVYYCVGTAYVLPEENEPTKGRILVFIVEDGKLQLVAEKETKGSVYSLNAFNGKLLAAINQKIQLYKWTLRDDGTRELQSECGHHGHILALYVQTRGDFIIVGDLMKSISLLMYKHEEGAIEERARDYNANWMSAVEILDDDVYIGAENFFNLFTVRKNSEGATDEERGRLEVVGEYHLGEFVNRFRHGSLVMRLPDSDVGQIPTVIFGTVNGVIGVIASLPQEQYAFLEKLQSNLRRVIKGVGGLSHEQWRSFSNEKKTVDAKNFLDGDLIESFLDLNRSKMDEISKQMRVSVEELCKRVEEMTRLH

SEQ ID NO: 18129 - protein, 1088 aa, Brassica oleracea
MSSWNYVVTAHKPTSVTHSCVGNFTSPQELNLIVAKCTRIEIHLLTPQGLQPMLDVPIYGRIATLELFRPHGETQDFLFIVTERHKFCVLQWDAESSELVTRAMGDVSDRIGRPTDNGQIGIIDPDCRLIGLHLYDGLFKVIPFDNKGQLKEAFNIRLEELQVLDIKFLFGCAKPTIAVLYQDNKDARHVKTYEVSLKDKDFVEGPWSQNNLDNGADLLIPVPPPLCGVLIIGEETIVYCSANAFKAIPIRPSITKAYGRVDVDGSRYLLGDHAGLVHLLVITHEKEKVTGLKIELLGETSIASTISYLDNAVVFVGSSYGDSQLVKLNLHPDAKGSYVEVLERYTNLGPIVDFCVVDLERQGQGQVVTCSGAFKDGSLRIVRNGIGINEQASVELEGIKGMWSLKSSVDEAFDTFLVVSFISETRILAMNLEDELEETEIEGFLSQVQTLFCHDAVYNQLVQVTSNSVRLVSSTTRELRDEWHAPAGFTVNVATANASQVLLATGGGHLVYLEIGDGKLTEVQHTVLEYEVSCLDINPIGDNPNYSQLASVGMWTDISVRIFSLPELTLITKEQLGGEIIPRSVLLCSFEGISYLLCALGDGHLLNFQLDTTTGQLKDRKKVSLGTQPITLRTFSSKSATHVFAASDRPTVIYSSNKKLLYSNVNLKEVSYMCPFNSAAFPDSLAIAREGELTIGTIDDIQKLHIRTIPLGEHARRICHQEQTRTFGICSLGNQTNAEESEMHFVRLLDDQSFEFMSTYPLDAFEYACSILSCSFTDDKNVYYCVGTAYVLPEENEPTKGRILVFIVEDAKLQLIAEKETKGAVYSLNAFNGKLLAAINQKIQLYKWMLRDDGTRELQSECGHHGHILALYVQTRGDFIVVGDLMKSISLLIYKHEEGAIEERARDYNANWMSAVEILDDDTYLGAENNFNLLTVKKNSEGATDEERGRLEVVGEYHLGEFVNRFCHGSLVMRLPDSEIGQIPTVIFGTVNGMIGVIASLPQEQYAFLEKLQSSLRKVIKGVGGLSHEQWRSFNNEKRTVEARNFLDGDLIESFLDLSRNKMEEISKSMNVQVEELCKRVEELTRLH

SEQ ID NO: 18130 - protein, 1088 aa, Brassica rapa
MSSWNYVVTAHKPTSVTHSCVGNFTSPQELNLIVAKCTRIEIHLLTPQGLQPMLDVPIYGRIATLELFRPHGETQDFLFIVTERHKFCVLQWDAESSELVTRAMGDVSDRIGRPTDNGQIGIIDPDCRLIGLHLYDGLFKVIPFDNKGQLKEAFNIRLEELQVLDIKFLFGCAKPTIAVLYQDNKDARHVKTYEVSLKDKDFVEGPWSQNNLDNGADLLIPVPPPLCGVLIIGEETIVYCSANAFKAIPIRPSITKAYGRVDVDGSRYLLGDHAGLVHLLVITHEKEKVTGLKIELLGETSIASTISYLDNAVVFVGSSYGDSQLVKLNLHPDAKGSYVEVLERYTNLGPIVDFCVVDLERQGQGQVVTCSGAFKDGSLRIVRNGIGINEQASVELEGIKGMWSLKSSVDEAFDTFLVVSFISETRILAMNLEDELEETEIEGFLSQLQTLFCHDAVYNQLVQVTSNSVRLVSSTTRELRDEWHAPAGFTVNVATANASQVLLATGGGHLVYLEIGDGKLTEVQHTVLEYEVSCLDINPIGDNPNYSQLASVGMWTDISVRIFSLPELTLITKEQLGGEIIPRSVLLCSFEGISYLLCALGDGHLLNFQLDTTTGQLKDRKKVSLGTQPITLRTFSSKSATHVFAASDRPTVIYSSNKKLLYSNVNLKEVSYMCPFNSAAFPDSLAIAREGELTIGTIDDIQKLHIRTIPLGEHARRICHQEQTRTFGICSLGNQTNAEESEMHFVRLLDDQSFEFMSTYPLDAFEYACSILSCSFTDDKNVYYCVGTAYVLPEENEPTKGRILVFIVEDAKLQLIAEKETKGAVYSLNAFNGKLLAAINQKIQLYKWMLRDDGTRELQSECGHHGHILALYVQTRGDFIVVGDLMKSISLLIYKHEEGAIEERARDYNANWMSAVEILDDDTYLGAENNFNLLTVKKNSEGATDEERGRLEVVGEYHLGEFVNRFCHGSLVMRLPDSEIGQIPTVIFGTVNGMIGVIASLPQEQYAFLEKLQSSLRKVIKGVGGLSHEQWRSFNNEKRTVEARNFLDGDLIESFLDLSRNKMEEISKSMNVQVEELCKRVEELTRLH

SEQ ID NO: 18131 - protein, 1089 aa, Chrysanthemum coronarium
MSTYNYVVTAHKPTNVTHSCVGNFTASNELNLIIAKCTRIEIHLLTPSGLQPMLDVPIYGRIATLELFRPHGETQDLLFIATERYKFCVLQWDADANEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFVEGPWSQNNLDNGADLLIPVPPPFCGVLIIGEETIVYCSASAFKAIPIRPSITRAYGRVDADGSRYLLGDHSGLLHLLVIAHEREKVTGLKIELLGETSIASTISYLDNAFVYVGSSYGDSQLVKLNVQPDAKGSYVEVLERYVNLGPIVDFCVVDLERQGQGQVVTCSGAYKDGSLRIVRNGIGINEQASVELQGIKGMWSLRSATDDLYDTFLVVSFISETRILAMNLEEELEETEIEGFNSQVQTLFCHDAVHNQLVQVTSSSVRLVSSITRELKHEWFAPADYSINVATANATQVLLATRGGHLVYLEIADGQLVEKKHAQLEYDISCLDINPIGDNPNYSNLAAVGMWTDISVKIFSLPDLTLKTEEHLGGEIIPRSVLLCAFEGIPYLLCALGDGHLLNFLLNTTTGQLTDRKKVSLGTQPITLRTFSSKSTTHVFAASDRPTVIYSSNKKLLYSNVNLKEVSYMCPFNSAAFPDSLAIAKEGELTIGTIDDIQKLHIRSIPLGEHARRICHQEQTRTFAICSLKYNQSSTEDSEMHFIRLLDDQTFDFISSYSLDQFEYGCSILSCSFSDDNNAYYCVGTAYVMPEENEPTKGRILIFMVEDGKLQLVAEKETKGAVYSLNAFNGKLLAAINQKIQLYKWMLRDDGTRELQSECGHHGHILALYVQTRGDFIVVGDLMKSISLLIYKHEEGAIEERARDYNANWMSAVEILDDDIYLGAENNFNLFTVRKNSEGATDEERGRLEVVGEYHLGEFVNRFRHGSLVMRLPDSDVGQIPTVIFGTVNGVIGVIASLPQDQYLFMEKLQTNLRKVIKGVGGLSHEQWRSFYSEKKTVDSRNFLDGDLIESFLDLGRSRMEEISKTMNVSVEELMKRVEELTRLH

SEQ ID NO: 18132 - protein, 1089 aa, Olea europaea
MSIWNYVVTAHKPTNVTHSCVGYFTGPQECNLIIAKCTRLEIHSVANQGLQAMLDVPIYGRIATLQLFRPHGETQDLLFVATERYKFCVLQWDAEAAEVITRAMGDVSDRIGRPTDNGQIGIIDPDCRLIGLHLYDGLFKVIPFDNKGQLKEAFNIRLEELQVLDIKFLHGCPKPTIVVLYQDNKDARHAKTYEVALKDKDFIEGPWSQNNLDNGAELLIPIPPPLCGVLIIGEETIVYCSASTFKAIPIRPSITKAYGRIDADGSRYLLGDHSGLLYLLVITQEKEKVTGLKIELLGETSIASTISYLDSGIVYVGSSYGDSQLIRLNLQPDEKGSYVEVMERYVNLGPIVDFCVVDLERQGQGQVVTCSGAYKDGSLRIVRNGIGINEQASVELQGIKGMWSLRSATDDPYDTFLVVSFISETRILAMNLEDELEETEIEGFCSQVQTLFCHDAIYDQLVQVTSNSVRLVSSTSRELRHEWVAPAGYSINVATANATQVLLATGGGYLVYLEIGDGALTEVKHAQLEYDISCLDINSIGNNPKYSQLAAVGMWTDISVRIFSLPDLNLITKEHLGGEIIPRSVLLCSFEGISYLLCALGDGHLLNFVLNVITGELTDRKKVSLGTQPITLRTFSSKNATHVFAASDRPTVIYSSNKKLLYSNVNLKEVSHMCPFNSAAFPDSLAIAKEGELTIGTIDDIQKLHIRSIPLGEQARRICHQEQTRTFAICSLKYNQSSIEDYEMHFIRLLDDQTFEFISTYPLDQFEWGCSILSCSFSDDSNVYYCVGTAYVMPEENEPTKGRILVFTVEDRKLQLIAEKETKGAVYSLNAFNGKLLAAINQEIQLYKWMLREDGSRELQSECGHHGHILALYVQTRGDFIIVGDLMKSISLLIYKHEEGAIEERARDYNANWMTAIEILDDDIYLGAENGFNLFTVRKNSEGATDEERGRLEVVGEYHLGEFVNRFRHGSLVMRLPDSDVGQIPTVIFGTVNGVIGVIASLPYEQYAFMEKLQTNLRRVIKGVGGLGHEQWRSFYSEKKTSDAKNFLDGDLIESFLDLGRNRMEEISKAMCVSVEELMKRVEELTRLH

SEQ ID NO: 18133 - protein, 1089 aa, Chrysanthemum coronarium
MSTYNYVVTAHKPTNVTHSCVGNFTASNELNLIIAKCTRIEIHLLTPSGLQPMLDVPIYGRIATLELFRPHGETQDLLFIATERYKFCVLQWDADANEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFVEGPWSQNNLDNGADLLIPVPPPFCGVLIIGEETIVYCSASAFKAIPIRPSITRAYGRVDADGSRYLLGDHSGLLHLLVIAHEREKVTGLKIELLGETSIASTISYLDNAFVYVGSSYGDSQLVKLNVQPDAKGSYVEVLERYVNLGPIVDFCVVDLERQGQGQVVTCSGAYKDGSLRIVRNGIGINEQASVELQGIKGMWSLRSATDDIYDTFLVVSFISETRILAMNLEDELEETEIEGFNSQVQTLFCHDAVHNQLVQVTSSSVRLVSSITRELKNEWFAPADYSINVATANTTQVLLATRGGHLVYLEITDGLLVEKRHAQLEYDVSCLDINPIGDNPNYSNLAAVGMWTGISVRIFSLPDLTLKTEEHLGGEIIPRSVLLCAFEGIPYLLCALGDGHLLNFLLNTTTGQLTDRKKVSLGTQPITLRTFSSKSTTHVFAASDRPTVIYSSNKKLLYSNVNLKEVSYMCPFNSAAFPDSLAIAKEGELTIGTIDDIQKLHIRSIPLGEHARRICHQEQSRTFAICSLKYNQSSTEDSEMHFIRLLDDQTFDFISSYSLDQFEYGCSILSCSFTDDTNAYYCVGTAYVMPEENEPTKGRILIFMVEDGKLQLVAEKETKGAVYSLNAFNGKLLAAINQKIQLYKWMLRDDGTRELQSECGHHGHILALYVQTRGDFIVVGDLMKSISLLMYKHEEGAIEERARDYNANWMSAVEILDDDIYLGAENNFNLFTVRKNSEGATDEERGRLEVVGEYHLGEFVNRFRHGSLVMRLPDSDVGQIPTIIFGTVNGVIGVIASLPQDQYLFMEKLQTNLRKVIKGVGGLSHEQWRSFYSEKKTVDSRNFLDGDLIESFLDLGRSRMEEISKTMNVSVEELMKRVEELTRLH

SEQ ID NO: 18134 - protein, 1089 aa, Lactuca sativa
MSTYNYVVTAHKPTNVTHSCVGNFTGPQELNLIIAKCTRIEIHLLTPQGLQPMLDVPIYGRIATLELFRPHGETQDLLFIATERYKFCVLQWDADANEVLTRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFVEGPWSQNNLDNGADLLIPVPPPFCGVLIIGEETIVYCSASAFKAIPIRPSITRAYGRVDADGSRYLLGDHSGLLHLLVIAHEKEKVTGLKIELLGETSIASTISYLDNAFVYVGSSYGDSQLIKLNLQPDPKGSYVEVLERYVNLGPIVDFCVVDLERQGQGQVVTCSGAYKDGSLRIVRNGIGINEQASVELQGIKGMWSLRSATDDIYDTFLVVSFISETRILAMNLEDELEETEIEGFCSQVQTLFCHDAIHNQLVQVTSSSVRLVSSSSGELRNEWHAPNDYSINVATANATQVLLATRGGHLVYLEIGDGVLVEKKHAELKYDISCLDINPIGENPNYSNLAAVGMWTDISVKIFSLPDLNLITEEHLGGEIIPRSVLLCAFEGIPYLLCALGDGHLLNFLLNTSTGELTDRKKVSLGTQPITLRTFSSKSTTHVFAASDRPTVIYSSNKKLLYSNVNLKEVSHMCPFNSAAFPDSLAIAKEGELTIGTIDDIQKLHIRSIPLGEHARRICHQEQSRTFAICSLKYNQSSTEDSEMHFIRLLDDQTFDFISTYSLDQFEYGCSILNCSFSDDNNAYYCVGTAYVMPEENEPTKGRILVFMVEDRKLQLVAEKETKGAVYSLNAFNGKLLAAINQKIQLYKWMLRDDGTRELQSECGHHGHILALYVQTRGDFIVVGDLMKSISLLIYKHEEGAIEERARDYNANWMSAVEILDDDIYLGAENNFNLFTVRKNSEGATDEERGRLEVVGEYHLGEFVNRFQHGSLVMRLPDSDVGKIPTIIFGTVNGVIGVIASLPQDQYVFMERLQTNLRKVIKGVGGLSHEQWRSFYSEKKTVDSRNFLDGDLIESFLDLGRSRMEEISKVMSVSVEELMKRVEELTRLH

SEQ ID NO: 18135 - protein, 958 aa, Secale cereale
DLYDGLFKVIPFDNKGQLKEAFNIRLEELQVLDIKFLYGCVRPTIVVLYQDNKDARHVKTYEVALKEKDFVEGPWSQNNLDNGAGLLVPVPAPLGGVIIIGEETIVYCNANSTFKAIPIKQSITRAYGRVDPDGSRYLLGDNSGILHLLVLTQERERVTGLKIEHLGETSVASSISYLDNGVVYVGSRFGDSQLVKLNLQPDASGSFVEILERYVNLGPIVDFCVVDLDRQGQGQVVTCSGAFKDGSIRVVRNGIGINEQASVELQGIKGLWSLKSSFNDLYDMYLVVSFISETRFLAMNMEDELEEIEIEGFDAQIQTLFCQNAINDLLIQVTANSVRLVSCTSRELVDQWNAPEGFSVNVASANASQVLLATGGGHLVYLEIRDAKLVEVKHAQLEHEISCVDLNPVGENPQYSSLAAIGMWTDISVSIFSLPDLELIRKENLGGEIVPRSVLMCTLEGISYLLCALGDGHLFSFLLNASTGELTDRKKVSLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSRTLAFCSFKYTQNSMEESEAHFIRLMDHQTFEFLSTHPLDQYECGCSMISCSFSDDNNFYYIVGTAYVLPEENEPTKGRILVFAVEDGRLQLIVEKETKGAVYSLNAFNGKLLAAINQKIQLYKWMTREDGSHELQSECGHHGHILALYTQTRGDFIVVGDLMKSISLLVYKHEESAIEELARDYNANWMTAVEMIDDDIYVGAENSYNLFTVRKNSDAATDEERGRLEVVGEYHLGEFVNRFRHGSLVMRLPDSEMGQIPTVIFGTINGVIGIIASLPHDHYVFLEKLQTTLVKFIKGVGSLSHEQWRSFHNDKKTSEARNFLDGDLIESFLDLNRAKMEEVAKAMAVPVEELSKRVEELTRLH

SEQ ID NO: 18136 - protein, 1089 aa, Chrysanthemum coronarium
MSTYNYVVTAHKPTNVTHSCVGNFTASNELNLIIAKCTRIEIHLLTSSGLQPMLDVPIYGRIATLELFRPHGETQDLLFIATERYKFCVLQWDADANEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFVEGPWSQNNLDNGADLLIPVPPPFCGVLIIGEETIVYCSASAFKAIPIRPSITRAYGRVDADGSRYLLGDHSGLLHLLVIAHEREKVTGLKIELLGETSVASTISYLDNAFVYVGSSFGDSQLVKLNVQPDAKGSYVEVLERYVNLGPIVDFCVVDLERQGQGQVVTCSGAYKDGSLRIVRNGIGINEQASVELQGIKGMWSLRSATDDIYDTFLVVSFISETRILAMNLEDELEETEIEGFNSQVQTLFCHDAVHNQLVQVTSSSVRLVSSITRELKNEWFAPADYSINVATANTTQVLLATRGGHLVYLEITDGLLVEKRHAQLEYDVSCLDINPIGDNPNYSNLAAVGMWTGISVRIFSLPDLTLKTEEHLGGEIIPRSVLLCAFEGIPYLLCALGDGHLLNFLLNTTTGQLTDRKKVSLGTQPITLRTFSSKSTTHVFAASDRPTVIYSSNKKLLYSNVNLKEVSYMCPFNSAAFPDSLAIAKEGELTIGTIDDIQKLHIRSIPLGEHARRICHQEQSRTFAICSLKYNQSSTEDSEMHFIRLLDDQTFDFISSYSLDQFEYGCSILSCSFTDDTNAYYCVGTAYVMPEENEPTKGRILIFMVEDGKLQLVAEKETKGAVYSLNAFNGKLLAAINQKIQLYKWMLRDDGTRELQSECGHHGHILALYVQTRGDFIVVGDLMKSISLLMYKHEEGAIEERARDYNANWMSAVEILDDDIYLGAENNFNLFTVRKNSEGATDEERGRLEVVGEYHLGEFVNRFRHGSLVMRLPDSDVGQIPTIIFGTVNGVIGVIASLPQDQYLFMEKLQTNLRKVIKGVGGLSHEQWRSFYSEKKTVDSRNFLDGDLIESFLDLGRSRMDEISKTMNVSVEELMKRVEELTRLH

SEQ ID NO: 18137 - protein, 1088 aa, Arabidopsis lyrata
MSVWNYAVTAQKPTCVTHSCVGNFTSPQELNLIVAKSTRIEIHLLSPQGLQTILDVPLYGRIATLELFRPHGEAQDFLFVATERYKFCVLQWDYESSELITRAMGDVSDRIGRPTDNGQIGIIDPDCRLIGLHLYDGLFKVIPFDNKGQLKEAFNIRLEELQVLDIKFLYGCTKPTIAVLYQDNKDARHVKTYEVSLKEKDFVEGPWSQNNLDNGADLLIPVPSPLCGVLIIGEETIVYCSANAFKAIPIRPSITKAYGRVDLDGSRYLLGDHSGLIHLLVITHEKEKVTGLKIELLGETSIASSISYLDNAVVFVGSSYGDSQLIKLNLQPDATGSYVEILEKYVNLGPIVDFCVVDLERQGQGQVVTCSGAYKDGSLRIVRNGIGINEQASVELQGIKGMWSLKSSIDEAFDTFLVVSFISETRILAMNIEDELEETEIEGFLSQVQTLFCHDAVYNQLVQVTSNSVRLVSSTTRELRNKWDAPAGFAVNVATANASQVLLATGGGHLVYLEIGDGTLTEVKHVLLEYEVSCLDINPIGDNPNYSQLAAVGLWTDISVRIFVLPDLTLITKEQLGGEIIPRSVLLCAFEGISYLLCALGDGHLLNFQLDTSSGKLRDRKKVSLGTQPITLRTFSSKSATHVFAASDRPAVIYSNNKKLLYSNVNLKEVSHMCPFNSAAFPDSLAIAREGELTIGTIDDIQKLHIRTIPIGEHARRICHQEQTRTFAICCLRNQPSAEESEMHFVRLLDAQSFEFLSTYPLDAFEYGCSILSCSFTDDKNVYYCVGTAYVLPEENEPTKGRILVFIVEEGRLQLITEKETKGAVYSLNAFNGKLLAAINQKIQLYKWMLRDDGTRELQSECGHHGHILALYVQTRGDFIVVGDLMKSISLLIYKHEEGAIEERARDYNANWMAAVEILDDDIYLGADNCFNLFTVKKNNEGATDEERARMEVVGEYHIGEFVNRFRHGSLVMRLPDSEIGQIPTVIFGTVSGMIGVIASLPQEQYAFLEKLQTSLRKVIKGVGGLSHEQWRSFNNEKRTAEAKSYLDGDLIESFLDLSRGKMEEISKGMDVQVEELCKRVEELTRLH

SEQ ID NO: 18138 - protein, 1078 aa, Flaveria ramosissima
NYVVTAHKPTNVTHSCVGNFTGPQELNLIIAKCTRIEIHLLTPEGLQPMLDVPIYGRIATLELFRPHGETQDLLFIATERYKFCVLQWDADASELITRCMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFVEGPWSQNNLDNGADLLIPVPPPFCGVLIIGEETIVYCSASTFKAIPIRPSITRAYGRVDADGSRYLLGDLSGLLHLLVIAHEKEKVTGLKIELLGETSVASTISYLDNAFVYVGSSYGDSQLIKLNLQPDAKGSYVEVLEKYVNLGPIVDFCVVDLERQGQGQVVTCSGAYKDGSLRIVRNGIGINEQASVELQGIKGMWSLRSATEDLYDTFLVVSFISETRILAMNLEDELEETEIEGFCSQVQTLFCHDAVHNQLVQVTSSSVRLVSSVSRELRHEWHAPADYSINVATANATQVLLATRGGHLVYLEIGDGVLVEKKHAELKYDISCLDINPIGDNPNYSNLAAVGMWTDISVRIFSLPDLNLITEEHLGGEIIPRSVLLCAFEGIPYLLCALGDGHLLNFLLNTSTGELTDRKKVSLGTQPITLRTFSSKSTTHVFAASDRPTVIYSSNKKLLYSNVNLKEVSHMCPFNSAAFPDSLAIAKEGELTIGTIDDIQKLHIRSIPLGEHARRICHQEQSRTFAICSLKYNQSSAEDSEMHFIRLLDDQTFDFISTYALDQFEYGCSILNCSFSDDNNAYYCVGTAYVMPEENEPSKGRILVFIVEDGKLQLVAEKETKGAVYSLNAFNGKLLAAINQKIQLYKWMLRDDGTRELQSECGHHGHILALYVQTRGDFIVVGDLMKSISLLIYKHEEGAIEERARDYNANWMSAVEILDDDVYLGAENNFNLFTVRKNSEGATDEERGRLEVVGEYHLGEFVNRFQHGSLVMRLPDSDVGHIPTIIFGTVNGVIGVIASLPQDQYMFLEKLQTNLRKVIKGVGGLSHEQWRSFYNEKKTADSKNFLDGDLIESFLDLGRNRMEEISKNMNVSVEELMKRV

SEQ ID NO: 18139 - protein, 1088 aa, Arabidopsis thaliana
MSVWNYAVTAQKPTCVTHSCVGNFTSPQELNLIVAKSTRIEIHLLSPQGLQTILDVPLYGRIATMELFRPHGEAQDFLFVATERYKFCVLQWDYESSELITRAMGDVSDRIGRPTDNGQIGIIDPDCRVIGLHLYDGLFKVIPFDNKGQLKEAFNIRLEELQVLDIKFLYGCTKPTIAVLYQDNKDARHVKTYEVSLKDKNFVEGPWSQNNLDNGADLLIPVPSPLCGVLIIGEETIVYCSANAFKAIPIRPSITKAYGRVDLDGSRYLLGDHAGLIHLLVITHEKEKVTGLKIELLGETSIASSISYLDNAVVFVGSSYGDSQLIKLNLQPDAKGSYVEILEKYVNLGPIVDFCVVDLERQGQGQVVTCSGAYKDGSLRIVRNGIGINEQASVELQGIKGMWSLKSSIDEAFDTFLVVSFISETRILAMNIEDELEETEIEGFLSEVQTLFCHDAVYNQLVQVTSNSVRLVSSTTRELRNKWDAPAGFSVNVATANASQVLLATGGGHLVYLEIGDGTLTEVKHVLLEYEVSCLDINPIGDNPNYSQLAAVGMWTDISVRIFVLPDLTLITKEELGGEIIPRSVLLCAFEGISYLLCALGDGHLLNFQLDTSCGKLRDRKKVSLGTRPITLRTFSSKSATHVFAASDRPAVIYSNNKKLLYSNVNLKEVSHMCPFNSAAFPDSLAIAREGELTIGTIDDIQKLHIRTIPIGEHARRICHQEQTRTFAISCLRNEPSAEESESHFVRLLDAQSFEFLSSYPLDAFECGCSILSCSFTDDKNVYYCVGTAYVLPEENEPTKGRILVFIVEEGRLQLITEKETKGAVYSLNAFNGKLLASINQKIQLYKWMLRDDGTRELQSECGHHGHILALYVQTRGDFIAVGDLMKSISLLIYKHEEGAIEERARDYNANWMTAVEILNDDIYLGTDNCFNIFTVKKNNEGATDEERARMEVVGEYHIGEFVNRFRHGSLVMKLPDSDIGQIPTVIFGTVSGMIGVIASLPQEQYAFLEKLQTSLRKVIKGVGGLSHEQWRSFNNEKRTAEAKGYLDGDLIESFLDLSRGKMEEISKGMDVQVEELCKRVEELTRLH

SEQ ID NO: 18140 - protein, 1072 aa, Chrysanthemum coronarium
HSCVGNFTASNELNLIIAKCTRIEIHLLTSSGLQPMLDVPIYGRIATLELFRPHGETQDLLFIATERYKFCVLQWDADANEVITRAMGDVSDRIGRPTDNGQIGIIDPDCRLIGLHLYDGLFKVIPFDNKGQLKEAFNIRLEELQVLDIKFLYGCPKPTIVVLYQDNKDARHVKTYEVSLKDKDFVEGPWSQNNLDNGADLLIPVPPPFCGVLIIGEETIVYCSASAFKAIPIRPSITRAYGRVDADGSRYLLGDHSGLLHLLVIAHEREKVTGLKIELLGETSVASTISYLDNAFVYVGSSFGDSQLVKLNVQPDAKGSYVEVLERYVNLGPIVDFCVVDLERQGQGQVVTCSGAYKDGSLRIVRNGIGINEQASVELQGIKGMWSLRSATDDIYDTFLVVSFISETRILAMNLEDELEETEIEGFNSQVQTLFCHDAVHNQLVQVTSSSVRLVSSITRELKNEWFAPADYSINVATANTTQVLLATRGGHLVYLEIADGQLVEKKHAQLEYDISCLDISPIVDNPNYSNLAAVGMWTDISVKIFSLPDLTLKTEEHLGGEIIPRSVLLCAFEGIPYLLCALGDGHLLNFLLNTTTGQLTDRKKVSLGTQPITLRTFSSKSTTHVFAASDRPTVIYSSNKKLLYSNVNLKEVSYMCPFNSAAFPDSLAIAKEGELTIGTIDDIQKLHIRSIPLGEHARRICHQEQTRTFAICSLKYNQSSTEDSEMHFIRLLDDQTFDFISSYSLDQFEYGCSILSCSFSDDNNAYYCVGTAYVMPEENEPTKGRILIFMVEDGKLQLVAEKETKGAVYSLNAFNGKLLAAINQKIQLYKWMLRDDGTRELQSECGHHGHILALYVQTRGDFIVVGDLMKSISLLIYKHEEGAIEERARDYNANWMSAVEILDDDIYLGAENNFNLFTVRKNSEGATDEERGRLEVVGEYHLGEFVNRFRHGSLVMRLPDSDVGQIPTVIFGTVNGVIGVIASLPQDQYLFMEKLQTNLRKVIKGVGGLSHEQWRSFYSEKKTVDSRNFLDGDLIESFLDLGRSRMEEISKTMNVSVEELMKRVEELTRLH

SEQ ID NO: 18141 - protein, 1059 aa, Mimulus guttatus
MSIWNYVVTAHKPTNVTHSCVGNFTGPQELNLIVAKCTRIEIHVLSPQGLQPMLDVPIYGRIATLELFRPHGEAQDLLFVATERYKFCVLQWDAETSEVITRAMGDVSDRIGRPTDNGQIGIVDPDCRLIGLHLYDGLFKVIPFDNKGQLKEAFNIRLEELQVLDIKFLYGCPKPTIVVLYQDNKEARHVKTYEVALKDKDFVEGPWSQNNLDNGAELLIPVPPPLCGVLIIGEETIVYCSASAFKAIPVRPSITRAYGRVDADGSRYLLGDHNGILHLLVITHEKEKVTGLKIELLGETSVASSISYLDNAVVFVGSSYGDSQLIKINLHPDAKGSYVEVLERFVNLGPIVDFCVVDLERQGQGQVVTCSGAYKDGSLRIVRNGIGINEQASVELQGIKGMWSLRSATDDPYDTFLVVSFISETRILAMNLEDELEETEIEGFSSDVQTLFCHDAIHDQLVQVWKNTMNVLLAIGGGHLVYLEIGDGVLTEVKHIQLEYDISCLDINPIGDNTNHSQLAAVGMWTDISVRIFSLPDLNLITKELLGGEIIPRSVLLCSFEGISYLLCALGDGHLLNFVLNTSNGQLADRKKVSLGTQPITLRTFSSKNATHVFAASDRPTVIYSSNKKLLYSNVNLKEVSHMCPFNSAAFPDSLAIAKEGELTIGTIDDIQKLHIRSIPLGEHARRICHQEQTRTFAICSLKYNQSSAEDSEMHFIRLLDDQTFDFISTYSLDQFECGCSILSCSFSDDNNVYYCIGTAYVMPEENEPTKGRILVFAVEDGKLQLIAEKETKGAVYSLNAFNGRLLAAINQKIQLYKWMLRDDGSRELQSESGHHGHILALYVQTRGDFIVVGDLMKSISLLIYKHEEGAIEERARDYNANWMSAVEILDDDIYVGAENNFNLFTVRKNSEGATDEERGRLEVVGEYHLGEFVNRFRHGSLVMRLPDSDVGQIPTVIFGTVNGVIGVIASLPHEQYVFLEKLQTNMRKVIKGVGGLSHEQWRSFYNEKKTVDAKNFLDGDLIESFLDLNRNQMEEVSKAINVPVEELMKRVEELTRLH

SEQ ID NO: 18142 - protein, 1090 aa, Eutrema halophilum
MSVWNYVVTAHKPTCVSHSCVGNFTSPQELNLIVAKCTRIEIHLLTPQGLQTMLDVPLYGRISTLDLFRPHGETQDFLFIATERHKFCVLQWDSESSELITRAMEDVSDRIGRPTDNGQIGIIDPDCRLIGLHLYDGLFKVIPFDNKGQLKEAFNIRLEELQVLDIKFLYGCAKPTIAVLYQDNKDARHVKTYEIATKDKDKVFVEGPWSQNNLDNGADLLIPVPSPLCGVLIIGEETIVYCSVNAFRAIPIRPCITKAYGRVDVDGSRYLLGDHAGLIHLLVITHEKEKVTGLKFELLGETSIASTISYLDNAVVFVGSSYGDSQLIKLNRKPDADGSYVEILEKYVNLGPIVDFCVVDLERQGQGQIVTCSGAYKDGSLRIVRNGIGINEQASVELQGIKGMWSLKASIDEAFDRFLVVSFINETRILAMNMEDELEETEIEGFLSQVQTLFCHYAVYDQLVQVTSNSVRLVSSTTRELRNKWEAPVGFTVNVATANASQVLLATGGGHLVYIEIGDGTLTEVKHVQLEYEVSCLDINPIGDNPNYSQLAAVGMWTDISVRIFLLPDLTLITKEQLGGEIIPRSVLLCAFEGISYLLCALGDGHLLSFQLDTSSGELRDRKKVLLGTQPITLRTFSSKSATHVFAASDRPAVIYSNNKKLLYSNVNLKEVSHMCPFSSAAFPDSLAITREGELTIGTIDDIQKLHIRTIPIGEHARRICHQEQTRTLAVCSLRNQLSAQESEMHFVRLLDSQSFEFLSAYPLDAFEYGCSILSCSFTDDKKVYYCVGTSYVLPEENEPTKGRILVFVVEERKLQLIAEKETKGSVYSLNAFNGKLLAAINQKIQLYKWMLRDDGTRELQSECGHHGHILALYVQTRGDFIVVGDLMKSIALLIYKHEEGSIEEIGRDYNASWMTAVEILDDDTYLGADNCSNLFTVKKNNEAATDEERARMEVVGEYHIGEFVNRFRHGSLVMRLPDTEIGQIPTMIFGTVNGVIGVIASLPQEEYLFLEKLQTSLRKVIKGVGGLNHEQWRSFSNEKRTAEAKGFLDGDLIESFLDLSRSKMDEISKGMDVQVEELCKRVEELTRLH

SEQ ID NO: 18143 - protein, 1088 aa, Eutrema parvulum
MSVWNYVVTAQKPTCVTHSCVGNFTSPQELNLIVAKCTRIEIHLLTPQGLQTMLDVPLYGRIATLELFRPHGEAQDLLFIATERYKFCVLQWESESSELITRAMGDVSDRIGRPTDNGQIGIIDPDCRLVGLHLYDGLFKVIPLDNKGQLKEAFNIRLEELQVLDIKFLYGCAKPTIAVLYQDNKDARHVKTYEVSHKEKGFVEGPWSQNNLDYGADLLIPVPSPLCGVLIIGEETIVYCSANAFKAIPIRPSITKAYGRVDIDGSRYLLGDHAGLIHLLVITHEKEKVTGLKIELLGETSIASTISYLDNAVVFVGSSYGDSQLIKLNMEPDAKGSYVEIIEKYVNLGPIVDFCVVDLERQGQGQVVTCSGAYKDGSLRIVRNGIGINEQASVELQGIKGMWSLKSSIDEAFDTFLVVSFISETRILAMNIEDELEETEIEGFLSEVQTLFCHDAVYNQLVQITSTSVRLVSSTTRELRNKWDAPAGFTVNVATANASQVLLATGGGHLVYIEIGDGTLTEVKHAQLEYEVSCLDINPVGENPNYSQLAAVGMWTDISVRIFVLPDLTLITKEQLGGEIIPRSVLLCAFEGISYLLCALGDGHLLNFQLDTSSGELRVRKKVSLGTQPITLRTFSSKSATHVFAASDRPAVMYSNNKKLLYSNVNLKEVSHMCPFNSAAFPDSLAIAREGELTIGTIDDIQKLHIRTIPIGEHAHRICHQEQTRTCAICTLKNQPSAEESEMHFVRLLDAQNFEFLSTYPLDAFEYGCSVLSCSFTDDKNVYYCVGTSYVLPEENEPTKGRILVFVVEEGKLQLIAEKETKGSVYSLNAFNGKLLAAINQKMQLYKWMLRDDGTRELQSECGHHGHILALYVKTRGDFIVVGDLMKSISLLIYKHEEGAIEEIARDYNASWMTAVEILDDDTYLGADNCYNLFTVKKNSEAATDEERCRMEVVGEYHTGEFVNRFRHGSLVMRLPDSEIGQIPTLIFGTVNGVIGVIASLPQEQYAFLEKLQTSLRKVIKGVGGLSHEQWRSFNNEKRTGDARNFLDGDLIESFLDLSRSKMEEISQGMDIQVEELCKRIEELTTLH

SEQ ID NO: 18144 - protein, 529 aa, Brachypodium distachyon
MGSRTRGCCGWLIVALVLALVATAAVVAIMKRKPGGGGRGREPKPLPVPGPPGAIDSKYGDALGIALQFFQVQKAGKLENNEIPWRGDSALDDGKEAKLDLSKGLYDAGDHMKFSFPMAFTATVLAWSVLEYGDQMNAAKQLDPALDALRWITDFLIAAHPSDNVFYIQVGDPDLDHNCWERPETMTEKRPLTQINPKSPGSDIAAEAAAAMAAASMVFKTSDTTYSDSLLQHAQKLFTFADTYRGISSETYPKLQKYYNSTGYVDELLWAASWLYHATGDQTYLSYVTVENGKAYADWGRPTWFSWDDKLPGTQVLLSRVNFFGSKKISNAENGGLKMYRDTAEAVICGLLPDSPSATGSRTSGGLVWISGWNSIQHGTNSGFLASVYSDYMLTSQTAAVQCSGKYFSPTDIRNFAISQANYILGDNPMKLSYLVGYGSSYPQQVHHRGASIPADAKTGCKGFEYLHSSSPNPNVAMGALVGGPFQNDSFVDSRDNAVQTESSTYNSGTLVGLLAGLVTTSSVASSFT

SEQ ID NO: 18145 - protein, 529 aa, Pennisetum glaucum
MGSKYTRGCCGWLIVALIAALVATAAMFAIMKRKPGGGGGKRLKPLPVPGPPGAIDSKYGDALGVALQFFQVQKSGKLENNQIPWRGDSALTDGKEAGLDLSKGMYDAGDHMKFTFPMAFTATVLAWSVLEYGDQMSAAKQLDPALDALKWITDFLIAAHPSDNVLYIQVGDPDLDHNCWERPETMTEKRPLTQINKKSPGSDVAAEAAAAMAAASMVFKSSDTTYSDVLLQHAQKLFTFADTYRGLSSDSYPKLQDFYNSTSYVDELLWAASWLYHATGDQTYLSYVTVQNGKTYADWGRPTWFSWDDKNPGTQVLLSRLNFFGSKQISNAENEGLKSYRDTAESVICGLIPDSPQATASRTGGGLIWISGWNSLQHATNAAFLALVYSDYMLSTQTAAVQCSGKYYSPTDIRNFAASQANYILGDNPMKLSYLVGYGSSYPQQVHHRGASIPADAKTGCKGFQYLHSPDPNPNVAMGALVGGPFQNDTYVDSRDNAVQTESSTYNSGTLVGLLSGLVTTSSVAQSFT

SEQ ID NO: 18146 - protein, 525 aa, Sorghum bicolor
MGKYTRGCCGWLIVALIAALVATAAMFAIMKRKPGGRHIKPLPVPGPPGAIDSKYGDALGVALQFFQVQKAGKLENNQIPWRGDSALTDGKEAGLDLSKGMYDAGDHMKFTFPMAFTATVLSWSVLEYGDQMSAAKQLDPALDALKWITDFLIAAHPSDNVLYIQVGDPDLDHNCWERPETMTEKRPLTQINKKSPGSDVAAEAAAAMAAASMVFKSRDTTYSDVLLQHAQKLFTFADTYRGLSSESYPKLQDFYNSTSYVDELLWAASWLYHATGDQTYLSYVTVQNGKTYADWGRPTWFSWDDKNPGTQVLLSRLNFFGSKQISNAENEGLKSYRDTAEAVICGLIPDSPQATASRTGGGLVWISGWNSLQHATNAAFLAVVYSDYMLSTRTAAVQCSGKYYSPTDIRNFAASQANYILGDNPMKLSYLVGYGSSYPQQVHHRGASIPADAKTGCKGFQYLHSSDPNPNVAVGALVGGPFQNDTFVDSRDNAVQTESSTYNSGTLVGLLSGLVTTSSVVQSFT

SEQ ID NO: 18147 - protein, 525 aa, Saccharum officinarum
MGKYTRGCCGWLIVALIAALVATAAMFAIMKRKPGGRHIKPLPVPGPPGAIDSKYGDALGVALQFFQVQKAGKLENNQIPWRGDSALTDGKEAGLDLSKGMYDAGDHMKFTFPMAFTATVLAWSVLEYGDQMSAAKQLDPALDALKWITDFLIAAHPSDNVLYIQVGDPDLDHNCWERPETMTEKRPLTQINKKSPGSDVAAEAAAAMAAASMVFKSRDTTYSDVLLQHAQKLFTFADTYRGLSSESYPKLQDFYNSTSYVDELLWAASWLYHATGDQTYLSYVTVQNGKTYADWGRPTWFSWDDKNPGTQVLLSRLNFFGSKQISNAENEGLKSYRDTAEAVICGLIPDSPQATASRTGGGLVWISGWNSLQHATNAAFLAVVYSDYMLSTRTAAVQCSGKYYSPTDIRNFAASQANYILGDNPMKLSYLVGYGSSYPQQVHHRGASIPADAKTGCKGFQYLHSPDPNPNVAMGALVGGPFQNDTFVDSRDNAVQTESSTYNSGTLVGLLSGLVTTSSVVQSFT

SEQ ID NO: 18148 - protein, 528 aa, Setaria italica
MGSKYTRGCCGWLIVALIAALVATAAMFAIMKRKPGGGGKHLKPLPVPGPPGAIDSKYGDALGVALQFFQVQKSGKLENNQIPWRGDSALTDGKEAGLDLSKGMYDAGDHMKFTFPMAFTATVLAWSVLEYGDQMSAAKQLDPALDALKWITDFLIAAHPSDNVLYIQVGDPDLDHNCWERPETMTEKRPLTQINKKSPGSDVAAEAAAAMAAASMVFKSSDTTYSDVLLQHAQKLFTFADTYRGLSSDSYPKLQDFYNSTSYVDELLWAASWLYHATGDQTYLSYVTVQNGKTYADWGRPTWFSWDDKNPGTQVLLSRLNFFGSKQISNAENEGLKSYRDTAESVICGLIPDSPQATASRTGGGLIWISGWNSLQHATNAAFLAIVYSDYMLSTQTAAVQCSGKYYSPTDIRNFAASQANYILGDNPMKLSYLVGYGSVYPQQVHHRGASIPADAKTGCKGFQYLHSPDPNPNVAMGALVGGPFQNDTFVDSRDNALQTESSTYNSGTLVGLLSGLVTTSSVAQSFT

SEQ ID NO: 18149 - protein, 526 aa, Zea mays
MGSKYTRGCCGWLIVALIAALVATAAMFAIMKRKPGGRHIKPLPVPGPPGAIDSKYGDALGVALQFFQVQKAGKLENNQIPWRGDSALTDGKEAGLDLSKGMYDAGDHMKFTFPMAFTATVLSWSVLEYGDQMSAAKQLDPALDALKWITDFLIAAHPSDNVLYIQVGDPDLDHNCWERPETMTEKRPLTQINKKTPGSDVAAEAAAAMAAASMVFKSRDTTYSDVLLQHAQKLFTFADTYRGLSSESYPKLQDFYNSTSYVDELLWAASWLYHATGDQTYLSYVTVQNGKSYADWGRPTWFSWDDKNPGTQVLLSRLNFFGSKQISNAENEGLKMYRDTAEAVICGLIPDSPQATASRTGGGLVWISGWNSLQHATNAAFLSVVYSDYMLSTRTAAVQCSGKYYSPTDIRNFAASQANYILGDNPMKLSYLVGYGSSYPKQVHHRGASIPADAKTGCKGFEYLHSPSPNPNVATGALVGGPFQNDTFVDSRDNAVQTESSTYNSGTLVGLLSGLVTTSSVVQSFT

SEQ ID NO: 18150 - protein, 528 aa, Echinochloa colona
MGSKYTRGCCGWLIVALIAALVATAAMFAIMKRKPGGGGRHLKPLPVPGPPGAIDSKYGDALGVVLQFFQVQKSGKLENNQIPWRGDSALTDGKEAGLDLSKGMYDAGDHIKFTFPMAFTATVLAWSVLEYGDQMSAAKQLDPALDALKWITDFLIAAHPSDNVLYIQVGDPDLDHNCWERPETMAEKRPLTQINKKSPGSDVAAEAAAAMAAASMVFKSSDTAYSDVLLQHAQKLFTFADIYRGLSSDSYPKLQDFYNSTGYVDELLWAASWLYHATGDQTYLSYVTVQYGKAYADWGRPTWFSWDDKNPGTQVLLSRLNFFGSKQISNAENEGLKSYRDTAESVICGLIPDSPQATASRTGGGLIWISGWNSLQHATNAAFLSIVYSDYMFSTRTAAVQCSGKYYSPTDIRNFAASQANYILGDNPMKLSYLVGYGSSYPQQVHHRGASIPADAKTGCKGFEYLHSPNPNPNVAMGALVGGPFQNDTFVDSRDNALQTESSTYNSGTLVGLLSGLVTTSSVAQSFT

SEQ ID NO: 18151 - protein, 530 aa, Avena sativa
MGSRRGGCCGWLIVALVLALVATAAVVAIMKRKPGGGGGSSRRPKPLPVPGPPGAVDSKYGDSLGVALQFFQVQKAGKLVDNQIPWRGDSALNDGKEAKLDLSKGLYDAGDHMKFTFPMAFTATVLAWSILEYGDQMTAAKQLDPALDGLRWITDFLIAAHPSDNVLYIQVGDPDLDHNCWERPETMTEKRPLTQINAKSPGSDIAAEAAAAMAAASMVFKSTDTTYSDTLLQHAQKLFTFADTYRGISSDTYPKLQNYYNSTGYADELLWAASWLYHATGDQTYLSYATVENGKAYADWGRPTWFSWDDKLPGTQVLLSRVNFFGSNKASNAENSGLKSYRDTAEAVICGLLPDSPSATGSRTSGGLVWISGWNSLQHATNAAFLAVVYSDYMLTSQTAAVECSGKYFSPTDIRNFAISQANYILGDNPMKLSYLVGYGSNYPQQVHHRGASIPSDVKTGCKGFDYLHSTSPNPNIAMGALVGGPFQNDSFVDLRDNAVQTESSTYNSGTLVGLLAGLVTTSSIAKTFT

SEQ ID NO: 18152 - protein, 531 aa, Hordeum vulgare
MGSKTKGCCGWLIVALVLALVATAAVVAIMKRKPGGGGGGRSRPPKPLPVPGPPGDVDSKYGDALGVALQFFQVQKAGKLVDNQIPWRGDSALTDGKEAKLDLSKGLYDAGDHMKFTFPMAFTATVLAWSVLEYGDQMTAAKQLDPALDALRWVTDFLIAAHPSDNVFYIQVGDPDLDHDCWQRPETMTEKRPLTQINPKNPGSDIAAEAAAALAAASMVFKSSDTTYSDSLLQHAQKLFTFADTYKGIASDTYPKLQKYYNSTGYVDELLWAASWLYHATGDQTYLSYVTVQNGKDYADWGRPTWFSWDDKLPGTQILLSRVNFFGSKEISNAENSGLKMYRDTAEAVICGLLPDSPSATGSRTSGGLVWISGWNSLQHGINAAFLAVVYSDYMLTSQTAAVECSGKYFSPTDIRNFAISQANYVLGDNTMKLSYLVGYGSNYPQQVHHRGASIPADAKTGCKGFEYLHSSSPNPNVAMGAVVGGPFQNDTFVDLRDNAVQTESSTYNSGTFVGLLAGLVTTSSVAKTFT

SEQ ID NO: 18153 - protein, 530 aa, Avena sativa
MGSRRGGCCGWLIVALVLALVATAAVVAIMKRKPGGGGGSSRRPKPLPVPGPPGAVDSKYGDSLGVALQFFQVQKAGKLVDNQIPWRGDSALNDGKEEKLDLSKGLYDAGDHMKFTFPMAFTATVLAWSILEYGDQMTAAKQLDPALDGLRWITDFLIAAHPSDNVLYIQVGDPDLDHNCWERPETMTEKRPLTQINAKSPGSDIAAEAAAAMAAASMVFKSTDTTYSDTLLQHAQKLFTFADTYRGISSDTYPKLQNYYNSTGYADELLWGASWLYHATGDQTYLSYATVENGKAYADWGRPTWFSWDDKLPGTQVLLSRVNFFGSNKASNAENSGLKSYRDTAEAVICGLLPDSPSATGSRTSGGLVWISGWNSLQHATNAAFLAVVYSDYMLTSQTAAVECSGKYFSPTDIRNFAISQANYILGDNPMKLSYLVGYGSNYPQQVHHRGASIPSDVKTGCKGFDYLHSTSPNPNIAMGALVGGPFQNDSFVDLRDNAVQTESSTYNSGTLVGLLAGLVTTSSIAKTFT

SEQ ID NO: 18154 - protein, 530 aa, Secale cereale
MGSRTKGCCGWLIVALVLALVATAAVVAIMKRKPGGAEGPEPPAQAAPRPGPPGDIDSKYGDALGVALQFFQVQKAGKLVDNQIPWRGDSALDDGKEAKLDLSKGLYDAGDHMKFTFPMAFTATVLAWSVLEYGDQMTAAKQLDPALDALRWTTDFLIAAHPSDNVFYIQVGDPDLDHDCWQRPETMTEKRPLTQINAKNPGSDIAAEAAAAMAAASMVFKSSDTTYSDSLLQHAQKLFTFADTYKGIASDAYPKLQKYYNSTGYVDELLWAASWLYHATGDQTYLSYVTVQNGKDYADWGRPTWFSWDDKLPGTQILLSRVNFFGSKEISNAENSGLKMYRDTAEAVICGLLPDSPSATGSRTSGGLVWISGWNSLQHGINAAFLAVVYSDYMLTSQTAAVECSGKYFSPTDIRNFAISQANYVLGDNPMKLSYLVGYGSSYPQQVHHRGASIPADAKTGCKGFEYLHSASPNPNVATGAVVGGPFQNDSFVDLRDNAVQTESSTYNSGTFVGLLAGLVTTSSIAKTFT

SEQ ID NO: 18155 - protein, 506 aa, Panicum virgatum
ATAAMFAIMKRKPGGKGHHKKPLPVPGPPGAIDSKYGDALGVALQFFQVQKSGKLENNQIPWRGDSALTDGKEAGLDLSKGMYDAGDHIKFTFPMAFTATVLAWSVLEYGDQMSAAKQLDPALDALKWITDFLIAAHPSDNVLYIQVGDPDLDHNCWERPETMTEKRPLTQINKKSPGSDVAAEAAAAMAAASMVFKSSDTTYSDVLLQHAQKLFTFADTYRGLSSETYPKLQDFYNSTGYVDELLWAASWLYHSTGDQTYLSYVTVQNGKTYAEWGRPTWFSWDDKNPGTQVLLSRLNFFGSKQISNAENEGLKSYRDTAEAVICGLIPDSPQATASRTGGGLIWISGWNSLQHATNSAFLALVYSDYMLSTRTAEVQCSGKYYSPTDIRNFAASQANYILGDNPMKLSYLVGYGSNYPQQVHHRGASIPADAKTGCKGFQYLHSPNPNPNVAMGALVGGPFQNDTFVDSRDNAVQTESSTYNSGTLVGLLSGLVTTSSVAQSFT

SEQ ID NO: 18156 - protein, 489 aa, Echinochloa colona
RHLKPLPVPGPPGAIDSKYGDALGVVLQFFQVQKSGKLENNQIPWRGDSALTDGKEAGLDLSKGMYDAGDHIKFTFPMAFTATVLAWSVLEYGDQMSAAKQLDPALDALKWITDFLVAAHPSDNVLYIQVGDPDLDHNCWERPETMTEKRPLTQINKKSPGSDVAAEAAAAMAAASMVFKSSDTAYSDVLLQHAQKLFTFADIYRGLSSDSYPKLQDFYNSTGYVDELLWAASWLYHATGDQTYLSYVTVQYGKAYADWGRPTWFSWDDKNPGTQVLLSRLNFFGSKQISNAENEGLKSYRDTAESVICGLIPDSPQATASRTGGGLIWISGWNSLQHATNAAFLSIVYSDYMFSTRTAAVQCSGKYYSPTDIRNFAASQANYILGDNPMKLSYLVGYGSSYPQQVHHRGASIPADAKTGCKGFEYLHSPNPNPNVAMGALVGGPFQNDTFVDSRDNAVQTESSTYNSGTLVGLLSGLVTTSSVAQSFT

SEQ ID NO: 18157 - protein, 479 aa, Triticum aestivum
PPGDIDSKYGDALGVALQFFQVQKAGKLVDNQIPWRGDSALNDGKEAKLDLSKGLYDAGDHMKFTFPMAFTATVLAWSVLEYGDQMTAAKQLDPALDALRWVTDFLIAAHPTDNVFYIQVGDPDLDHDCWQRPETMTEKRPLTQINPKNPGSDIAAEAAAAMAAASMVFKSSDTTYSDSLLQHAQKLFTFADTYKGIASDTYPNLQKYYNSTGYVDELLWAASWLYHATGDQTYLSYVTVQNGKDYADWGRPTWFSWDDKLPGTQILLSRVNFFGSKEISNAENSGLKMYRDTAEAVICGLLPDSPSATGSRTSGGLVWISGWNSLQHGINAAFLAVVYSDYMLTSQTAAVECSGKYFSPTDIRNFAISQANYVLGDNPMKLSYLVGYGSSYPQQVHHRGASIPADAKTGCKGFEYLHSSSPNPNVATGAVVGGPFQNDSFVDLRDNAVQTESSTYNSGTFVGLLAGLVTTSSIAKTFT

SEQ ID NO: 18158 - protein, 617 aa, Zea mays
MYGRDPWGGPLEICHDSATDDDRSRNLDIDRGALSRTLDETQQSWLLAGPGDPGRKKKKYVDIGCLVVSRKLFVWTLGVLLAAAVFAGVVAGIAKAIPRRHRPPPPPDDYTVALHKALMFFNAQRSGKLPKHNNIPWRGNSCMKDGLSDPAVRRSLVGGYYDAGDAVKFNFPAAFSMTLLSWSVIEYSAKYDAAGELGHVRDIIKWGSDYFLKTFNSTADSIDRVVAQVGSTATSPGSTQPNDRYCWMRPEDIDYPRPVVECHACSDLAAEMAAALAAASIVFKDNKAYSQKLVHGATTLFQFARERRGRYSAGGSDAAKFYNSTSYWDEFVWGSSWMYLATGNSSYLTLATHPKLAKHAGAFWGGPDYGVFSWDNKLTGAQVLLSRLRLFLSPGYPYEETLSTFHNQTSIIMCSYLPIFKSFNRTRGGLIQLNHGKPQPLQYVVNAAFLASVFSDYLEAADTPGWYCGPHFYSIEVLRSFARTQIEYILGKNPLKMSYVVGFGNHYPKHVHHRGASIPKNGVHYGCKGGWKWRDTKKPNPNIIVGAMVAGPDRHDGFKDVRKNYNYTEATLAGNAGLVAALVALSGEGHGVDKNTMFSAVPPMFPSPPPPPAPWKP

SEQ ID NO: 18159 - protein, 617 aa, Setaria italica
MYGRDPWGGPLEICPDSATDDDRSRNLDIDRGALSRTLDETQQSWLLAGPGDQGRKKKKYVDIGCLVVSRKLFVWTLGVLLAAAVFAGVVAGIAKAIPRRHRPPPPPDDYTVALHKALMFFNAQRSGKLPKHNNVPWRGNSCMKDGLSDPAVRRSLVGGYYDAGNAVKFNFPAAFSMTLLSWSVIEYSAKYEAVGELGHVRDIIKWGADYFLKTFNSTANSIDRVIAQVGSAATSPGSTQPNDHYCWMRPEDIDYPRPVVECHACSDLAAEMAAALAAASIVFRDNKAYSQKLVHGATTLFQFARDRRGRYSAGGSDAAKFYNSTSYWDEFVWGSSWMYLATGNSSYLTLATHPKLAKHAGAFWGGPDYGVFSWDNKLTGAQVLLSRLRLFLSPGYPYEEMLRTFHNQTSIIMCSYLPIFKSFNRTKGGLIQLNHGKPQPLQYVANAAFLASVFSDYLEAADTPGWYCGPHFYSIEVLRGFARTQIEYILGKNPLKMSYVVGFGKHYPKHVHHRGASIPKNGVHYGCKGGWKWRDTKKPNPNIIVGAMVAGPDRHDGFKDARKNYNYTEATLAGNAGLVAALVALSGESHGVDKNTMFSAVPPMFPSPPPPSAPWKP

SEQ ID NO: 18160 - protein, 618 aa, Sorghum bicolor
MYGRDPWGGPLEICHPDSATDDDRSRNLDIDRGAMSRTLDETQQSWLLAGPGDQARKKKKYVDIGCLVVSRKLFVWTLGVLLAAAVFAGVVAGIAKAIPRRHRPPPPPDDYTVALHKALMFFNAQRSGKLPKHNNIPWRGNSCMKDGLSDPAVRRSLVGGYYDAGGAVKFNFPAAFSMTLLSWSVIEYSAKYDAVGELGHVRDIIKWGSDYFLKTFNSTADSIDRVIAQVGSAAMSPGSTQPNDQYCWMRPEDIDYPRPVVECHACSDLAAEMAAALAAASIVFKDNKAYSQKLVHGATTLFQFARERRGRYSAGGSDATKFYNSTSYWDEFVWGSSWMYLATGNSSYLTLATHPKLAKHAGAFWGGPDYGVFSWDNKLTGAQVLLSRLRLFLSPGYPYEEMLRAFHNQTSIIMCSYLPIFKSFNRTRGGLIQLNHGKPQPLQYVVNAAFLASVFSDYLEAADTPGWYCGPHFYSIEVLRSFARTQIEYILGKNPLKMSYVVGFGNHYPKHVHHRGASIPKNGVHYGCKGGWKWRDTKKPNPNIIVGAMVAGPDRHDRFKDARKNYNYTEATLVGNAGLVAALVALSGEGHGVDKNAMFSAVPPMFPSPPPPPAPWKP

SEQ ID NO: 18161 - protein, 617 aa, Panicum virgatum
MYGRDPWGGPLEICHDSATDDDRSRNLDIDRGALSRTLDETQQSWLLAGPGDQGRRRKKYLDIGCLVVSRKFFVWTLGVLLAAAVFAGVVAGIAKAIPRRHRPPPPPDDYTVALHKALMFFNAQRSGKLPKHNNVPWRGNSCMKDGLSDPAVRRSLVGGYYDAGDAVKLNFPAAFSMTLLSWSVIEYSAKYEAVGELDHVRDIIKWGADYFLKTFNSTADSIDRVVVQVGSAATSPGSTQPNDHYCWMRPEDIDYPRPVVECHACSDLAAEMAAALAAASIVFKDNKAYSQKLVHGAATLFQFARDRRGRYSAGSSDAAKLYNSTGYWDEFVWGSSWMYLATGNSSYLTLATNPKLAKHAGAFWGGPDYGVFSWDNKLAGAQVLLSRLRLFLSPGYPYEEMLRTFHNQTSIIMCSYLPIFKSFNRTKGGLIQLNHGKPRSLQYVVNAAFLASVFSDYLEAADTPGWYCGPHFYSIEVLRSFARTQIEYILGKNPLKMSYVVGFGKHYPKHVHHRGASIPKNGVHYGCKGGWKWRDTKKPNPNIIVGAMVAGPDRHDGFKDARKNSNYTEATLAGNAGLVAALVALSGEGHGVDKNTMFSAVPPMFPSPPPPPAPWKP

SEQ ID NO: 18162 - protein, 618 aa, Zea mays
MYGRDPWGGPLEICHDSATDDDRSRNLDIDRAALSRTLDETQQSWLLAGTADQPRKKNKYVDIGCLLVSRKLFVWTLGVLLAAAVFAGAVAGIAKAIPRRHRPLPPPDDYTVALHKALMFFHAQRSGKLPKHNNIHWRGNSCMKDGLSDPAVRRSLVGGYYDAGDAVKFNFPAAFSMTLLSWSVIEYSAKYDAVGELGHVRDIIKWGSDYFLKTFNSTADSIDRVIAQVGGGATSPGSTQPNDRYCWMRPEDIDYPRPVVECHACSDLAAEMAAALAAASIVFKDNKAYSQKLVHGATTLFQFARDRRGRYSAGGSYAAKFYNSTSYWDEFLWGSSWMYLATGNSSYLTLATNPKLAKHAGAFWGGPDYGVFSWDNKLTGAQVLLSRLRLFLSPGYPYEEILRTFHNQTSIIMCSYLPVFKSFNRTRGGLIQLNHGKPRPLQYVVNAAFLASVFSDYLEAADTPGWYCGPHFYSVEVLRSFARTQIDYILGKNPLKMSYVVGFGKRYPRHVHHRGASIPKNGVHYGCKGGWKWRDAKKPNPNTIAGAMVAGPDRHDGFKDARRNYNYTEATLAGNAGLVAALVALSGEGHGGVDKNTMFSAVPPMFPSPPPPPAPWKP

SEQ ID NO: 18163 - protein, 619 aa, Brachypodium distachyon
MYGRDPWGGPLEICHDSATDDDRSRNLDLDRGALSRTLDETQQSWLLAGPGDQARKKKYVDLGCLVVSRKLFVWTVGVLVAAAAFAGIVAGIAQAIPKHHPQPPPPDEYTVALRKALMFFNAQKSGKLPKHNNVPWRGDSCLKDGSSDQAFRRDLSGGYYDGGEATKYNFPAAFSMTLLSWSVIEYSAKYEAAGELGHVRDTIKWGADYLLKTFNSTADTIDRLVAQVGSGAVSPGSTQPNDRYCWMRPEDIDYPRPVVECRACPDLAAEMAAALAAASIVFKDNKAYSHKLVHGATTLWKFARDRGKRGMYNAGISDATKFYNSTNYFDEIVWGGSWMYLATGNTSYLELATNPTLAKNAGAYKLDQHTGVFSWENKLPGAQVLLSRLRLFLSPGYPYEEMLRTFHNQTCIMMCSYLPVFKSFNRTKGGLIQLNHGNPKPLQYVVNAAFLASVFSDYLDAADTPGWYCGPHFYSVEVLRSFARTQIEYILGKNPLKMSYVVGYGNHYPKHVHHRGASIPKKKGVHYGCKEGWKWRDSKKPNPHIVVGAMVAGPDRHDRFKDVRKNYNYTEATLAGNAGLVTALVALSGEAHGLDKNTMFSAVPPMFPSPPPPPAPWKP

SEQ ID NO: 18164 - protein, 622 aa, Hordeum vulgare
MSMYGRDPWGGPLEICHDSATDDDRSRNLDLDRAALSRTLDETQQSWLLAGPGDQGRKKKRYVDLGCLLVSRKLFLWTLGLLLAAAALAGIAAGIAKAVPRHHAPPTPPDQFTLALRKALMFFNAQKSGKLPKHNNVPWRGDSCLKDGRSDEAFRRDLSGGYYDGGGAVKFNFPSAFSMTLLSWSVIEYSTKYEAAGELGHVRDTIKWGADYLLKTFNSTAHSIDRLVAQVGSAAISPGSSQPNDHYCWMRPEDIDYPRPVTECHTCPDLGAEMAAALAAASIVFKDNRAYSHKLLHGATTVWEFARKGGSRSAYSALRSDAAKFYNSTGYWDEYMWGGSWMYLATGNSSYLQFATSVELAKNVHVFSRPPNYGVFSWDNKLPGAQVLLSRLRLFLSPGYPYEEMLRTYHNQTSTIMCSYLPDFRSFNRTKGGLIQLNHGQPQPLQYVVNAAFLASLFSDYLEAADTPGWYCGPHFYSIEVLRSFARTQMEYILGKNPLKMSYVVGHGKHYPKRVHHRGASIPKKKGIHPGCKGGWTWRDTKKPNPHIIVGAMVAGPDRHDGFKDIRKNRNYTEPTLAGNAGLVAALVALSGEGHGVDKNTMFSAVPPMFPSPPPPPAPWKP

SEQ ID NO: 18165 - protein, 620 aa, Hordeum vulgare
MYGRDPWGGPLEICHDSATDDDRSRNLDLDRAALSRTLDETQQSWLLAGPGDQGRKKKRYVDLGCLLVSRKLFLWTLGLLLAAAALAGIAAGIAKAVPRHHAPPTPPDQFTLALRKALMFFNAQKSGKLPKHNNVPWRGDSCLKDGRSDEAFRRDLSGGYYDGGGAVKFNFPSAFSMTLLSWSVIEYSTKYEAAGELGHVRDTIKWGADYLLKTFNSTAHSIDRLVAQVGSAAISPGSSQPNDHYCWMRPEDIDYPRPVTECHTCPDLGAEMAAALAAASIVFKDNRAYSHKLLHGATTVWEFARKGGSRSAYSALRSDAAKFYNSTGYWDEYMWGGSWMYLATGNSSYLQFATSVELAKNVHVFSRPPNYGVFSWDNKLPGAQVLLSRLRLFLSPGYPYEEMLRTYHNQTSTIMCSYLPDFRSFNRTKGGLIQLNHGQPQPLQYVVNAAFLASLFSDYLEAADTPGWYCGPHFYSIEVLRSFARTQMEYILGKNPLKMSYVVGHGKHYPKRVHHRGASIPKKKGIHPGCKGGWTWRDTKKPNPHIIVGAMVAGPDRHDGFKDIRKNRNYTEPTLAGNAGLVAALVALSGEGHGVDKNTMFSAVPPMFPSPPPPPAPWKP

SEQ ID NO: 18166 - protein, 620 aa, Secale cereale
MYGRDPWGGPLEICHDSATDDDRSRNLDLDRAALSRTLDETQQSWLLAGPGDQGRKKKRYVDLGCLLVSRKLFLWTLGLLLAAAALAGIAAGIAKAVPRHQTPPTPPDQFTLALRKALMFFNAQKSGKLPKHNNVPWRGDSCLKDGRSGETVRRDLSGGYYDGGSAMKFNFPSAFSMTLLSWSVIEYNAKYEAAGELGHVRDTIKWGADYLLKTFNSTAHSIDRLVAQVGSAAMSPGSSLPNDHYCWMRPEDIDYPRPVTECHTCPDLGAEMAAALAAASIVFKDNRAYSHKLLHGATTVWDFARKGGSRTVYSLPGSDAAKFYNSTGYWDEYMWGGSWMYLATGNSSYLQFATSAELANHAHVYSRPANYGVFSWDNKLPGAQVLLSRLRLFLSPGYPYEEMLRTYHNQTSIIMCSYLPNFRSFNRTKGGLIQLNHGQPQPLQYVVNAAFLASLFSDYLEAADTPGWYCGPHFYSIEVLRSFARTQMEYILGKNPLKMSYVVGHGKHYPKHVHHRGASIPKKKGVHPGCKGGWTWRDTKKPNPHILVGAMVAGPDRHDGFKDVRKNRNYTEPTLAGNAGLVAALVALSGEGHGVDKNTMFSAVPPMFPSPPPPPAPWKP

SEQ ID NO: 18167 - protein, 621 aa, Musa acuminata
MSIYGRDPWGGPLEIHADSATDDDRSRNLDLDRAALSMTSRQLDETQQSWLLAGPGDKGKKKKKYVDLGCLIVSRKIFLWTVGAVVAAAALAGLITLIVKTVPHHHRPRPPPDNYTLALHKALMFFNAQRSGRIPKHNNVSWRGNSGMKDGFSDPSYGRSLVGGFYDAGDAIKFNFPASFAMTMLSWSVIEYSAKYEAAGELVHVKEIIKWGVDYLLKTFNSSADTIDRVAAQVGQGATSGGTNPNDHYCWTRPEDIDYPRPVYVCHSCSDLTAEMAASLASASIVFKDNKAYSQKLVHGAATLWKFAREQRGRYSEGGSDASVFYNSTSYWDEFVWGGAWMYLATGNSSYLQLSTHPKLAKHAGAFWGGPDYGVLSWDNKLTGAQVLLSRLRLFLSPGYPYEEMLRTFHNQTGIIMCSYLPVFNSFNRTKGGLIQLNHGRPQPLQYVVNAAFLASLYSDYLEAADTPGWYCGPNFFPTGALRDFARTQIDYILGKNPKKMSYVVGFGQRYPKHVHHRGASIPKNGVKYNCKGGWKWRDTKKPNPNTIIGAMVAGPDKHDGFHDIRTNYNYTEPTLAGNAGLVAALVALSGESTGVDKNTIFSAVPPMFPSPPPPPAPWRP

SEQ ID NO: 18168 - protein, 620 aa, Triticum aestivum
MYGRDPWGGPLEICHDSATDDDRSRNLDLDRAALSRTLDETQQSWLLAGPGDQGRKKKRYVDLGCLLVSRKLFLWTLGLLLAAAALAGIAAGIAKAVPRHQAPPAPLDQFTLALRKALMFFNAQKSGKLPKHNNVPWRGDSCLKDGRSDQTSRRDLSGGYYDGGSAVKFNFASAFSMTLLSWSVIEYNAKYEAAGELGHVRDTIKWGADYLLKTFNSTAHSIDRLVAQVGGAAMSDGPSQPNDHYCWMRPEDIDYPRPVTECHTCPDLGAEMAAALAAASIVFKDNRVYSHKLLHGATTVWDFARKGGSRQTYSLPRSDAAKFYNSTAYWDEYIWGGSWMYLATGNSSYLQFATDAKLAKNAHIYSRPPNYGVFSWDNKLPGAQVLLSRLRLFLSPGYPYEEMLRTYHNQTSTIMCSYLPDFRSFNRTKGGLIQLNHGQPQPLQYVVNAAFLASLFSDYLEAADTPGWYCGPHFYSIEVLRSFARTQMEYILGKNPLKMSYVVGHGKHYPKRVHHRGASIPKKKGVHPGCKGGWTWRDTKKPNPHIIVGAMVAGPDRHDGFKDVRKNRNYTEPTLAGNAGLVAALVALSGEGHGVDKNTMFSAVPPMFPSPPPPPAPWKP

SEQ ID NO: 18169 - protein, 618 aa, Musa acuminata
MYGRDPWGGPLEIHADSATDDDRSRNLDLDRAALSMTSRQLDETQQSWLLAGPGDQGKKKKYVDLGCLIVSRKLFLWSLGAVVAAAALAGLITLIVKTVPRHHRPRPPPDNYTLALHKALMFFNAQRSGPIPKHNNVSWRGNSGMKDGISDPSYGKSLVGGFYDAGDAIKFNFPASFAMTMLSWSVIEYSAKYDAAGELGHVKEIIKWGVDYLLKTFNSSADTIDRIATQVGQGATSGGANPNDHYCWTRPEDIDYPRPVYECHSCSDLAAEMAAALAAASIVFKDNKAYSQKLVHGAATLWKFSRNQRGRYSEGGSDASIFYNSTSYWDEFVWGGAWMYLATGNASYLQLSTHPKLAKHAGAFWGGPDYGVLSWDNKLTGAQVLLSRLRLFLSPGYPYEEMLRTFHNQTGIVMCSYLPVFNSFNRTKGGLIQLNHGRPQPLQYVVNVAFLASVYSDYLEASDTPGWYCGPNFFPAGVLRDFARTQIDYILGKNPQKMSYVVGFGKRYPKHVHHRGASIPKNGVKYSCKGGWKWRDTKKPNPNTIFGAMVAGPDRQDGFRDVRTNYNYTEPTLAGNAGLVAALVSLSGESTGVDKNTMFSAVPPMSPTPPPPPAPWRP

SEQ ID NO: 18170 - protein, 620 aa, Elaeis guineensis
MYGRDPWGGPLEISNADSATDDDRSRNLDLDRAALSTSSRPLDETQQSWLLAGPGDQGKKKKKYVDLGCLIVSRKLFIWTVGTIVATAALAGFITLIVKTVPRHHHPKPPPDNYTLALHKALMFFNAQRSGRLPKHNNVSWRGNSGMKDGISDTSYGRSLVGGFYDAGDAIKFNFPASFAMTMLSWSVIEYSAKYEAAGELNHVKEIIKWGTDYLLKTFNNSADTIDRIAAQVGVGDTSGGTTPNDHYCWMRPEDIDYPRPVYVCHSCSDLAAEMAAALAAASIVFKDNKAYSQKLVHGAATVWKFAREQRGRYSPQGSDPSLFYNSTSYWDEFVWGGAWMYLATGNSSYLYLSTHPTLAKHAGAFWGGPDYGVFSWDNKLIGAQVLLSRLRLFLSPGYPYEEILRTFHNQTSIVMCSYLPIFTSFNRTKGGLIELNHGRPQPLQYVVSAAFLAAVYSDYLDAADTPGWYCGPNFYSTGVLRNFAQTQIDYVLGKNPRKMSYVVGFGNRYPKHVHHRAASIPKNGVKYSCKGGWKWRDTKKPNPHTIVGAMVAGPDRRDGFRDVRTNYNYTEPTLAGNAGLVAALVALSGEKSGVDKNTIFSAVPPMFPTPPPPPAPWKP

SEQ ID NO: 18171 - protein, 620 aa, Cocos nucifera
MYGRDPWGGPLEISNADSATDDDRSRNLDLDRAALSTSSRPLDETQQSWLLAGPGDQGKKKKKYVDLGCLIVSRKLFIWTVGTIVATAALAGFITLIVKTVPRHHHPKPPPDNYTLALHKALMFFNAQRSGRLPKHNNVSWRGNSGMKDGISDTSYGRSLVGGFYDAGDAIKFNFPASFAMTMLSWSVIEYSAKYEAAGELNHVKEIIKWGTDYLLKTFNNSADTIDRIAAQVGVGDTSGGTTPNDHYCWMRPEDIDYPRPVYVCHSCSDLAAEMAAALASASIVFKDNKAYSQKLVHGAATVWKFARDQRGRYSPPGSDPSLFYNSTSYWDEFVWGGAWMYLATGNSSYLYLSTHPTLAKHAGAFWGGPDYGVFSWDNKLIGAQVLLSRLRLFLSPGYPYEEILRTFHNQTSIVMCSYLPIFTSFNRTKGGLIELNHGRPQPLQYVVSAAFLAAVYSDYLDAADTPGWYCGPNFYSAGVLRNFAQTQIDYVLGKNPRKMSYVVGFGNRYPKHVHHRAASIPKNGVKYSCKGGWKWRDTKKPNPHTIVGAMVAGPDRRDGFRDVRTNYNYTEPTLAGNAGLVAALVALSGEKSGVDKNTIFSAVPPMFPTPPPPPAPWKP

SEQ ID NO: 18172 - protein, 617 aa, Platanus occidentalis
MYGRDPWGGPLEINAADSATDDDRSRNLQDFDRAALSSRPLDETQQSWLLGPGEQKKKKYVDLGCIIVSRKIFVWTVGTLLAAGFLAGLITLIVKTVPRHHRPHPPPDNYTLALHKALMFFNAQRSGPLPKHNNVSWRGNSGMKDGLSDNSVNKNLVGGYYDAGDAIKFNFPSSFAMTMLSWSVIEYSAKYEAAGELNHIKETIKWGTDYLLKTFNSSADTIDKVAAQVGIGDTSGGSTSPNDHYCWVRPEDIDYPRPVYECHACSDLAAEMAAALAAASIVFKDSKTYSQKLVHGAKTLFKFSREQRSRYSPGGSDPSIFYNSTSYWDEFVWGGAWLYYATGNSSYLQLATTPGLAKHAGAFWGGPDYGVLSWDNKLAGAQVLLSRLRLFLSPGYPYEEILRTFHNQTSIIMCSYLPVFTSFNRTKGGLIQLNHGRPQPLQYVVNAAFLATLYSDYLEAADTPGWYCGPNFYSTEVLRDFAKTQIDYILGKNPRKMSYVVGFGNHFPKHVHHRGASIPKNRIRYNCKGGWKWRDSPRPNPNTIVGAMVAGPDKHDGFRDVRTNYNYTEPTLAGNAGLVAALVALSGDKTGIDKNTIFSAVPPMFPTPPPPPAPWKP

SEQ ID NO: 18173 - protein, 620 aa, Elaeis guineensis
MYGRDPWGGPLEISNADSATDDDRSRNMDLDRAALSTSSRPLDETQQSWLLAGPGDQGKTKKKYVDLGCLIVSRKLFIWTVGIIVAVAALAGFITLIVKTVPRHHHPQPPPDNYTLALRKALMFFNAQRSGRLPKHNNVSWRGNSGMKDGISDPSYGRSLVGGFYDAGDAIKFNFPASFAMTMLSWSVIEYSAKYEAAGELNHVKEIIKWGTDYLLKTFNNSADTIDRIAAQVGIGDTSGGTTPNDHYCWMKPEDIDYPRPVYVCHSCSDLAAEMAAALAAASIVFKDNKAYSQKLVHGAATVWKFAREQRGRYSPRGSDPSLFYNSTSYWDEFVWGGSWMYLATGNSSYLYLSTHPTLAKHAGAFWGGPDYGVFSWDNKLPGAQILLSRLRLFLSPGYPYEEILRTFHNQTSIIMCSYLPVFTSFNRTKGGFIELNHGRPQPLQYIVNAAFLAAVYSDYLDAADTPGWYCGPNFYSTGVLRDFARTQIDYILGKNPHKMSYVVGFGNHYPKHVHHRGASIPKNGVRFSCKGGWKWRDTKKPNPHTIAGAMVAGPDRHDGFRDVRTNYNYTEPTLAGNAGLVAALVALSGEKNGVDKNTIFSAVPPMFPTPPPPPAPWKP

SEQ ID NO: 18174 - protein, 623 aa, Cocos nucifera
MYGRDPWGGPLEILNADSATDDDRSRNLDLDRAALSTSSRPLDETQQSWLLAGPGDQAKTKKKYVDLGCLIVSRKLFMWTVGTIVAVAALAALAGFITLIVKTVPRHHRPQPPPDNYTLALHKALMFFNAQRSGRLPKLNNVSWRGNSGMKDGISDPSYGRSLVGGFYDAGDAIKFNFPASFAMTMLSWSVIEYSAKYEAAGELNHVKEIIKWGTDYLLKTFNNSADTIDRIAAQVGTGDTSGGTTPNDHYCWMKPEDIDYPRPVYVCHSCSDLAAEMAAALAAASIVFKDNKAYSQKLVHGAATVWKFAREQRGRYSPRGSDPSLFYNSTSYWDEFVWGGAWMYLATGNSSYLYLSTHPTLAKHAGAFWGGPDYGVFSWDNKLPGAQVLLSRLRLFLSPGYPYEEILRTFHNQTSIIMCSYLPIFTSFNRTKGGFIELNHGRPQPLQYIVNAAFLAAVYGDYLDAADTPGWYCGPNFYSTGVLRDFARTQIDYILGKNPHKMSYVVGFGNHYPKHVHHRGASIPKNGVRYSCKGGWKWRDTKKPNPHTITGAMVAGPDRHDGFRDVRTNYNYTEPTLAGNAGLVAALVALSGEKNGVDKNTIFSAVPPKFPTPPPPPAQWKP

SEQ ID NO: 18175 - protein, 619 aa, Gossypium hirsutum
MYGRDPWGGPLEINATDSATDDDRSRNLQDLDRAALSRPLDETQQSWLLGPGEQKKKKKYVDLGCIIVSRKIFVWTVGTLLVSALLAGLITLIVKTVPRHHHRHSPPDNYTLALHKALMFFNAQRSGKLPKHNNVSWRGNSGLQDGKSDPSVLMKDLVGGYYDAGDAIKFNFPASFSMTMLSWSVIEYSAKYEAAGELNHVKEIIKWGTDYLLKTFNNTADTIDRIAAQVGIGDTSGGSSAPNDHYCWMRPEDIDYPRPVYECHSCSDLAAEMAAALASASIVFKDNKAYSQKLVHGARTLFKFARDQRGRYSAGGSDPALFYNSSSYWDEFVWGGAWLYYATGNSSYLQLATHPKLAKHAGAFWGGPDYGVLSWDNKLAGAQVLLSRLRLFLSPGYPYEEILSTFHNQTSIIMCSFLPVFTSFNRTKGGLIQLNHGRPQPLQYVVNAAFLAALYSDYLDAADTPGWYCGPNFYSTDVLREFAKTQIDYILGKNPRKMSYVVGFGNHYPKHVHHRGASIPKNKIKYNCKGGWKWRDTSKPNPNTLVGAMVAGPDKHDGFRDVRTNYNYTEPTLAGNAGLVAALVALSGDKATGIDKNTIFSAVPPMFPTPPPPPAPWKP

SEQ ID NO: 18176 - protein, 619 aa, Gossypium raimondii
MYGRDPWGGPLEINATDSATDDDRSRNLQDLDRAALSRPLDETQQSWLLGPGEQKKKKKYVDLGCIIVSRKIFVWTVGTLLVSALLAGLITLIVKTVPRHHHRHSPPDNYTLALHKALMFFNAQRSGKLPKHNNVSWRGNSGLQDGKSDPSVLMKDLVGGYYDAGDAIKFNFPASFSMTMLSWSVIEYSAKYEAAGELNHVKEIIKWGTDYLLKTFNNTADTIDRIAAQVGIGDTSGGVSAPNDHYCWMRPEDIDYPRPVYECHSCSDLAAEMAAALASASIVFKDNKAYSQKLVHGARTLFKFARDQRGRYSAGGSDPALFYNSSSYWDEFVWGGAWLYYATGNSSYLQLATHPKLAKHAGAFWGGPDYGVLSWDNKLAGAQVLLSRLRLFLSPGYPYEEILSTFHNQTSIIMCSFLPVFTSFNRTKGGLIQLNHGRPQPLQYVVNAAFLAALYSDYLDAADTPGWYCGPNFYSTDVLREFAKTQIDYILGKNPRKMSYVVGFGNHYPKHVHHRGASIPKNKIKYNCKGGWKWRDTSKPNPNTLVGAMVAGPDKHDGFRDVRTNYNYTEPTLAGNAGLVAALVALSGDKATGIDKNTIFSAVPPMFPTPPPPPAPWKP

SEQ ID NO: 18177 - protein, 619 aa, Gossypium hirsutum
MYGRDPWGGPLEINATDSATDDDRSRNLQDLDRAALSRPLDETQQSWLLGPGEQKKKKKYVDLGCIIVSRKIFVWTVGTLLVSALLAGLITLIVKTVPRHHHRHSPPDNYTLALHKALMFFNAQRSGKLPKHNNVSWRGNSGLQDGKSDPSVLMKDLVGGYYDAGDAIKFNFPASFSMTMLSWSVIEYSAKYEAAGELNHVKEIIKWGTDYLLKTFNNTADTIDRIAAQVGIGDTSGGVSAPNDHYCWMRPEDIDYPRPVYECHSCSDLAAEMAAALASASIVFKDNKAYSQKLVHGARTLFKFARDQRGRYSAGGSDPALFYNSSSYWDEFVWGGAWLYYATGNSSYLQLATHPKLAKHAGAFWGGPDYGVLSWDNKLAGAQVLLSRLRLFLSPGYPYEEILSTFHNQTSIIMCSFLPVFTSFNRTKGGLIQLNHGRPQPLQYVVNAAFLAALYSDYLDAADTPGWYCGPNFYSTDVLREFAKTQIDYILGKNPRKMSYVVGFGNHYPKHVHHRGASIPKNKIKYNCKGGWKWRDTSKPNPNTLVGAMVAGPDKHDGFRDVRTNYNYTEPTLAGNAGLVAALVALSGDKATVIDKNTIFSAVPPMFPTPPPPPAPWKP

SEQ ID NO: 18178 - protein, 619 aa, Gossypium raimondii
MYGRDPWGGPLEINAADSATDDDRSRNLQDLDRAALSRPLDETQQSWLLGPSEQKKKKKYVDLGCIIVSRKIFVWTVGTLVVSAVLAGLITLIVKTVPRHHHGKPPPDNYTLALHKALMFFNAQRSGKLPKHNNVSWRGNSCLRDGKSDPGTTMKDLVGGYYDAGDAIKFNFPASFAMTMLSWSVIEYSAKYEAAGELNHVKEIIKWGTDYLLKTFNNSADTIDKIAAQVGVGDTSGGSTTPNDHYCWMRPEDIDYPRPVYECHSCSDLAAEMAAALAAASIVFKDNKAYSQKLVHGARTVFQFARDQRGRYSAGGSDPALFYNSSSYWDEFVWGGAWLYYATGNSSYLQLATHPKLAKHAGAFWGGPDYGVLSWDNKLAGAQVLLSRLRLFLSPGYPYEEILRTFHNQTSIVMCSFLPVFTSFNRTKGGLIQLNHGRPQPLQYVVNAAFLAALYSDYLDAADTPGWYCGPNFYSTDVLREFAKTQMDYILGKNPRKMSYVVGFGNHYPKHVHHRGASIPKNKIRYNCKGGWKWRDSKKPNPNTLVGAMVAGPDKHDGFHDVRTNYNYTEPTLAGNAGLVAALVALSGDKSTGIDKNTIFSAVPPMFPTPPPPPAPWKP

SEQ ID NO: 18179 - protein, 444 aa, Oryza sativa
MLETKPPSPGTAGAAGVAGGGYHRRWAAPLLASVLLSSLLIAASLFFSSSRALLLSFSPLPSAASAEPLFVEAKLRQQQQMRGAAASGGRGRGAVPRIAYLVSGSAGDGAALRRTLRALYHPSNMYVVHLDLEAPATERAELAAAVRADPVYSRFRNVKVVTRANLVTYRGPTMVANTLHAAAILLREGGEWDWFINLSASDYPLVTQDDLLYVLSDLPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLNDFDGMVNSNAPFARKFGREDPVLDKIDQELLGRQPDGFVAGGWMDLLNTTTVKGSFTVERVQDLRPGPGADRLKKLVTGLLTQEGFDDKHCL

SEQ ID NO: 18180 - protein, 439 aa, Setaria italica
MLEAKPPSPGSGAAGAAAHIHGHRRWAAPLLASVLLSSLLISASLFFSSSRALLLSFSPLPSAASAEPLFVEAKLRQQMRAEDRPPRGAVPRIAYLVSGSAGDGAALRRTLRALYHPANTYVVHLDLEAPAAERAELAAAIRSDPVYARFRNVKVVTRANLVTYRGPTMVANTLHAAAILLREGGDWDWFINLSASDYPLVTQDDLLHVLSELPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLDDFDGMVNSNAPFARKFGREDPVLDKIDQELLGRQPDGFVPGGWTDLLNTTEKGGPFTVEHVQDLRPGPGVDRLKKLVTGLLTQEGFDDKHCL

SEQ ID NO: 18181 - protein, 439 aa, Saccharum officinarum
MLEAKPPSPGSGAAGAAAHIHGHRRWAAPLLASVLLSSLLISASLFFSSSRALLLSFSPLPSAASAEPLFVEAKLRQQMRAEERPARGAVPRIAYLISGSAGDGAALRRTLRALYHPANTYVVHLDLEAPAAERAKLASAVRADPVYARFRNVKVVTRANLVTYRGPTMVANTLHAAAILLREGGDWDWFINLSASDYPLVTQDDLLHVLSELPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLADFDGMVNSNAPFARKFGREDPVLDKIDQELLGRQPDGFVPGGWTDLLNTTEKGKPFTVERVQDLRPGPGVDRLKKLVTGLLTQEGFDDKHCL

SEQ ID NO: 18182 - protein, 440 aa, Sorghum bicolor
MLEAKPPSPGSGAAGAAAAHIHSHRRWAAPLLASVLLSSLLISASLFFSSSRALLLSFSPLPSAASAEPLFVEAKLRQQMRAEERPARGAVPRIAYLISGSAGDGAALRRTLRALYHPANTYVVHLDLEAPAAERAELAAAVRADTVYARFRNVKVVTRANLVTYRGPTMVANTLHAAAILLREGGDWDWFINLSASDYPLVTQDDLLHVLSELPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLADYDGMVNSNAPFARKFGREDPVLDKIDQELLGRQPDGFVPGGWTDVLNTTEKGKPFTVERVQDLRPGPGVDRLKKLVTGLLTQEGFDDKHCL

SEQ ID NO: 18183 - protein, 439 aa, Zea mays
MLEAKPPSPGSGAAGAAAHIHGHRRWAAPLLASVLLSSLLITASLFFSSSRALLLSFSPLPSAASAEPLFVEAKLRQQMRAEERPTRGAVPRIAYLISGSAGDGAALRRTLRALYHPVNTYVVHLDLEAPAAERAELASAIHADPVYARFRNVKVVTRANLVTYRGPTMVANTLHAAAILLREGGNWDWFINLSASDYPLVTQDDLLHVLSELPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLADFDGMVNSNAPFARKFGREDPVLDKIDQELLARRPDGFVPGGWTDLLNTTEKGKPFTVERVQDLRPGPGVDRLKKLVTGLLTQEGFDDKHCL

SEQ ID NO: 18184 - protein, 441 aa, Zea mays
MLEAKPPSPGSSGAAGAAAHIHAHRRWAAPLLASVLLSSILISASLFFSSSRALLLSFSPLPSAASAEPLFVEAKLRQQMRAEERPARGAVPRIAYLVSGSAGDGAALRRTLRALYHPANTYVVHLDLEAPAAERAELAAAVRADPVYARFRNVKVVTRANLVTYRGPTMVANTLHAAAILLREGGDWDWFINLSASDYPLVTQDDLLHVLSELPRQLNFIEHTSDIGWKEYQRAKPVIIDPGLYSLQKSDVFWITEKRSVPTAFKLFTGSAWMVLTHQFIEYCIWGWDNLPRTVLMYYANFLSSPEGYFHTVICNVPEFRNTTVNHDLHFISWDNPPKQHPHYLTLADFDGMVNSNAPFARKFGREDPVLDKIDQELLGRRPDGFVPGGWTYLLNATTEEGRPFAVERVQDLRPGPGVDRLKKLVTGLLTQEGFDDKHCL

SEQ ID NO: 18185 - protein, 436 aa, Pennisetum glaucum
MLEAKPPSPGSGAAAHIHGHRRWAAPLLASVLLSSLLISASLFFSSSRALLLSFSPLPSAASAEPLFVEAKLRQQMRAEDRPPRGAVPRIAYLVSGSAGDGAALRRTLRALYHPANTYVVHLDLEAPAAERAELAAAIRSDPVYARFRNVKVVTRANLVTYRGPTMVANTLHAAAILLREGGDWDWFINLSASDYPLVTQDDLLHVLSELPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLDDFDGMINSNAPFARKFGREDPVLDKIDQDLLGRQPDGFVPGGWTDVLNTTEKGKPFTVERVQDLRPGPGVDRLKKLVTGLLTQEGFDDKHCL

SEQ ID NO: 18186 - protein, 437 aa, Secale cereale
MMETKPPSPGSGGASGALHHHRRWAAPLLASVLLSSLLISASLFFSSSRALLLSFSPLPSAAAAEPLFVEAKLRQQQQEAHARPHRAVPRIAYLVSGSAGDGVALRRTLRALYHPANRYVLHLDLEAPAAERADLAAAVRADPVYSRFRNVKVVTRANLVTYRGPTMVANTLHAAAILLRDGGDWDWFINLSASDYPLVSQDDLLFVLSGLPRELNFIEHTSDIGWKEYQRAKPVIVDPGLYSLQKSDVFWITEKRSVPTAFKLFTGSAWMMLTHRFIEYCIWGWDNLPRTVLMYYANFLSSPEGYFHTVICNVPEFRNTTVNHDLHFISWDNPPKQHPHYLTLNDFDGMLNSNAPFARKFGREDPVLDKIDQEILGRQPDGFVPGGWLDLLNTTVKGEHFSVERVQDLRPGPGADRIKKLVTGLLNEEGFDDKHCV

SEQ ID NO: 18187 - protein, 438 aa, Triticum aestivum
MMETKPPSPGSGGGSAPGVHHHRRWAAPLLASVLLSSLLISASLFFSSSRALLLSFSPLPSAAPGEPLFVEAKLRQQQQEARARPHRAVPRIAYLVSGSAGDGVALRRTLRALYHPANRYVLHLDLEAPAAERAELAAAVRADPVYSRFRNVKVVTRANLVTYRGPTMVANTLHAAAILLRDGGDWDWFINLSASDYPLVSQDDLLYVLSGLPRELNFIEHTSDIGWKEYQRAKPVIVDPGLYSLQKSDVFWITEKRSVPTAFKLFTGSAWMMLTHRFIEYCIWGWDNLPRTVLMYYANFLSSPEGYFHTVICNVPEFRNTTVNHDLHFISWDNPPKQHPHYLTLNDFDGMLSSNAPFARKFGREDPVLDKIDQEILGRQPDGFVPGGWLDLLNTTVKGKQFSVERVQDLRPGPGADRIKKLVTGLLTEEGFDDKHCV

SEQ ID NO: 18188 - protein, 408 aa, Echinochloa colona
ASVLLSSLLISASLFFSSSRALLLSFSPLPSAASAEPLFVEAKLRQQMRADDRPPRGAVPRIAYLVSGSAGDGAALRRTLRALYHPANTYVVHLDLEAPAAERADLAAAIRADPVYAKFRNVRVVTRANLVTYRGPTMVANTLHAAAILLREGGDWDWFINLSASDYPLVTQDDLLHVLSELPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLDDFDGMVNSNAPFARKFGREDPVLDKIDQELLGRRPDGFVPGGWTDLLNTTEKGRPFTVERVQDLRPGPGVDRLKKLVTGLITQEGFDDKHCL

SEQ ID NO: 18189 - protein, 400 aa, Triticum aestivum
LISASLFFSSSRALLLSFSPLPTAASAEPLFVEAKLRQQQQEAHARPHRAVPRIAYLVSGSAGDGVALRRTLRALYHPANRYVLHLDLEAPAAERAELAAAVRADPVYSRFRNVKVVTRANLVTYRGPTMVANTLHAAAILLRDGGDWDWFINLSASDYPLVSQDDLLYVLSGLPRELNFIEHTSDIGWKEYQRAKPVIVDPGLYSLQKSDVFWITEKRSVPTAFKLFTGSAWMMLTHRFIEYCIWGWDNLPRTVLMYYANFLSSPEGYFHTVICNVPEFRNTTVNHDLHFISWDNPPKQHPHYLTLNDFDGMLNSNAPFARKFGREDPVLDKIDQEILGRQPDGFVPGGWLDLLNTTVKGKHFSVERVQDLRPGPGADRIKKLVTGLLTEEGFDDKHCV

SEQ ID NO: 18190 - protein, 513 aa, Saccharum officinarum
METASFLSVALALAALVPVSLLLLNRLLYGKLPPGPRRRPVVGNLFDVQPVRCRCYQEWARRYGPIMTVWLGTSPTVVVSTSELAKEVLKTHDQQLADRCRDRSTESFSRGGQDLIWADYGPHYIKVRKLCNLELFTQRRLEALRPIREDEVTAMVESVYKAVTSPGNEGKPLVVKNHLSMVAFNNITRLAFGKRFVNAAGELDEQGREFKGIVHNGIKIGASLSIAQHIPWLRWLAPVDEQVFKAHGERRDRLTVKIMEEHAKALKQRGAQQHFVDALFTLRDKYDLSDDTVIGLLWDMITAGTDTTVISVEWAMAELLRNPRVQEKLQEELDHVVGRDRVLSETDFPNLPYLQAVVKESLRLHPPTPLMLPHRASASVKIAGYDIPKGANVVVNVWAVARDPAVWDSPLEFRPERFLRENIDIKGADFRVLPFGAGRRVCPGAQLGINLVASMIGHMLHHFRWTLPEGTRPEDVSMMESPGLVTFMATPLQAVATPRLDKEELYRRVPSEI

SEQ ID NO: 18191 - protein, 513 aa, Zea mays
METASFLSVALALAALVPVSLLLVNRLLYGKLPPGPRRRPVVGNLFDVQPVRCRCYQEWARRYGPIMTVWLGTSPTVVVSTSELAKEVLKTHDQQLADRCRDRSTESFSRGGQDLIWADYGPHYIKVRKLCNLELFTQRRLEALRPIREDEVTAMVESVYKAVTAPGSAGKPLVVKNHLSMVAFNNITRLAFGKRFVDAAGELDEQGREFKGIVHNGIKIGASLSIAQHIPWLRWLAPVDEQAFKAHGERRDRLTVKIMEEHARALKQRGAQQHFVDALFTLRDKYDLSDDTVIGLLWDMITAGTDTTVISVEWAMAELLRNPRVQEKLQEELDRVVGRDRVLSETDFPNLPYLQAVVKESLRLHPPTPLMLPHRASASVKIAGYDIPKGANVVVNVWAVARDPEVWDSPLEFRPERFLRENIDIKGADFRVLPFGAGRRVCPGAQLGINLVASMIGHMLHHFTWTLPSGTCPEDVSMMESPGLVTFMATPLQAVATPRLDKEELYRRVPSDV

SEQ ID NO: 18192 - protein, 509 aa, Leymus cinereus x Leymus triticoides
MDTATLLPVALALLAIPVTALLLNRLRFGKLPPGPRPWPVLGNLFQIQPVRCRCFAEWAGRYGPIMTVWFGSSPMVVVSTSELAQEVLKTHDQQLADRSRNRSSERFSRGGMDLIWADYGPHYIKVRKFCNLELFTPRRLEALRPIREDEVTAMVESVYRAGKEGKPVAVREFLAMVGFNNITRLAFGKRFLNAAGELDEQGREFKEIVNNGIKIGASLSIAEHIRWLRWLTPVDEVAYQAHGDRRDRLTVKIMEEHARALERSGTSKQHFVDALFTLREKYDLSDDTVIGLLWDMITAGTDTTVITVEWAVGELVRNPMVQQKVQEELDRVVGRDRVLSETDFPNLPYLQAVVKESLRLHPPTPLMLPHRASAAVKVAGYDIPKGASVTVNVWAIARDPKVWDSPLEFRPERFLHENIDIKGCDYRVLPFGAGRRVCPGAQLGINLVASMIGHLLHHFTWALPDGTRTEDLDMMESPGLITFMRTPLQVVATPRLEKEELYKRVPVEM

SEQ ID NO: 18193 - protein, 509 aa, Triticum aestivum
MDTATLLPVALALLAIPVTALLLNRLRFGRLPPGPRPWPVLGNLFQIQPVRCRCFAEWAARYGPIMTVWFGSTPMVVVSTPELAQEVLRTHDQHLADRSRNRSSERFSRGGMDLIWADYGPHYIKVRKLCNLELFTPRRLEALRPVREDEVTAMVESVHAAGKGGRPVAVREFLAMVGFNNITRLAFGKRFLTAAGELDEQGREFKEIVNNGIKIGASLSIAEHIRWLRWLTPVDEVAYQAHGDRRDRLTVKIMEEHARALERSGASKQHFVDALFTLRDKYDLSDDTVIGLLWDMITAGTDTTVITVEWAVAELVRNPMVQQKVQEELDRVVGRDRVLSETDFPNLPYLQAVVKESLRLHPPTPLMLPHRASAAVKVAGYDIPKGASVTVNVWAIARDPKAWDSPLEFRPERFLHDNIDIKGCDYRVLPFGAGRRVCPGAQLGINLVASMIGHLLHHFTWALPDGTRTEDLDMMESPGLITFMRTPLQVVATPRLEKEELYKRVAAEM

SEQ ID NO: 18194 - protein, 594 aa, Setaria italica
MITGADFYHVMTAMVPLYVAMILAYGSVRWWRIFSPDQCSGINRFVALFAVPLLSFHFISTNNPYTMNLRFIAADTLQKLMVLAMLTAWSHLSRRGSLEWTITLFSLSTLPNTLVMGIPLLKGMYGDFSGSLMVQIVVLQCIIWYTLMLFMFEYRGARMLITEQFPDTAGAIASIVVDPDVVSLDGRRDAIETEAEVKEDGKIHVTVRRSNASRSDIYSRRSMGFSSTTPRPSNLTNAEIYSLQSSRNPTPRGSSFNHNDFYSMVGRSSNFGAADAFGIRTGATPRPSNYEDDASKPKYPLPVVNAAPGAGHYPAPNPAVAAAPKGAKKAATNGQAKGEDLHMFVWSSSASPVSDVFGGGAPDYNDAAAAKSPRKMDGAKERDDYVERDEFSFGNRGAMDRDAEAGDEKAAVAGGGDPNAVAAPTAMPPTSVMTRLILIMVWRKLIRNPNTYSSLIGLIWSLVCFRWNFEMPAIVLKSISILSDAGLGMAMFSLGLFMALQPRIIACGNKVATFAMAVRFLTGPAVMAAASFAVGLRGTLLHVAIVQAALPQGIVPFVFAKEYNVHPDILSTAVIFGMLIALPITLVYYILLGL

SEQ ID NO: 18195 - protein, 595 aa, Zea mays
MITGTDFYHVMTAVVPLYVAMILAYGSVRWWRIFSPDQCSGINRFVALFAVPLLSFHFISTNNPYTMNLRFIAADTLQKLMVLAMLTAWSHLSRRGSLEWTITLFSLSTLPNTLVMGIPLLKGMYGDFSGSLMVQIVVLQCIIWYTLMLFMFEYRGARMLITEQFPDNAGAIASIVVDPDVVSLDGRRDAIETEAEVKEDGRIHVTVRRSNASRSDIYSRRSMGFSSTTPRPSNLTNAEIYSLQSSRNPTPRGSSFNHNDFYSMVGRSSNFGAADAFGIRTGATPRPSNYEDDASKPKYPLPVVNATSGAGAAHYPAPNPAVAAAPKGARKAATNGQAKGEDLHMFVWSSSASPVSDVFGGGAPDYNEAAAAKSPRKMDGGKDRDDYVERDEFSFGNRGAMDRDAEAGDGKAAAAGGDPSTVAAPTAMPPTSVMTRLILIMVWRKLIRNPNTYSSLIGVIWSLVCFRWNFQMPAIVLQSISILSDAGLGMAMFSLGLFMALQPRIIACGNKVATFAMAVRFLTGPAVMAAASFAVGLRGTLLHVAIVQAALPQGIVPFVFAKEYNVHPDILSTAVIFGMLIALPITLVYYILLGL

SEQ ID NO: 18196 - protein, 595 aa, Oryza sativa
MITAADFYHVMTAMVPLYVAMILAYGSVKWWRIFTPDQCSGINRFVALFAVPLLSFHFISTNNPYTMNLRFIAADTLQKLMVLAMLTAWSHLSRRGSLEWTITLFSLSTLPNTLVMGIPLLKGMYGEFSGSLMVQIVVLQCIIWYTLMLFMFEYRGARMLITEQFPDTAANIASIVVDPDVVSLDGRRDAIETETEVKEDGRIHVTVRRSNASRSDIYSRRSMGFSSTTPRPSNLTNAEIYSLQSSRNPTPRGSSFNHTDFYSMVGRSSNFGAADAFGVRTGATPRPSNYEDDASKPKYPLPASNAAPMAGHYPAPNPAVSSAPKGAKKAATNGQAKGEDLHMFVWSSSASPVSDVFGGGAPDYNDAAAVKSPRKMDGAKDREDYVERDDFSFGNRGVMDRDAEAGDEKAAAAAGADPSKAMAAPTAMPPTSVMTRLILIMVWRKLIRNPNTYSSLIGLIWSLVCFRWNFEMPAIVLKSISILSDAGLGMAMFSLGLFMALQPHIIACGNKVATYAMAVRFLAGPAVMAAASFAVGLRGTLLHVAIVQAALPQGIVPFVFAKEYSVHPSILSTAVIFGMLIALPITLVYYILLGL

SEQ ID NO: 18197 - protein, 588 aa, Hordeum vulgare
MITGTDFYHVMTAVVPLYVAMILAYGSVKWWGIFTPDQCSGINRFVALFAVPLLSFHFISTNNPYTMNLRFIAADTLQKLMMLAMLTAWSHLSRRGSLEWTITLFSLSTLPNTLVMGIPLLKGMYGDFSGSLMVQIVVLQCIIWYTLMLFMFEYRGARMLITEQFPDTAGAIASIVVDPDVVSLDGRSNAIETEAEVKEDGKIHVTVRRSSASRSDIYSRRSMGFSSTTPRPSNLTNAEIYSLQSSRNPTPRGSSFNHTDFYSMVGRSSNFGAADAYGIRTGATPRPSNYEEDAPKPKHPAPGAGHYPAPNPAVAAAPKGPKKPAANGQAKGEDLHMFVWSSSASPVSDVFGGGAPDYNDAAAAKSPRKMDGAKEREDYNVERDDFSFGNRGALDRDAEAGDEKAMTADPNNAMSAGPTAMPPTSVMTRLILIMVWRKLIRNPNTYSSLIGLIWSLVCFRWNFTMPAIVLGSISILSDAGLGMAMFSLGLFMALQPRIIACGNKVATYAMAVRFLAGPAVMTAASFAVGLRGTLLHVAIVQAALPQGIVPFVFAKEYSVHPDILSTAVIFGMLIALPITLVYYILLGL

SEQ ID NO: 18198 - protein, 588 aa, Triticum aestivum
MITGTDFYHVMTAVVPLYVAMILAYGSVKWWGIFTPDQCSGINRFVALFAVPLLSFHFISTNNPYTMNLRFIAADTLQKLMMLAMLTAWSHLSRRGSLEWTITLFSLSTLPNTLVMGIPLLKGMYGDFSGSLMVQIVVLQCIIWYTLMLFMFEYRGARMLITEQFPDTAGAIASIVVDPDVVSLDGRSNAIETEAEVKEDGKIHVTVRRSSASRSDIYSRRSMGFSSTTPRPSNLTNAEIYSLQSSRNPTPRGSSFNHTDFYSMVGRSSNFGAADAYGIRTGATPRPSNYEEDAPKPKHPAPGAGHYPAPNPAVAAAPKGPKKPATNGQAKGEDLHMFVWSSSASPVSDVFGGGAPDYNDAAAAKSPRKMDGAKERDDYNVERDDFSFGNRGALDRDTEAGDEKAMTADPNNAMSAGQTAMPPTSVMTRLILIMVWRKLIRNPNTYSSLIGLIWSLVCFRWNFTMPAIVLGSISILSDAGLGMAMFSLGLFMALQPRIIACGNKVATYAMAVRFLAGPAVMTAASFAVGLRGTLLHVAIVQAALPQGIVPFVFAKEYSVHPDILSTAVIFGMLIALPITLVYYILLGL

SEQ ID NO: 18199 - protein, 601 aa, Brachypodium distachyon
MITAADFYHVMTAVVPLYVAMILAYGSVKWWRIFTPDQCSGINRFVALFAVPLLSFHFISSNNPYTMNLRFIAADTLQKLMVLAMLTAWSHLSRSGSLEWTITLFSLSTLPNTLVMGIPLLKGMYGDFSGSLMVQIVVLQCIIWYTLMLFMFEYRGARMLITEQFPDTAGAIASIVVDPDVVSLDGRRDAIETEAEVKEDGKIHVTVRRSNASRSDVYSRRSMGFSSTTPRPSNLTNAEIYSLQSSRNPTPRGSSFNHTDFYSMVGRSSNFGAADAFGVRTGATPRPSNYEDDAPPKQPAQGKYQIPGAAINGAAAGQYPAPNPAVAAPKRKVATANGQGKGGGEDLHMFVWSSSASPVSDVFGGGGGPDYNDAAAAKSPRKMDGGAKEREDYVERDEFSFGNRGGAMERDAEAGDEKAAVGGGNGGAAAAAMPPTSVMTRLILIMVWRKLIRNPNTYSSLIGLIWSLVCFRWNFEMPAIVLKSISILSDAGLGMAMFSLGLFMALQPRIIACGNKVATYAMAVRFFAGPAVMLAASFAVGLRGTLLHVALVQAALPQGIVPFVFAKEYSVHPDILSTAVIFGMLIALPITLVYYIVLGLF

SEQ ID NO: 18200 - protein, 597 aa, Zea mays
MISAADLYHVMTAVVPLYVAMILAYGSVRWWRIFSPDQCSGINRFVALFAVPLLSFHFISTNNPYTMNLRFIAADTLQKLMVLAMLTAWGHLSRRGRGSLDLDWTITLFSLSTLPNTLVMGIPLLRGMYGDFSGSLMVQIVVLQCIIWYTLMLFMFEYRAARLLIAEQFPGNAAGAIASIAVDPDVVSLVDHGRGDAIETEAEVREDGRIHVTVRRSSASRSDVVYSRRSVGGFSGATPRPSNLTNAEIYSLQSSRNPTPRGSSFNHTDFYSMVGRSSNFGAADAFGAVRTGAGTTPRPSNYEDDASRPKYPLPVVSAAPGVAGHYPAPWSARKAATNGHAKGEDLHMFVWSSSASPVSDFFGGGAPDYNDHAAAAKSPRKMDGGARDRDDYVERDEFSFGNRGAMEDRDAEDPAAAGGDPNAVAAATAMPPTSVMTRLILIMVWRKLIRNPNTYSSLIGVVWSLVCFRWNFQMPDIVLHSISILSDAGLGMAMFSLGLFMALQPRIIACGNKVATFAMAVRFLTGPAVMAAASFAVGLRGTLLHVAIVQAALPQGIVPFVFAKEYSVHPDILSTAVIFGMLIALPITLVYYILLGL

SEQ ID NO: 18201 - protein, 534 aa, Saccharum officinarum
MITATDFYHVMTAVVPLYVAMILAYGSVRWWRIFSPDQCSGINRFVALFAVPLLSFHFISTNNPYTMNLRFIAADTLQKLMVLAMLTAWSHLSRRGSLEWTITLFSLSTLPNTLVMGIPLLKGMYGDFSGSLMVQIVVLQCIIWYTLMLFMFEYRGARLLITEQFPDNAGAIASIVVDPDVVSLDGRRDAIETEAEVKEDGKIHVTVRRSNASRSDIYSRRSMGFSSTTPRPSNLTNAEIYSLQSSRNPTPRGSSFNHNDFYSMVGRSSNFGAADAFGVRTGATPRPSNYEDDASKPGNKYPLPVVNAASVPGAAGHYPAPNPTVAAAPKKKAAGTNGQAKGEDLHMFVWSSSASPVSDVFGGGAPDYNDAAAVKSPRKMDGGGAKDRDDYVERDEFSFGNRGAMDRDAEAGDEKAAAAGGDPSAVAAPTAMPPTSVMTRLILIMVWRKLIRNPNTYSSLIGVIWSLVCFRWNFQMPAIVLQSISILSDAGLGMAMFSLGLFMALQPRIIACGNKVATFAMAVRFLTGPAVMAA

SEQ ID NO: 18202 - protein, 601 aa, Zea mays
MITGTDFYHVMTAMVPLYVAMILAYGSVRWWRIFTPDQCSGINRFVALFAVPLLSFHFISTNNPYTMNIRFIAADTLQKLIVLALLTAWSYLSRRGCLEWTITLFSLSTLPNTLVMGIPLLKGMYGDFSGSLMVQIVVLQCIIWYTLMLFMFEYRGARILITEQFPDTAGAIASIVVDPDVVSLDGRNDAIETEAEVKEDGKIHVTVRRSNASRSDIYSRRSMGFSSTTPRPSNLTNAEIYSLQSSRNPTPRGSSFNHTDFYSMVGRSSNFAAGDAFGLRTGATPRPSNYEEDPQGKANKYGQYPAPNPAMAAQPAKGLKKAANGQAKGEDGKDLHMFVWSSSASPVSDVFGNGAAEYNDAAAVKEVRMAVASPRKVAADGRKERGEDFAERDDFSFGNRGAAERDAEAGDEKAAAAAAAAQGNAGAVAAPAAMPPTSVMTRLILIMVWRKLIRNPNTYSSLIGLIWSLVCFRWNFEMPAIILKSISILSDAGLGMAMFSLGLFMALQPRIIACGNKVATFAMAVRFLTGPAVMAAASFAVGLRGTLLHVAIVQAALPQGIVPFVFAKEYGVHPDILSTAVIFGMLIALPITLVYYILMGL

SEQ ID NO: 18203 - protein, 592 aa, Oryza sativa
MITGADFYHVMTAMVPLYVAMILAYGSVKWWRIFTPDQCSGINRFVALFAVPLLSFHFISTNNPYTMNLRFIAADTLQKLIVLALLTLWSHLSRRGSLEWTITLFSLSTLPNTLVMGIPLLKGMYGEFSGSLMVQIVVLQCIIWYTLMLFMFEYRGARILITEQFPDTAGAIASIVVDADVVSLDGRRDMIETEAEVKEDGKIHVTVRRSNASRSDVYSRRSMGFSSTTPRPSNLTNAEIYSLQSSRNPTPRGSSFNHTDFYSMVGRSSNFAAGDAFGVRTGATPRPSNYEEDAAAPNKAGSKYGQYPAPNPAMAAPPKPKKAANGQAKGEDGKDLHMFVWSSSASPVSDVFGNGAEYNDAAAVKEVRMAVASPRKADGVERDDFSFGNRGVAERDAEAGDEKSVAAAVSGEHGKPGLTPAPTAMPPTSVMTRLILIMVWRKLIRNPNTYSSLIGLIWSLVCFRWNFEMPAIILKSISILSDAGLGMAMFSLGLFMALQPRIIACGNKVATFAMAVRFLTGPAVMAAASIAVGLRGTLLHVAIVQAALPQGIVPFVFAKEYSVHPDILSTAVIFGMLIALPITLVYYILLGL

SEQ ID NO: 18204 - protein, 597 aa, Setaria italica
MITGTDFYHVMTAMVPLYVAMILAYGSVRWWRIFTPDQCSGINRFVALFAVPLLSFHFISTNNPYTMNLRFIAADTLQKLIVLALLTAWSYLSRRGCLEWTITLFSLSTLPNTLVMGIPLLKGMYGDFSGSLMVQIVVLQCIIWYTLMLFMFEYRGARILITEQFPDTAGAIASIVVDPDVVSLDGRNDAIETEAEVKEDGKIHVTVRRSNASRSDIYSRRSMGFSSTTPRPSNLTNAEIYSLQSSRNPTPRGSSFNHTDFYSMVGRSSNFAAGDAFGVRTGATPRPSNYEEDAQGKANKYGQYPAPNPAMAAPAKGQPKKAANGQAKGEDGKDLHMFVWSSSASPVSDVFGNGNAEYNDAAAVKEVRMAVASPRKVAADGRKERGEDFAERDDFSFGNRGGAERDAEAGDEKAAVAGQGNAGVGAPAAMPPTSVMTRLILIMVWRKLIRNPNTYSSLIGLIWSLVCFRWNFEMPAIILKSISILSDAGLGMAMFSLGLFMALQPRIIACGNKVATFAMAVRFLTGPAVMAAASFAVGLRGTLLHVAIVQAALPQGIVPFVFAKEYGVHPDILSTAVIFGMLIALPITLVYYILLGL

SEQ ID NO: 18205 - protein, 603 aa, Saccharum officinarum
MITGTDFYHVMTAMVPLYVAMILAYGSVRWWRIFTPDQCSGINRFVALFAVPLLSFHFISTNNPYTMNLRFIAADTLQKLIVLALLTAWSYLSRRGCLEWTITLFSLSTLPNTLVMGIPLLKGMYGDFSGSLMVQIVVLQCIIWYTLMLFMFEYRGARILITEQFPDTAGAIASIVVDPDVVSLDGRNDAIETEAEVKEDGKIHVTVRRSNASRSDIYSRRSMGFSGTTPRPSNLTNAEIYSLQSSRNPTPRGSSFNHTDFYSMVGRSSNFGAGDAFGLRTGATPRPSNYEEEAQGGKAANKYGGQYPAPNPAMAAQPMPTKGLKKAAANGQAKGEDGKDLHMFVWSSSASPVSDVFGNGAAEYNDAAAVKEARMAVASPRKVAADGRKERGEDFTERDDFSFGNRGAADRDAEAGDKKAATVQGNAGGVAAPAAMPPTSVMTRLILIMVWRKLIRNPNTYSSLIGLIWSLVCFRWNFEMPAIILKSISILSDAGLGMAMFSLGLFMALQPRIIACGNKVATFAMAVRFLTGPAVMAAASLAVGLRGTLLHVAIVQAALPQGIVPFVFAKEYGVHPDILSTAVIFGMLIALPITLVYYILMGL

SEQ ID NO: 18206 - protein, 606 aa, Sorghum bicolor
MITGTDFYHVMTAMVPLYVAMILAYGSVRWWRIFTPDQCSGINRFVALFAVPLLSFHFISTNNPYTMNLRFIAADTLQKLIVLALLTAWSYLSRRGCLEWTITLFSLSTLPNTLVMGIPLLKGMYGDFSGSLMVQIVVLQCIIWYTLMLFMFEYRGARILITEQFPDTAGAIASIVVDPDVVSLDGRNDAIETEAEVKEDGKIHVTVRRSNASRSDIYSRRSMGFSSTTPRPSNLTNAEIYSLQSSRNPTPRGSSFNHTDFYSMVGRSSNFAAGDAFGLRTGATPRPSNYEEEAQGGKAANKYGGQYPAPNPAMAAQPMPTKQGLKKAAANGQAKGEDGKDLHMFVWSSSASPVSDVFGNGAAEYNDAAAVKEVRMAVASPRKVAADGRKERGEDFTERDDFSFGNKGAAERDAEAGDEKAAALQVGNACGVAAAPAAMPPTSVMTRLILIMVWRKLIRNPNTYSSLIGLVWSLVCFRWNFEMPAIILKSISILSDAGLGMAMFSLGLFMALQPRIIACGNKVATFAMAVRFLTGPAVMAAASLAVGLRGTLLHVAIVQAALPQGIVPFVFAKEYGVHPDILSTAVIFGMLIALPITLVYYILMGL

SEQ ID NO: 18207 - protein, 586 aa, Secale cereale
MITGTDFYHVMTAMVPLYVAMMLAYGSVKWWRIFTPDQCSGINRFVALFAVPLLSFHFISTNNPYTMNLRFIAADTLQKLIVLALLTLWSHLSRNGSLEWTITLFSLSTLPNTLVMGIPLLKGMYGDESGSLMVQIVVLQCIIWYTLMLFMFEYRGARILITEQFPDTAGAIASIAVDPDVMSLDGRRDMIETEAEVKEDGKIHVTVRRSNASRSDIYSRRSMGFSSTTPRPSNLTNAEIYSLQSSRNPTPRGSSFNHTDFYSMVGRSSNFAAGDAFGPVVRTGATPRPSNYEEDKAGNNNNTKYGQYPAPNPAMAAPQKPAKKPANGQAKGEDGKDLHMFVWSSSASPVSDVFGNGTEAYNDAAAKDVRVAAASPRKADGVERDEFSFGNKERDAEAGDEKAAAEQGTAGLVAAPTAMPPTSVMTRLILIMVWRKLIRNPNTYSSLIGLIWSLVCFRWNFVMPAIIMKSIAILSDAGLGMAMFSLGLFMALQPRIIACGNKRATFAMAVRFLTGPAVMAAASIAVGLRGTLLHIAIVQAALPQGIVPFVFAKEYSVHPDILSTAVIFGMLIALPITLVYYILLGL

SEQ ID NO: 18208 - protein, 596 aa, Brachypodium distachyon
MITGTDFYHVMTAMVPLYVAMMLAYGSVKWWRIFTPDQCSGINRFVALFAVPLLSFHFISTNNPYAMNLRFIAADTLQKLIVLALLTLWSHLSRNGSLEWTITLFSLSTLPNTLVMGIPLLKGMYGDESGSLMVQIVVLQCIIWYTLMLFMFEYRGARILITEQFPDTAGAIASIVVDPDVVSLDGRRDMIETEAEVKEDGKIHVTVRRSNASRSDIYSRRSMGFSSTTPRPSNLTNAEIYSLQSSRNPTPRGSSFNHTDFYSMVGRSSNFAAGDVFGGPGPVVRTGATPRPSNYEEDKAAAAGGNKYPAPNPAMAAAPPKPGKKQQQQGKGEDGKDLHMFVWSSSASPVSDVFGNGAEYNVDAAAVKDVRVAVASPRKGDGRKEKGEDYVERDEFSFGNKGMAGERDAEAGDEKDQGNAGGVVAATAMPPTSVMTRLILIMVWRKLIRNPNTYSSLIGLVWSLVCFRWNFEMPAIIMKSIAILSDAGLGMAMFSLGLFMALQPRIIACGNKRASFAMAVRFLTGPAVMAAASIAVGLRGKLLHVAIVQAALPQGIVPFVFAKEYSVHPDILSTAVIFGMLIALPITLVYYILLGL

SEQ ID NO: 18209 - protein, 603 aa, Hordeum vulgare
MITGTDFYHVMTAMVPLYVAMMLAYGSVKWWRIFTPDQCSGINRFVALFAVPLLSFHFISSNNPYTMNLRFIAADTLQKLIVLALLTLWSHLSRNGSLEWTITLFSLSTLPNTLVMGIPLLKGMYGDESGSLMVQIVVLQCIIWYTLMLFMFEYRGARILITEQFPDTAGAIASIAVDPDVMSLDGRRDMIETEAEVKEDGKIHVTVRRSNASRSDIYSRRSMGFSSTTPRPSNLTNAEIYSLQSSRNPTPRGSSFKHTDFYPTPRGSSFNHTDFYSMVGRSSNFAAGDAFGPVVRTGATPRPSNYEEDKAGNNNNSSNNKYGQYPAPNPAMAAPQKPAKKAANGQAKGEDGKDLHMFVWSSSASPVSDVFGNGTEAYNEAAAKDVRVAAASPRKADGVERDEFSFGNKERDAEAGDEKAAAEQGTAGLVPAPTAMPPTSVMTRLILIMVWRKLIRNPNTYSSLIGLIWSLVCFRWNFVMPAIIMKSIAILSDAGLGMAMFSLGLFMALQPRIIACGNKRATFAMAVRFLTGPAVMAAASIAVGLRGTLLHIAIVQAALPQGIVPFVFAKEYSVHPDILSTAVIFGMLIALPITLVYYILLGL

SEQ ID NO: 18210 - protein, 504 aa, Panicum virgatum
RGSLEWTITLFSLSTLPNTLVMGIPLLKGMYGDFSGSLMVQIVVLQCIIWYTLMLFMFEYRGARMLITEQFPDNAGAIASIVVDPDVVSLDGRRDAIETEAEVKEDGKIHVTVRRSNASRSDIYSRRSMGFSSTTPRPSNLTNAEIYSLQSSRNPTPRGSSFNHNDFYSMVGRSSNFGAADAFGVRTGATPRPSNYEDDASKTKYPLPVVNAAPGPGHYPAPNPAVAAAPKGAKKAATNGQAKGEDLHMFVWSSSASPVSDVFAGGAPDYNDAAAAVKSPRKMDGAKDRDDYVERDEFSFGNRGAMDRDAEAGDEKAASAAAGVGADPNAVAAPTAMPPTSVMTRLILIMVWRKLIRNPNTYSSLIGLIWSLVCFRWNFEMPAIVLKSISILSDAGLGMAMFSLGLFMALQPRIIACGNKVATFAMAVRFLTGPAVMAAASFAVGLRGTLLHVAIVQAALPQGIVPFVFAKEYNVHPDILSTAVIFGMLIALPITLVYYILLGL

SEQ ID NO: 18211 - protein, 365 aa, Zea mays
MGTGAVAVAAPDRAKQRRAGGHLWKKALLHFSLCFVMGFFTGFAPSSSSSWKSAAATPQHHPPHRPGDRLAASRVAVDARATLSPPAEAADALSAGATVDLGDDEEDAAQRRLLIVVTTTRSGPGERRRRRGELLRLAHTLRLVRPPVVWVVVEPAADAPATAEVLRGTGVMYRHLAFKPEDNFTTADAEAHVQRNAALAHVEKHRLAGVLHFADAAGVYDVGFFEQIRQIEAFGTWPVATMSAGEKKVVVEGPLCSASKVVGWFSRDFNDGTTRSVTYNTEADLNPAGAAGTRAHTIDVSGFAFNSSILWDPERWGRPTSLPDTSQDSIKFVQEVLLEDRAKLKGIPSDCSQIMVWQYSVPSSR

SEQ ID NO: 18212 - protein, 373 aa, Saccharum officinarum
MGTGALAVAAPAPDRANKQRRAGGAHLWKKALLHFSLCFVMGFFTGFAPSSSSSWKAATTHPPHRPGDRLAASRVAVDARATLLPSPPTTAGDALSAAVAAGGGATVDVGDDDEDGAAGQSRLLIVVTTTPAGPGERRRPPVLRLAHTLRLVRPPVVWTVVEPAADAPATAEVLRGTGVMYRHLAFKPEDNFTTADAEAHVQRNAALAHVEKHRLAGVLHFADAAGVYDVGFFDQIRQIEAFGTWPVATMSAGEKKVVVEGPLCSASKVVGWFSRDFNDGTTRSVTYNTEVDLNPAGAAGTRAHTIDVSGFAFNSSILWDPERWGRPTSLPDTSQDSIKFVQEVVLEDRAKLKGIPSDCSQIMVWQYSMPSSQ

SEQ ID NO: 18213 - protein, 369 aa, Setaria italica
MGTGAVAVAAPDRAKQRRGGHLWKKALLHFSLCFVMGFFTGFAPSSSSSWKAATQHLPHRAGDQLAASRVAVDARVNMVPSPPDAAGEVGLAGAAAAGGGAMVDVGDDDEEAGPRRLLIVVTTTRSGAGERRRRRAELLRLAHTLRLVRPPVVWVVVEPAADAPATAEVLRGTGVMYRHIAFKPEENFTTAAAEAHAQRNAALAHVEKHRLAGVLHFADAAGVYDTGFFDQIRQIEAFGTWPVATMSAGEKKVVVEGPLCSASMVVGWFSRDFNDGTTRAVTYNTEADSNPAGAAGTRAHTIDVSGFAFNSSILWDPERWGRPTSLPDTSQDSIKFVQEVVLEDRAKLKGIPSDCSQIMVWQYSVPSSQ

SEQ ID NO: 18214 - protein, 1180 aa, Zea mays
MASTGGGGGLRHSNSSRLSRMSFSGGGSDDARAQAAAAPGGDRPMVTFARRTRSGRYVSYSRDDLDSELGAAGVDMSPDRDEQFASYHVHIPATPDNQPMDPAISARVEEQYVSNSLFTGGFNSVTRAHLMDKVIDSEASHPQMAGARGSSCAVNGCDANVMSDERGDDILPCECDFKICAECFADAVKNAGAICPGCKEPYKNTELDDVVGAAADATAGGRPTLSLPPPPGAAASRMERRLSIMRSQKAMTRSQTGDWDHNRWLFETKGTYGYGNAIWPKENEVDAAGGLGGGGADGQPAEFTTKPWRPLTRKLSIPAGVLSPYRLLILIRMAVLGLFLTWRIKHKNEDAIWLWGMSVVCELWFGFSWLLDQLPKLCPVNRATDLAVLKDKFETPTPSNPTGRSDLPGLDIFVSTADPEKEPPLVTANTILSILAADYPVEKLSCYVSDDGGALLTFEAMAEAASFANMWVPFCRKHNIEPRNPDSYFNLKKDPYKNKVRQDFVKDRRRVKREYDEFKVRINGLPDSIRRRSDAYHAREEIKAMKRQREAALDDAVEPVKIPKATWMADGTHWPGTWIQPSAEHTRGDHAGIIQVMLKPPSDDPLYGSTGDEGRPLDFTEVDIRLPMLVYVSREKRPGYDHNKKAGAMNALVRSSAVMSNGPFILNLDCDHYVYNSQAFREGMCFMMDRGGDRIGYVQFPQRFEGIDPSDRYANHNTVFFDVNMRALDGLMGPVYVGTGCLFRRVALYGFDPPRSKEHGGCCSCCFPQRRKIKASAAAPEETRALRMADFDEDEMNMSSFPKKFGNSSFLIDSIPIAEFQGRPLADHPGVKNGRPPGALTVPRDLLDASTVAEAVSVISCWYEDKTEWGHRVGWIYGSVTEDVVTGYRMHNRGWKSVYCVTKRDAFRGTAPINLTDRLHQVLRWATGSVEIFFSRNNALLASRRMKFLQRIAYLNVGIYPFTSIFLIVYCFLPALSLFSGQFIVKTLNVTFLTYLLVITLTLCLLAVLEIKWSGISLEEWWRNEQFWLIGGTSAHLAAVLQGLLKVVAGIEISFTLTSKSGGDDVDDEFADLYIVKWTSLMIPPIVIMMVNLIGIAVGFSRTIYSEIPQWSKLLGGVFFSFWVLAHLYPFAKGLMGRRGRTPTIVFVWAGLLSITISLLWVAINPPSQNQQIGGSFTFP

SEQ ID NO: 18215 - protein, 1175 aa, Setaria italica
MASNGGGGGVLRHSNSSRLSRMSYSGEDGRGAQAPAGDRPMVTFARRTHSGRYVSYSRDDLDSEVGGIGDFSPEHQEFLSYHVHIPATPDNQPMDPAISARVEEQYVSNSLFTGGFNSVTRAHLMDKVIESEASHPQMAGAKGSSCAINGCDAKVMSDERGEDILPCECDFKICAECFGDAVKNGGGVCPGCKEPYKNTELEDVVGGAAGARATLSLPPPPGAGGAAASRMERRLSIMRSQKALTRSQTGDWDHNRWLFETKGTYGYGNAIWPKENEVESGGGGGGGLGGADGQPAEFTTKPWRPLTRKLSIPAGILSPYRLLILIRMAVLGLFLTWRIRHKNEDAIWLWGMSVVCELWFGFSWLLDQLPKLCPVNRATDLAVLKDKFETPTPSNPTGRSDLPGLDIFVSTADPEKEPPLVTANTILSILAADYPVEKLSCYVSDDGGALLTFEAMAEAASFANMWVPFCRKHNIEPRNPESYFNLKRDPYKNKVRQDFVKDRRRVKREYDEFKVRINGLPESIRRRSDAYHAREEIKAMKRQRETALDDAVEPVKIPKATWMADGTHWPGTWIQPSAEHTRGDHAGIIQVMLKPPSDDPLYGSTGEEGRPLDFTEVDIRLPMLVYVSREKRPGYDHNKKAGAMNALVRSSAVMSNGPFILNLDCDHYVYNSQAFREGMCFMMDRGGDRIGYVQFPQRFEGIDPSDRYANHNTVFFDVNMRALDGLMGPVYVGTGCLFRRVALYGFDPPRDKEHGGCCSCCFPQRRKVKTSAAAPEETRALRMADFDEDEMNMSSFPKKFGNSNFLINSIPIAEFQGRPLADHPGVKNGRPPGALTVPRDLLDASTVAEAISVISCWYEDKTEWGHRVGWIYGSVTEDVVTGYRMHNRGWKSVYCVTKRDAFRGTAPINLTDRLHQVLRWATGSVEIFFSRNNALLASRKMKFLQRIAYLNVGIYPFTSIFLIVYCFLPALSLFSGQFIVKTLNVAFLTYLLVITLTLCLLAVLEIKWSGISLEEWWRNEQFWLIGGTSAHLAAVLQGLLKVIAGIEISFTLTSKSGGDDENDEFADLYIVKWTSLMIPPIVIMMVNLIAIAVGFSRTIYSEIPQWSKLLGGVFFSFWVLAHLYPFAKGLMGRRGRTPTIVFVWAGLLSITISLLWVAINPPSQNSQIGGSFTFP

SEQ ID NO: 18216 - protein, 1170 aa, Oryza sativa
MASSGGGGLRHSNSSRLSRMSYSGEDGRAQAPGGGGDRPMVTFARRTHSGRYVSYSRDDLDSELGNSGDMSPESGQEFLNYHVTIPATPDNQPMDPAISARVEEQYVSNSLFTGGFNSVTRAHLMDKVIESEASHPQMAGAKGSSCAINGCDAKVMSDERGDDILPCECDFKICADCFADAVKNGGACPGCKDPYKATELDDVVGARPTLSLPPPPGGLPASRMERRLSIMRSQKAMTRSQTGDWDHNRWLFETKGTYGYGNAIWPKENEVDNGGGGGGGGGLGGGDGQPAEFTSKPWRPLTRKLKIPAGVLSPYRLLILIRMAVLGLFLAWRIKHKNEDAMWLWGMSVVCELWFGLSWLLDQLPKLCPVNRATDLAVLKDKFETPTPSNPNGRSDLPGLDIFVSTADPEKEPPLVTANTILSILAADYPVEKLSCYVSDDGGALLTFEAMAEAASFANMWVPFCRKHDIEPRNPESYFNLKRDPYKNKVRSDFVKDRRRVKREYDEFKVRINSLPDSIRRRSDAYHAREEIKAMKRQREAALDDVVEAVKIPKATWMADGTHWPGTWIQPSAEHARGDHAGIIQVMLKPPSDDPLYGTSGEEGRPLDFTEVDIRLPMLVYVSREKRPGYDHNKKAGAMNALVRSSAVMSNGPFILNLDCDHYVYNSQAFREGMCFMMDRGGDRIGYVQFPQRFEGIDPSDRYANHNTVFFDVNMRALDGIMGPVYVGTGCLFRRIALYGFDPPRSKEHSGCCSCCFPQRRKVKTSTVASEERQALRMADFDDEEMNMSQFPKKFGNSNFLINSIPIAEFQGRPLADHPGVKNGRPPGALTVPRDLLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASRKMKFLQRIAYLNVGIYPFTSIFLIVYCFLPALSLFSGQFIVRTLNVTFLTYLLVITLTMCMLAVLEIKWSGISLEEWWRNEQFWLIGGTSAHLAAVLQGLLKVIAGIEISFTLTSKSGGDEADDEFADLYIVKWTSLMIPPIVIMMVNLIAIAVGFSRTIYSEIPQWSKLLGGVFFSFWVLAHLYPFAKGLMGRRGRTPTIVFVWSGLLAITISLLWVAINPPSQNSQIGGSFTFP

SEQ ID NO: 18217 - protein, 1182 aa, Brachypodium distachyon
MASNGGGGVLRHSNSSRLSRMSFSGEDGRGQPPGAGGGGGADRPMVTFARRTHSGRYVSYSRDDLDSELGGSEAAGFSPDREEFLSYHVHIPATPDNQPMDPAISARVEEQYVSNSLFTGGFNSVTRAHLMDKVIESEASHPQMAGSKGSSCAINGCDGKVMSDERGEDILPCECDFKICAECFGDAVKNGGALCPGCKEPYKATEMEDLVGGAEGGARPTLSLPPPPGGAAASRMERRLSIVRSQKAMTRSQTGDWDHNRWLFETKGTYGYGNAIWPKENEVDNGGGGGGGGGLSGADGQPAEFTSKPWRPLTRKLKIPAGILSPYRLLVLIRMVVLGLFLTWRIKHKNEDAMWLWGMSVVCELWFGFSWILDQLPKLCPVNRATDLVVLKDKFETPTPSNPNGRSDLPGLDIFVSTADPEKEPPLVTANTILSILAADYPVEKLSCYVSDDGGALLTFEAMAEAASFANMWVPFCRKHGIEPRNPESYFSLKKDPYKNKVRSDFVKDRRRIKREYDEFKVRINGLPDSIRRRSDAYHAREEIKAMKRQREAALDDAVEAVKIAKATWMADGTHWPGTWIQPSAEHTRGDHAGIIQVMLKPPSDDPLYGSNGEEGRPLDFTDIDIRLPMLVYVSREKRPGYDHNKKAGAMNALVRSSAVMSNGPFILNLDCDHYVYNSQAFREGMCFMMDRGGDRIGYVQFPQRFEGIDPSDRYANHNTVFFDVNMRALDGLMGPVYVGTGCLFRRIALYGFDPPRSTEHGGCCSCCFLKKRKIKISSSASEETRALRMADFDEEEMNMSTFPKKFGNSNFLINSIPIAEFQGRPLADHPGVKNGRPPGALTVPRDLLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASRRMKFLQRIAYLNVGIYPFTSIFLIVYCFLPALSLFSGQFIVRTLDVTFLTYLLVITLTLCMLAVLEIKWSGINLEEWWRNEQFWLIGGTSAHLAAVLQGLLKVIAGIEISFTLTSKSGGDDENDDYADLYIVKWTSLMIPPIVIMMVNLIAIAVGFSRTIYSEIPQWSKLLGGVFFSFWVLAHLYPFAKGLMGRRGRTPTIVFVWSGLLAITISLLWVAINPPSQNSQIGGSFTFP

SEQ ID NO: 18218 - protein, 1194 aa, Secale cereale
MDNIGGGGVLRHSNSSRLSRMSFSGEDGRGAQARPAPGAGNGGGADRPMVTFARRTHSGRYVSYSRDDLDSELANSDLAGGGGGFSPDREEFLSYHVHIPATPDNQPMDPAISARVEEQYVSNSLFTGGFNSVTRAHLMDKVIDSEASHPQMAGSKGSSCAVNGCDGKVMSDERGQDILPCECDFKICADCFGDAVKNAGALCPGCKEPYKATEMEDLVGAADGGARPTLSLPPPPGGAPASRMERRLSIVRSQKAMTRSQTGDWDHNRWLFETKGTYGYGNAIWPKENDADNGGGGGGGGGAGLGGTDGQPAEFTSKPWRPLTRKLKIPAGILSPYRLLVLIRLAVLGLFLTWRIKHKNEDAMWLWGMSVVCELWFGFSWILDQLPKLCPVNRATDLAVLKDKFETPTPSNPNGRSDLPGLDIYVSTADPEKEPPLTTANTILSILAADYPVEKLSCYVSDDGGALLTFEAMAEAASFANMWVPFCRKHVIEPRNPDSYFSLKRDPYKNKVRSDFVKDRRRIKREYDEFKVRINGLPDSIRRRSDAYHAREEIKAMKRQREAALDDAVETVKIAKATWMADGTHWPGTWIQPSAEHTRGDHAGIIQVMLKPPSDDPLYGGDGEEGRPLDFTDIDIRLPMLVYVSREKRPGYDHNKKAGAMNALVRSSAVMSNGPFILNLDCDHYVYNSQAFREGMCFMMDRGGDRIAYVQFPQRFEGIDPSDRYANHNTVFFDVNMRALDGLMGPVYVGTGCLFRRVALYGFDPPRSTEHGGCCSCCFPKKRKIKSTVSSATSEETRALRMADFDDEEMNMSTFPKRFGNSNFLINSIPIAEFQGRPLADHPGVKNGRPPGALTVPRDLLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASRRMKCLQRIAYLNVGIYPFTSIFLIVYCFLPALSLFSGQFIVKELDVTFLTYLLVITLTLCMLAVLEIKWSGINLEEWWRNEQFWLIGGTSAHLAAVLQGLLKVIAGIEISFTLTSKSGADDENDEFADLYIVKWTSLMIPPIVIMMVNLIAIAVGFSRTIYSEIPQWSKLLGGVFFSFWVLAHLYPFAKGLMGRRGRTPTIVFVWSGLLAITISLLWVAINPPSQNSQIGGSFQFP

SEQ ID NO: 18219 - protein, 1155 aa, Hordeum vulgare
PAPAAGAGGDRPMVTFARRTHSGRYVSYSRDDLDSELANTDLAGGFSPDREEFLSYHVHIPATPDNQPMDPAISARVEEQYVSNSLFTGGFNSVTRAHLMDKVIDSEASHPQMAGSKGSSCAVNGCDAKVMSDERGQDILPCECDFKICAECFGDAVKNAGALCPGCKEPYKATEMDDLVGAADGGARPTLSLPPPPGGAPASRMERRLSIVRSQKAMTRSQTGDRDHNRWLFETKGTYGYGNAIWPKENDADNGGGGGGGGGAGLGGHDGQPAEFTSKPWRPLTRKLKIPAGILSPYRLLVLIRLAVLGLFLTWRIKHKNEDAMWLWGMSVVCELWFGFSWILDQLPKLCPVNRATDLAVLKDKFESPTPSNPNGRSDLPGLDIYVSTADPEKEPPLTTANTILSILAADYPVEKLSCYVSDDGGALLTFEAMAEAASFANMWVPFCRKHGIEPRNPESYFSLKRDPYKNKVRSDFVKDRRRIKREYDEFKVRINGLPDSIRRRSDAYHAREEIKAMKRQREAALDDVVETVKIAKATWMADGTHWPGTWIQPSAEHTRGDHAGIIQVMLKPPSDDPLYGGDGEEGRPLDFTDIDIRLPMLVYVSREKRPGYDHNKKAGAMNALVRSSAVMSNGPFILNLDCDHYVYNSQAFREGMCFMMDRGGDRIAYVQFPQRFEGIDPSDRYANHNTVFFDVNMRALDGLMGPVYVGTGCLFRRVALYGFDPPRSTEHGGCCSCCFPKKRKIKSTVSSATSEETRALRMADFDDEEMNMSTFPKRFGNSNFLINSIPIAEFQGRPLADHPGVKNGRPPGALTVPRDLLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASRRMKCLQRIAYLNVGIYPFTSIFLIVYCFLPALSLFSGQFIVKELDVTFLTYLLVITLTLCMLAVLEIKWSGINLEEWWRNEQFWLIGGTSAHLAAVLQGLLKVIAGIEISFTLTSKSGADDENDEFADLYIVKWTSLMIPPIVIMMVNLIAIAVGFSRTIYSEIPQWSKLLGGVFFSFWVLAHLYPFAKGLMGRRGRTPTIVFVWSGLLAITISLLWVAINPPSQNSQIGGSFQFP

SEQ ID NO: 18220 - protein, 1143 aa, Hordeum vulgare
MVTFARRTHSGRYVSYSRDDLDSELANTDLAGGFSPDREEFLSYHVHIPATPDNQPMDPAISARVEEQYVSNSLFTGGFNSVTRAHLMDKVIDSEASHPQMAGSKGSSCAVNGCDAKVMSDERGQDILPCECDFKICAECFGDAVKNAGALCPGCKEPYKATEMDDLVGAADGGARPTLSLPPPPGGAPASRMERRLSIVRSQKAMTRSQTGDWDHNRWLFETKGTYGYGNAIWPKENDADNGGGGGGGGGAGLGGHDGQPAEFTSKPWRPLTRKLKIPAGILSPYRLLVLIRLAVLGLFLTWRIKHKNEDAMWLWGMSVVCELWFGFSWILDQLPKLCPVNRATDLAVLKDKFESPTPSNPNGRSDLPGLDIYVSTADPEKEPPLTTANTILSILAADYPVEKLSCYVSDDGGALLTFEAMAEAASFANMWVPFCRKHGIEPRNPESYFSLKRDPYKNKVRSDFVKDRRRIKREYDEFKVRINGLPDSIRRRSDAYHAREEIKAMKRQREAALDDVVETVKVAKATWMADGTHWPGTWIQPSAEHTRGDHAGIIQVMLKPPSDDPLYGGDGEEGRPLDFTDIDIRLPMLVYVSREKRPGYDHNKKAGAMNALVRSSAVMSNGPFILNLDCDHYVYNSQAFREGMCFMMDRGGDRIAYVQFPQRFEGIDPSDRYANHNTVFFDVNMRALDGLMGPVYVGTGCLFRRVALYGFDPPRSTEHGGCCSCCFPKKRKIKSTVSSATSEETRALRMADFDDEEMNMSTFPKRFGNSNFLINSIPIAEFQGRPLADHPGVKNGRPPGALTVPRDLLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASRRMKCLQRIAYLNVGIYPFTSIFLIVYCFLPALSLFSGQFIVKELDVTFLTYLLVITLTLCMLAVLEIKWSGINLEEWWRNEQFWLIGGTSAHLAAVLQGLLKVIAGIEISFTLTSKSGADDENDEFADLYIVKWTSLMIPPIVIMMVNLIAIAVGFSRTIYSEIPQWSKLLGGVFFSFWVLAHLYPFAKGLMGRRGRTPTIVFVWSGLLAITISLLWVAINPPSQNSQIGGSFQFP

SEQ ID NO: 18221 - protein, 1160 aa, Ananas comosus
MASNSALRNSRSARMAASAADPLQGGGRPAAAPPAPTVKFARRTQSGRYVSYSRDDLDSEIGSGEFSQEFTNYHVHIPATPDNQPMEVSIDPSISAKVEEQYVSNSLFTGGFNSVTRAHLMDKVIESEASHPQMAGAKGSSCSIQGCDSKVMSDERGIDILPCECDFKICAECFGDAVKAGGICPGCKEPYKTTELEDIVNDSSMGGQPHLSLPPPPAGVSRMERRLSIMRSQKMMSRSQTGDWDHNRWLFETKGTYGYGNAIWPKENGGDDGNGGDGQPSELSSKPWRPLTRKLKIPAAILSPYRLLIAIRMIALVLFLMWRVKHKNKDAMWLWGMSVVCELWFAFSWLLDQLPKLCPVNRATDLAVLKEKFETPTPNNPTGKSDLPGLDIFVSTADPEKEPPLVTANTILSILAADYPVEKLSCYVSDDGGALLTFEAMAEAASFANLWVPFCRKHDIEPRNPESYFNLKKDPYKNKVKSDFVKDRRRVKREYDEFKVRINGLPDSIRRRSDAYHAREEIKAMKRQREMAGDDPIEQVKIPKATWMADGTHWPGTWINPGSEHSRGDHAGVIQVMLKPPSDEPLYGNNGDEGRPLDFTDVDIRLPLLVYVSREKRPGYDHNKKAGAMNALVRASAIMSNGPFILNLDCDHYVYNSQAFREGMCFMMDRGGDRLCYVQFPQRFEGIDPSDRYANNNTVFFDVNMRALDGLQGPVYVGTGCLFRRIALYGFDPPRAKEHGAGCCSCCFPGRRKNVSAVASEETRALRMGDFDEEEMNLSTFPKKFGNSSFLIDSIPIAEFQGRPLADHPAVKNGRPPGALTIPRDLLDASTVAEAISVISCWYEDKTEWGHRVGWIYGSVTEDVVTGYRMHNRGWKSVYCVTKRDAFRGTAPINLTDRLHQVLRWATGSVEIFFSRNNALLASPRMKFLQRIAYLNVGIYPFTSIFLIVYCFLPALSLFSGQFIVQTLNVAFLTYLLTITVTLSALAVLEIKWSGINLEEWWRNEQFWLIGGTSAHLAAVIQGLLKVIAGIEISFTLTSKSGGDDVDDEFADLYIVKWSSLMIPPITIMMVNLIAIAVGFSRTIYSVIPQWSKLLGGVFFSFWVLAHLYPFAKGLMGRRGRTPTIVFVWSGLIAITISLLWVAINPPSANSQIGGSFTFP

SEQ ID NO: 18222 - protein, 313 aa, Echinochloa colona
MEPMNVDNGGCGGLDAQIEQLMQCRPLAEQEVKSLCEKAKEILMEESNVQPVKSPVTICGDIHGQFHDLVELFRIGGKCPDTNYLFMGDYVDRGYYSVETVTLLVALKVRHPHRITILRGNHESRQITQVYGFYDECLRKYGNANVWKTFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 18223 - protein, 310 aa, Setaria italica
MNVDNGGCGGLDAQIEQLMQCRPLAEQEVKSLCEKAKEILMEESNVQPVKSPVTICGDIHGQFHDLVELFRIGGKCPDTNYLFMGDYVDRGYYSVETVTLLVALKVRHPHRITILRGNHESRQITQVYGFYDECLRKYGNANVWKTFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 18224 - protein, 310 aa, Zea mays
MNVDNGGSGGLDAQIEQLMQCRPLAEQEVKALCEKAKEILMEESNVQPVKSPVTICGDIHGQFHDLVELFRIGGKCPDTNYLFMGDYVDRGYYSVETVTMLVALKVRYPHRITILRGNHESRQITQVYGFYDECLRKYGNANVWKTFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 18225 - protein, 313 aa, Panicum virgatum
MEPMNVDNGGCGGLDAQIEQLMQCRPLAEQEVKSLCEKAKEILMEESNVQPVKSPVTICGDIHGQFHDLVELFRIGGKCPDTNYLFMGDYVDRGYYSVETVTLLVALKVRHPHRITILRGNHESRQITQVYGFYDECLRKYGNANVWKTFTDLFDCFPLTALVESEIFCLHGGLSPSIENLDSVRSLDRVQEVPHEGPMCDLLWSDPDDRCGWGISPRGAGYTFGQDTSEQFNHTNNLKLVARAHQLVMEGYNWAHEQKVVTIFSAPNYCYRCGNMASILEVDDCNGHTFIQFEPAPRRGEPDVTRRTPDYFL

SEQ ID NO: 18226 - protein, 314 aa, Oryza sativa
MEPMSVDGGGGCGGLDTQIEQLMQCRPLAEQEVKALCEKAKEILMEESNVQPVKSPVTICGDIHGQFHDLVELFRIGGKCPDTNYLFMGDYVDRGYYSVETVTLLVALKVRHPHRITILRGNHESRQITQVYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 18227 - protein, 313 aa, Hordeum vulgare
  Sequence also found in Organisms: Pseudoroegneria spicata
MEPMSVDSSGCGGLDAQIEQLLQCRPLAEQEVKALCEKAKEILMEESNVQPVKSPVTICGDIHGQFHDLVELFRIGGKCPDTNYLFMGDYVDRGYYSVETVSLLVALKVRHPHRITILRGNHESRQITQVYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNAHTFIQFEPAPRRGEPDVTRRTPDYFL

SEQ ID NO: 18228 - protein, 311 aa, Oryza sativa
MSVDGGGGCGGLDTQIEQLMQCRPLAEQEVKALCEKAKEILMEESNVQPVKSPVTICGDIHGQFHDLVELFRIGGKCPDTNYLFMGDYVDRGYYSVETVTLLVALKVRHPHRITILRGNHESRQITQVYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 18229 - protein, 310 aa, Hordeum vulgare
  Sequence also found in Organisms: Secale cereale, Triticum aestivum
MSVDSSGCGGLDAQIEQLLQCRPLAEQEVKALCEKAKEILMEESNVQPVKSPVTICGDIHGQFHDLVELFRIGGKCPDTNYLFMGDYVDRGYYSVETVSLLVALKVRHPHRITILRGNHESRQITQVYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNAHTFIQFEPAPRRGEPDVTRRTPDYFL

SEQ ID NO: 18230 - protein, 312 aa, Brachypodium distachyon
MSVDSSSSGCGGLDAQIEQLMQCRPLAEQEVKALCEKAKEILMEESNVQPVKSPVTICGDIHGQFHDLVELFRIGGKCPDTNYLFMGDYVDRGYYSVETVSLLVALKVRHPHRITILRGNHESRQITQVYGFYDECLRKYGNANVWKIFTDLFDYFPLTALVESEIFCLHGGLSPSIENLDSVRCLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 18231 - protein, 310 aa, Lolium multiflorum
  Sequence also found in Organisms: Avena sativa
MSVDSSGSGGLDAQIEQLMQCRPLPEQEVKALCEKAKEILMEESNVQPVKSPVTICGDIHGQFHDLVELFRIGGKCPDTNYLFMGDYVDRGYYSVETVSLLVALKVRHPHRITILRGNHESRQITQVYGFYDECLRKYGNASVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHSFIQFEPAPRRGEPDVTRRTPDYFL

SEQ ID NO: 18232 - protein, 310 aa, Avena sativa
MSVDSNGSGGLDAQIEQLMQCRPLPEQEVKALCEKAKEILMEESNVQPVKSPVTICGDIHGQFHDLVELFRIGGKCPDTNYLFMGDYVDRGYYSVETVSLLVALKVRHPHRITILRGNHESRQITQVYGFYDECLRKYGNASVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHSFIQFEPAPRRGEPDVTRRTPDYFL

SEQ ID NO: 18233 - protein, 301 aa, Pennisetum glaucum
GLDAQIEQLMQCRPLAEQEVKSLCEKAKEILMEESNVQPVKSPVTICGDIHGQFHDLVELFRIGGKCPDTNYLFMGDYVDRGYYSVETVTLLVALKVRHPHRITILRGNHESRQITQVYGFYDECLRKYGNANVWKTFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 18234 - protein, 315 aa, Sorghum bicolor
MEGLAGSRGGGGCGGLDAQIEQLMECRPLAETEVKTLCEKAKEILMEESNVQPVKSPVTICGDIHGQFHDLVELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 18235 - protein, 315 aa, Echinochloa colona
MEDSAGSRGGGGCGGLDAQIEQLMECRPLPETEVKTLCEKAKEILMEESNVQPVKSPVTICGDIHGQFHDLVELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 18236 - protein, 315 aa, Pennisetum glaucum
MEDSAGSRGGGGCGGLDAQIEQLMECRPLAETEVRALCEKAKEILMGESNVQPVKSPVTICGDIHGQFHDLVELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 18237 - protein, 315 aa, Setaria italica
MEDSAGSRGGGGCGGLDAQIEQLMECRPLPETEVRALCEKAKEILMDESNVQPVKSPVTICGDIHGQFHDLVELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 18238 - protein, 315 aa, Saccharum officinarum
MEDLAGSRGGGGCGGLDAQIEQLMECRPLSETEVKTLCEKAKEILMEESNVQPVKSPVTICGDIHGQFHDLVELFQIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 18239 - protein, 315 aa, Panicum virgatum
MEGSAGLRGGGGCGGLDAQIEQLMECRPLPETEVKTLCEKAKEILMEESNVQPVKSPVTICGDIHGQFHDLVELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHSFIQFEPAPRRGEPDVTRRTPDYFL

SEQ ID NO: 18240 - protein, 315 aa, Zea mays
MEDLASSRGGGGCGGLDAQIEQLMECRPLPETEVKTLCEKAKEILMEESNVQPVKSPVTICGDIHGQFHDLLELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIENLDNVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 18241 - protein, 314 aa, Oryza sativa
MEESVGSRGGGGGGLDAQIEQLMECRPLSEPEVKTLCEKAKEILMEESNVQPVKSPVTICGDIHGQFHDLVELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIDNLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 18242 - protein, 314 aa, Oryza sativa
MEESVGSRGGGGGGLDAQIEQLMECRPLSETEVKTLCEKAKEILMEESNVQPVKSPVTICGDIHGQFHDLVELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIDNLDSVRSLDRVQEVPHEGPMCDLLWSDPDDRCGWGISPRGAGYTFGQDISEQFNHSNNLKLVARAHQLVMEGYNWAHEQKVVTIFSAPNYCYRCGNMASILEVDDCRNHTFIQFEPAPRRGEPDVTRRTPDYFL

SEQ ID NO: 18243 - protein, 297 aa, Festuca arundinacea
QIEQLMQCRPLPEQEVKALCEKAKEILMEESNVQPVKSPVTICGDIHGQFHDLVELFRIGGKCPDTNYLFMGDYVDRGYYSVETVSLLVALKVRHPHRITILRGNHESRQITQVYGFYDECLRKYGNASVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHSFIQFEPAPRRGEPDVTRRTPDYFL

SEQ ID NO: 18244 - protein, 307 aa, Avena sativa
MGSPHGGLDEQIEQLMQCKPLAEPEVRALCEKAKEILMEESNVQPVRSPVTICGDIHGQFHDLAELFRIGGKCPDTNYLFMGDYVDRGYYSVETVSLLVALKVRYPHRITILRGNHESRQITQVYGFYDECLRKYGNANVWKTFTDLFDYFPLTALVESEIFCLHGGLSPSIETLDSVRSFDRVQEVPHEGPMCDLLWSDPDDRCGWGISPRGAGYTFGQDISEQFNHSNNLKLIARAHQLVMEGFNWAHEQKVVTIFSAPNYCYRCGNMASILEVDDCREHTFIQFEPAPRRGEPDVTRRTPDYFL

SEQ ID NO: 18245 - protein, 313 aa, Manihot esculenta
MSLDSVPSNTHGNLDEQINQLMQCKPLSEHEVRTLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18246 - protein, 313 aa, Catharanthus roseus
MSADLVASSTYGNLDEQISQLMQCKPLSETEVRALCEKAKEILMEESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWSHEQKVVTIFSAPNYCYRCGNMASILEVDDCRQHTFIQFEPAPRRGEPDVTRRTPDYFL

SEQ ID NO: 18247 - protein, 311 aa, Quercus alba
MESVPSNTHGGLDEQISQLMQCKPLSEQEVRVLCDKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKAHTFIQFEPAPRRGEPDVTRRTPDYFL

SEQ ID NO: 18248 - protein, 313 aa, Populus trichocarpa
MSLDSVASNTHGNLDEQISQLMQCKPLSEQEVRALCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18249 - protein, 312 aa, Amborella trichopoda
MSVDPVSNSHGNLDAQISQLMQCKPLSEQEVRVLCEKAKEILMEESNVQPVKSPVTICGDIHGQFHDLAELFRIGGKCPDTNYLFMGDYVDRGYYSVETVTLLVALKVRYSHRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFL

SEQ ID NO: 18250 - protein, 311 aa, Fragaria vesca
MDSVPSNSHGNLDEQIAQLMQCKPLSEQEVRGLCEKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18251 - protein, 307 aa, Oryza sativa
  Sequence also found in Organisms: Echinochloa colona, Panicum virgatum
MSSPHGGLDDQIERLMQCKPLPEPEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 18252 - protein, 313 aa, Rosmarinus officinalis
MSADLVAPTAHGNLDEQISQLMQCKPLSEPEVRTLCEKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWAHEQKVVTIFSAPNYCYRCGNMASILEVDDCREHTFIQFEPAPRRGEPDVTRRTPDYFL

SEQ ID NO: 18253 - protein, 313 aa, Manihot esculenta
MSLDTVHSNTHGNLDEQINQLMQCKPLSEPDVRTLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18254 - protein, 311 aa, Castanea mollissima
MESVPSNTHGSLDEQISQLMQCKPLSEQEVRVLCDKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKAHTFIQFEPAPRRGEPDVTRRTPDYFL

SEQ ID NO: 18255 - protein, 312 aa, Gossypium hirsutum
  Sequence also found in Organisms: Gossypium raimondii
MESSVGSNSHGNLDEQISQLMQCKPLSEQEVRALCDKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18256 - protein, 307 aa, Leymus cinereus x Leymus triticoides
MGNPRGGLDEQIEQLLQCKPLVEPELKALCEKAKEILMEESNVQPVRSPVTICGDIHGQFHDLAELFRIGGKCPDTNYLFMGDYVDRGYYSVETVSLLVALKVRYPHRITILRGNHESRQITQVYGFYDECLRKYGSANVWKTFTDLFDYLPLTALVESEIFCLHGGLSPSIETLDNVRSFDRVQEVPHEGPMCDLLWSDPDDRCGWGISPRGAGYTFGQDISEQFNHTNSLKLIARAHQLVMEGFNWAHEQKVVTIFSAPNYCYRCGNMASILEVDDCREHTFIQFEPAPRRGEPDVTRRTPDYFL

SEQ ID NO: 18257 - protein, 307 aa, Zea mays
  Sequence also found in Organisms: Sorghum bicolor, Saccharum officinarum
MSSPHGGLDDQIERLMQCKPLAEPEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLRLIARAHQLVMEGFNWAHEQKVVTIFSAPNYCYRCGNMASILEVDDCREHTFIQFEPAPRRGEPDVTRRTPDYFL

SEQ ID NO: 18258 - protein, 313 aa, Populus trichocarpa
MSLDSVATNAHGNLDEEISQLMQCKPLSEQEVRALCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18259 - protein, 314 aa, Cephalotaxus harringtonia
MSVEPVSSNGGFGQLDLHIEQLMQCKPLSEQEVRGLCEKAKEILMEESNVQPVKCPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDYKGHTFIQFEPAPRRGEPDVTRRTPDYFL

SEQ ID NO: 18260 - protein, 314 aa, Distylium racemosum
MSVEPVVSSNGYGQLDAQIEQLMQCKPLLEQEVRGLCDKAKEILMEESNVQPVKCPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDYKGHTFIQFEPAPRRGEPDVTRRTPDYFL

SEQ ID NO: 18261 - protein, 312 aa, Echinacea purpurea
MSVDLASNTHGNLDEQISQLMECKPLTEPEVKTLCEKAKEILMAESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFDPAPRRGEPDVTRRTPDYFL

SEQ ID NO: 18262 - protein, 314 aa, Sciadopitys verticillata
MSVEPVSSNGGYGQLDVQIEQLMQCKPLSEQEVRGLCEKAKEILMEESNVQPVKCPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDYKGHTFIQFEPAPRRGEPDVTRRTPDYFL

SEQ ID NO: 18263 - protein, 313 aa, Rosmarinus officinalis
MSADLVAESTHGNLDEQIAQLNQCKPLSEPEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSVETLDNIRNFDRVQEVPHEGPMCDLLWSDPDDRCGWGISPRGAGYTFGQDISEQFNHSNNLKLIARAHQLVMEGYNWAHEQKVVTIFSAPNYCYRCGNMASILEVDDCREHTFIQFEPAPRRGEPDVTRRTPDYFL

SEQ ID NO: 18264 - protein, 313 aa, Amsonia hubrichtii
MSADLVASSTHGNLDEQISQLMQCKPLSETEVRTLCEKAKEILMEESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWSHEQKVVTIFSAPNYCYRCGNMASILEVDDCRQHTFIQFEPAPRRGEPDVTRRTPDYFL

SEQ ID NO: 18265 - protein, 311 aa, Malus domestica
MDSVPSNSHGNLDEQIAQLMQCKPLSEQEVRVLCEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18266 - protein, 313 aa, Citrus clementina
  Sequence also found in Organisms: Citrus sinensis
MSLDSVPSNSHGNLDEQIAQLMQCKPLSEQEVRVLCEKAKEILMDESNVQPVKSPVTICGDIHGQFHDLAELFRIGGKCPDTNYLFMGDYVDRGYYSVETVTLLVSLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18267 - protein, 307 aa, Setaria italica
MSSPHGGLDDQIERLMQCKPLPEPEVRALCDKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 18268 - protein, 312 aa, Liriodendron tulipifera
IDPLPSSNSHGNLDEQISQLMQCKPLSEQEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKHGNASVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFL

SEQ ID NO: 18269 - protein, 307 aa, Zea mays
MSSPHGGLDDQIERLMQCKPLAEPEVRALCEKAKEILMEESNVQPVKSPVTICGDIHGQFHDLAELFRIGGKCPDTNYLFMGDYVDRGYYSVETVTLLVSLKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLRLIARAHQLVMEGFNWAHEQKVVTIFSAPNYCYRCGNMASILEVDDCREHTFIQFEPAPRRGEPDVTRRTPDYFL

SEQ ID NO: 18270 - protein, 307 aa, Pennisetum glaucum
MSSPHGGLDEQIERLMQCKPLPEPEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLRLIARAHQLVMEGFNWAHEQKVVTIFSAPNYCYRCGNMASILEVDDCREHTFIQFEPAPRRGEPDVTRRTPDYFL

SEQ ID NO: 18271 - protein, 313 aa, Mimulus guttatus
MSADLVAESTNGNLDEQIAQLMQCKPLPESEVRTLCEKAKEILMEESNVQPVKSPVTICGDIHGQFHDLAELFRIGGKCPDTNYLFMGDYVDRGYYSVETVTLLVSLKVRYPQRITILRGNHESRQITQVYGFYDECLRKYGNANVWKIFTDLFDYFPLTALVESEIFCLHGGLSPSVETLDNIRNFDRVQEVPHEGPMCDLLWSDPDDRCGWGISPRGAGYTFGQDISEQFNHTNNLKLIARAHQLVMEGYNWAHEQKVVTIFSAPNYCYRCGNMASILEVDDCREHTFIQFEPAPRRGEPDVTRRTPDYFL

SEQ ID NO: 18272 - protein, 311 aa, Tropaeolum majus
MDSVPSNSHGNLDEEISQLMQCKPLSEQEVRVLCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18273 - protein, 314 aa, Ananas comosus
MSSANSTAASSHGNLDEQISQLMQCKPLSEPEVRVLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18274 - protein, 311 aa, Prunus persica
  Sequence also found in Organisms: Prunus mume
MDAVPSNSHGNLDEQIAQLMQCKPLSEPEVRGLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18275 - protein, 307 aa, Secale cereale
MGNPRGGLDEQIEQLLQCKPLVEPELKALCEKAKEILMEESNVQPVRSPVTICGDIHGQFHDLAELFRIGGKCPDTNYLFMGDYVDRGYYSVETVSLLVALKVRYPHRLTILRGNHESRQITQVYGFYDECLRKYGSANVWKTFTDLFDYLPLTALVESEIFCLHGGLSPSIETLDNVRSFDRVQEVPHEGPMCDLLWSDPDDRCGWGISPRGAGYTFGQDISEQFNHTNSLKLIARAHQLVMEGFNWAHEQKVVTIFSAPNYCYRCGNMASILEVDDCREHTFIQFEPAPRRGEPDVTRRTPDYFL

SEQ ID NO: 18276 - protein, 313 aa, Selaginella moellendorffii
MNVAPVSSNGYGQLDAQIAQLMQCKPLVEHEVQALCEKAKEILMEENNVQPVKCPVTICGDIHGQFHDLAELFRIGGKCPDTNYLFMGDYVDRGYYSVETATLLVALKVRYPDRITILRGNHESRQITQVYGFYDECLRKYGNANVWKIFTDLFDYFPLTALVESEIFCLHGGLSPSIDTLDHVRQLDRVQEVPHEGPMCDLLWSDPDDRCGWGISPRGAGYTFGHDISEQFNHTNNLKLVARAHQLVMEGYNWGHEHKVVTIFSAPNYCYRCGNMASILEVDDNMGHTFIQFEPAPRRGEPDVTRRTPDYFL

SEQ ID NO: 18277 - protein, 313 aa, Tabernaemontana elegans
MSADLVAPSTHGNLDEQISQLMQCKPLSETEVRTLCEKAKEILMEESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWSHEQKVVTIFSAPNYCYRCGNMASILEVDDCRQHTFIQFEPAPRRGEPDVTRRTPDYFL

SEQ ID NO: 18278 - protein, 313 aa, Utricularia gibba
MSADLVASSAHGSLDEQIAQLMQCKPLSEPEVRALCEKAKEILKEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSVETLDNIRNFDRVQEVPHEGPMCDLLWSDPDDRCGWGISPRGAGYTFGQDISEQFNHTNNLKLIARAHQLVMEGYNWAHEQKVVTIFSAPNYCYRCGNMASILEVDDCGDHTFIQFEPAPRRGEPDVTRRTPDYFL

SEQ ID NO: 18279 - protein, 314 aa, Vinca minor
MSAADLVAPSSNGNLDEQISQLMQCKPLSETEVRALCEKAKEILMEESNVQPVRSPVTICGDIHGQFHDLAELFRIGGKCPDTNYLFMGDYVDRGYYSVETVTLLVALKVRYSQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWSHEQKVVTIFSAPNYCYRCGNMASILEVDDCRQHTFIQFEPAPRRGEPDVTRRTPDYFL

SEQ ID NO: 18280 - protein, 314 aa, Amorphophallus konjac
MSVADPVPSNSNGNLDEQISQLMQCKPLSEQEVRVLCDKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKVFTDLFDYFPLTALVESEIFCLHGGLSPSIETLDNVRNLDRVQEVPHEGPMCDLLWSDPDDRCGWGISPRGAGYTFGQDISEQFNHTNNLKLIARAHQLVMDGYNWGHEQKVVTIFSAPNYCYRCGNMASILEVDDCKGHTFIQFEPAPRRGEPDVTRRTPDYFL

SEQ ID NO: 18281 - protein, 313 aa, Aquilegia formosa
MNVDLVSSNSNGDLDEQISQLMQCKPLSEQEVRTLCDKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCRGHTFIQFEPAPRRGEPDVTRRTPDYFL

SEQ ID NO: 18282 - protein, 312 aa, Cirsium arvense
MSVDLASNTHGNLDEQISQLMQCKPLIEPEVRALCEKAKEILMGESNVQPVKSPVTICGDIHGQFHDLAELFRIGGKCPDTNYLFMGDYVDRGYYSVETVTLLVALKVRYPQRLTILRGNHESRQITQVYGFYDECLRKYGNANVWKTFTDLFDYFPLTALVESEIFCLHGGLSPSIETLDSIRSFDRVQEVPHEGPMCDLLWSDPDDRCGWGISPRGAGYTFGQDISEQFNHTNNLKLIARAHQLVMEGFNWGHDQKVVTIFSAPNYCYRCGNMASILEVDDCKGHTFIQFDPAPRRGEPDVTRRTPDYFL

SEQ ID NO: 18283 - protein, 312 aa, Taraxacum officinale
MNVELASNTHGNLDEQISQLMECKPLTEPEVRTLCEKAKEILMDESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18284 - protein, 312 aa, Flaveria ramosissima
MSVDLASNTHGNLDQQISQLMECKPLTEPEVKTLCEKAKEILMAESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFDPAPRRGEPDVTRRTPDYFL

SEQ ID NO: 18285 - protein, 312 aa, Flaveria ramosissima
MSVDLASNTHGNLDEQISQLMECKPLTEPEVKTLCEKAKEILMAESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFDPAPRRGEPDVTRRTPDYFL

SEQ ID NO: 18286 - protein, 314 aa, Vitis vinifera
MSFDPVPSSNNHGNLDEQISQLMQCKPLSEQEVRMLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFL

SEQ ID NO: 18287 - protein, 313 aa, Actinidia deliciosa
MTFDPVPSSTHGNLDEQISQLMQCKPLSEQEVRVLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCRGHTFIQFEPAPRRGEPDVTRRTPDYFL

SEQ ID NO: 18288 - protein, 313 aa, Plantago ovata
MTTDLVSASSGGNLDEQISQLMQCKPLSEPEVRGLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNNLKLIARAHQLVMEGYNWAHEQKVVTIFSAPNYCYRCGNMASILEVDDCREHTFIQFEPAPRRGEPDVTRRTPDYFL

SEQ ID NO: 18289 - protein, 312 aa, Helianthus annuus
MSVDLASNTHGNLDEQISQLMECKPLTEPEVKTLCEKAKEILMGESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFDPAPRRGEPDVTRRTPDYFL

SEQ ID NO: 18290 - protein, 314 aa, Taxus baccata
MSVEPVSSHGGFGQLDLHIEQLMQCKPLSEQEVRGLCEKAKEILMEESNVQPVKCPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDYKGHTFIQFEPAPRRGEPDVTRRTPDYFL

SEQ ID NO: 18291 - protein, 313 aa, Rosmarinus officinalis
MSADLVAPSTHGNLDDQISQLMQCKPLSETEVRTLCEKAKEILMEESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWSHEQKVVTIFSAPNYCYRCGNMASILEVDDCRQHTFIQFDPAPRRGEPDVTRRTPDYFL

SEQ ID NO: 18292 - protein, 312 aa, Centaurea maculosa
  Sequence also found in Organisms: Cirsium arvense
MSGELASNTHGNLDEQISQLMQCKPLTEPEVRTLCDKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHDQKVVTIFSAPNYCYRCGNMASILEVDDCKGHTFIQFEPAPRRGEPDVTRRTPDYFL

SEQ ID NO: 18293 - protein, 313 aa, Castanea mollissima
  Sequence also found in Organisms: Quercus alba
MGVNSLPSESSNDLDEQIAQLMECKPLSEQQVRALCEKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSIETLDNVRNFDRVQEVPHEGPMCDLLWSDPDDRCGWGISPRGAGYTFGQDISEQFNHTNNLKLIARAHQLVMDGFNWAHEQKVVTIFSAPNYCYRCGNMASILEVDDCRSHTFIQFEPAPRRGEPDVTRRTPDYFL

SEQ ID NO: 18294 - protein, 312 aa, Gossypium hirsutum
  Sequence also found in Organisms: Gossypium raimondii
MTSSVDSNSHGNLDEQISQLMQCKPLAEQEVRVLCDKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGYNWGHEQKVVTIFSAPNYCYRCGNMASILEVDDCQGHTFIQFEPAPRRGEPDVTRRTPDYFL

SEQ ID NO: 18295 - protein, 313 aa, Eucalyptus grandis
MGANSPSSDAGFDLDGQIAQLMQCKPLSEQQVKALCEKAKEILMEESNVQPVKSPVTICGDIHGQFHDLAELFRIGGECPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMDGFNWAHEQKVVTIFSAPNYCYRCGNMASILEVDDFKGHTFIQFEPAPRRGEPDVTRRTPDYFL

SEQ ID NO: 18296 - protein, 313 aa, Euonymus alatus
MSLDSVPSNSHGNLDEQISQLMQCKPLSEQEVRVLCDKAKEILMVESNVQPVKSPVTICGDIHGQFHDLAELFRIGGKCPDTNYLFMGDYVDRGYYSVETVTLLVALKVRYPHRITILRGNHESRQITQVYGFYDECLRKYGNANVWKTFTDLFDYFPLTALVESEIFCLHGGLSPSIETLDNIRNFDRMQEVPHDGPMCDLLWSDPDDRCGWGMSPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18297 - protein, 313 aa, Euonymus alatus
MSLDSVPSNSHGNLDEQISQLMQCKPLSEQEVRVLCDKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGMSPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18298 - protein, 312 aa, Heritiera littoralis
MESSVGSNSHGNLDEQISQLIQCKPISEQEVRVLCDKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDVSEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18299 - protein, 311 aa, Cucumis melo
  Sequence also found in Organisms: Citrullus lanatus
MDSVSSNSHGNLDEQISQLMQCKPLNEQEVRVLCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNNLKLIARAHQLVMEGYNWSHEQKVVTIFSAPNYCYRCGNMASILEVDDCKAHTFIQFEPAPRRGEPDVTRRTPDYFL

SEQ ID NO: 18300 - protein, 311 aa, Momordica charantia
MDSLSFNSHGNLDEQISQLMQCKPLNEQEVRGLCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNNLKLIARAHQLVMEGYNWSHEQKVVTIFSAPNYCYRCGNMASILEVDDCKAHTFIQFEPAPRRGEPDVTRRTPDYFL

SEQ ID NO: 18301 - protein, 312 aa, Nicotiana benthamiana
MDPVPSSASHGNLDEQIAQLMQCKPLSEQEVRGLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGAMCDLLWSDPDDRCGWGISPRGAGYTFGQDISEQFNHTNNLKLIARAHQLVMEGFNWAHDQKVVTIFSAPNYCYRCGNMASILEVDDSRERTFIQFEPAPRRGEPDVTRRTPDYFL

SEQ ID NO: 18302 - protein, 313 aa, Elaeis guineensis
MSANPAPASSHGNLDEQIAQLMQCKPLPEQEVRVLCEKAKEILMEESNVQPVQSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGAMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18303 - protein, 313 aa, Tripterygium wilfordii
MSLDSVPSNSHGNLDEQISQLMQCKPLSEQEVRVLCDKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNNLKLIARAHQLVMEGYNWGHEQKVVTIFSAPNYCYRCGNMASILEVDDCKGHTFIQFEPAPRRGEPDVTRRTPDYFL

SEQ ID NO: 18304 - protein, 313 aa, Aristolochia fimbriata
MSVDPVPSNSHGQIDEQISQLMQCKPLSEQEVRVLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFL

SEQ ID NO: 18305 - protein, 313 aa, Daucus carota
MNVDLAASNSHGNLDQQIAQLMQCKPLSEPEVRALCDKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGYNWGHDQKVVTIFSAPNYCYRCGNMASILEVDDCNGHTFIQFEPAPRRGEPDVTRRTPDYFL

SEQ ID NO: 18306 - protein, 313 aa, Chelidonium majus
MSVDAVASNSHGNLDEEIAQLMQCKPLSEQEVRGLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCRGHTFIQFEPAPRRGEPDVTRRTPDYFL

SEQ ID NO: 18307 - protein, 317 aa, Cynodon dactylon
GRVPPRPGGEDEQPHGGLDDQIERLMQCKPLPEPEARALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 18308 - protein, 313 aa, Panax ginseng
MNVDLVASNAHGNLDEQISQLMQCKPLSEPEVRALCDKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCRGHTFIQFEPAPRRGEPDVTRRTPDYFL

SEQ ID NO: 18309 - protein, 313 aa, Papaver somniferum
MSIDVITPNSHGNLDEEIAQLMQCKPLSEQEVRGLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCRGHTFIQFEPAPRRGEPDVTRRTPDYFL

SEQ ID NO: 18310 - protein, 313 aa, Valeriana officinalis
MSADLASSNSHGNLDQQIAQLMQCKPLSEPEVRGLCEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCRGHTFIQFEPAPRRGEPDVTRRTPDYFL

SEQ ID NO: 18311 - protein, 314 aa, Pinus pinaster
  Sequence also found in Organisms: Pinus taeda, Pseudotsuga menziesii
MSAEPVSSSSGYGQLDAQIEQLMQCKPLSEQEVRGLCEKAKEILMEESNVQPVKCPVTICGDIHGQFHDLAELFRIGGKCPDTNYLFMGDYVDRGYYSVETVTLLVSLKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDTKGHTFIQFEPAPRRGEPDVTRRTPDYFL

SEQ ID NO: 18312 - protein, 314 aa, Abies balsamea
MSAEPVSSSSGYGQLDAQIEQLMQCKPLSEQEVRGLCEKAKEILMEESNVQPVKCPVTICGDIHGQFHDLAELFRIGGKCPDTNYLFMGDYVDRGYYSVETVTLLVSLKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDTKEHTFIQFEPAPRRGEPDVTRRTPDYFL

SEQ ID NO: 18313 - protein, 312 aa, Ambrosia trifida
MSIDLATNTHGNLDEQIAQLMECKPLSEPEVKTLCEKAKEILMGESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFDPAPRRGEPDVTRRTPDYFL

SEQ ID NO: 18314 - protein, 313 aa, Malus domestica
MGVNSVSTDTSSDLNEQIEQLMQCKPLSEQQVRMLCEKAKEILMGESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIENLDNIRNFDRVQEVPHEGPMCDLLWSDPDDRCGWGISPRGAGYTFGQDISEQFNHTNNLKLIARAHQLVMDGFNWAHEQKVVTIFSAPNYCYRCGNMASVLEVDDCRGHTFIQFEPAPRRGEPDVTRRTPDYFL

SEQ ID NO: 18315 - protein, 313 aa, Malus domestica
MGVNSVSSDTNSDLNEQIEQLMQCKPLSEQQVRMLCEKAKEILMGESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIENLDNIRNFDRVQEVPHEGPMCDLLWSDPDDRCGWGISPRGAGYTFGQDISEQFNHTNNLKLIARAHQLVMDGFNWAHEQKVVTIFSAPNYCYRCGNMASVLEVDDCRGHTFIQFEPAPRRGEPDVTRRTPDYFL

SEQ ID NO: 18316 - protein, 312 aa, Artemisia annua
MSVDLASNTHGNLDQQIAHLIQCKPLNEPEVKTLCDKAKEILMEESNVQPVRSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDSVRSFDRVQEVPHEGPMCDLLWSDPDDRCGYGISPRGAGYTFGQDISEQFNHTNNLKLIARAHQLVMEGFNWAHDQKVVTIFSAPNYCYRCGNMASILEVDDCQGHTFIQFEPAPRRGEPDVTRRTPDYFL

SEQ ID NO: 18317 - protein, 314 aa, Musa acuminata
MSVNAVLAPNSHGNLDEQIAQLMQCKPLSEQEVRVLCEKAKEVLMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRSFDRVQEVPHEGPMCDLLWSDPDDRCGWGISPRGAGYTFGQDISEQFNHTNNLKLIARAHQLVMEGYNWGHDQKVVTIFSAPNYCYRCGNMASICEVDDCKDHTFIQFEPAPRRGEPDVSRRTPDYFL

SEQ ID NO: 18318 - protein, 307 aa, Hordeum vulgare
MSSPHGGLDDQIERLMQCKPLPEAEVRALCEKAKEILMEESNVQPVRSPVTICGDIHGQFHDLAELFRIGGKCPDTNYLFMGDYVDRGYYSVETVTLLVSLKVRYPQRITILRGNHESRQITQVYGFYDECLRKYGNANVWKTFTDLFDYFPLTALVESEIFCLHGGLSPSIETLDNIRNFDRTQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 18319 - protein, 307 aa, Brachypodium distachyon
MSSPHGGLDDQIERLMQCKPLPEAEVRALCEKAKEILMEESNVQPVKSPVTICGDIHGQFHDLAELFRIGGKCPDTNYLFMGDYVDRGYYSVETVTLLVSLKVRYPQRITILRGNHESRQITQVYGFYDECLRKYGNATVWKTFTDLFDYFPLTALVESEIFCLHGGLSPSIETLDNIRNFDRIQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 18320 - protein, 307 aa, Brachypodium distachyon
MGNPHGGLDEQIEQLLQCKPLAEPELRALCGKAKEVLMEESNVQPVRSPVTICGDIHGQFHDLAELFRIGGKCPDTNYLFMGDYVDRGYYSVETVSLLVALKVRYPHRITILRGNHESRQITQVYGFYDECLRKYGSATVWKTFTDLFDYFPLTALVESEIFCLHGGLSPSIETLDNVRSFDRIQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 18321 - protein, 315 aa, Catharanthus roseus
MSSDPAVASSGGLGNLDEQISQLMQCKPLSEQEVRGLCEKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSVETLDNIRNFDRVQEVPHEGPMCDLLWSDPDDRCGWGISPRGAGYTFGQDISEQFNHTNNLKLIARAHQLVMEGFNWAHDQKVVTIFSAPNYCYRCGNMASILEVDDCRGHTFIQFEPAPRRGEPDVTRRTPDYFL

SEQ ID NO: 18322 - protein, 312 aa, Centaurea maculosa
MSVDLASNTHGNLDEQISQLMQCKPLIEPEVRALCEKAKEILMGESNVQPVKSPVTICGDIHGQFHDLAELFRIGGKCPDTNYLFSGDYVDRGYYSVETVTLLVALKVRYPQRLTILRGNHESRQITQVYGFYDECLRKYGNANVWKTFTDLFDYFPLTALVESEIFCLHGGLSPSIETLDSIRSFDRVQEVPHEGPMCDLLWSDPDDRCGWGISPRGAGYTFGQDISEQFNHTNNLKLIARAHQLVMEGFNWGHDQKVVTIFSAPNYCYRCGNMASILEVDDCKGHTFIQFDPAPRRGEPDVTRRTPDYFL

SEQ ID NO: 18323 - protein, 313 aa, Citrus clementina
  Sequence also found in Organisms: Citrus sinensis
MGANSLSTDTTTDLDEQISQLMQCKPLSEPQVKALCEKAKEILMEESNVQPVKSPVTICGDIHGQFHDLAELFQIGGKCPDTNYLFMGDYVDRGYYSVETVTLLVALKVRYPQRITILRGNHESRQITQVYGFYDECLRKYGNANIWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMDGFNWAHEQKVVTIFSAPNYCYRCGNMASILEVDDCRSHTFIQFEPAPRRGEPDVTRRTPDYFL

SEQ ID NO: 18324 - protein, 313 aa, Cleome gynandra
MGANSFPTDSTLDLDEQISQLMQCKPLSEQQVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHGGPMCDLLWSDPDDRCGWGISPRGAGYTFGQDISEQFNHTNNLKLIARAHQLVMDGFNWAHEQKVVTIFSAPNYCYRCGNMASILEVDDCRNHTFIQFEPAPRRGEPDVTRRTPDYFL

SEQ ID NO: 18325 - protein, 313 aa, Cyclamen graecum
MSTDLVQSNALGNLDEQIEQLMQCKPLSEPEVRGLCEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRSFDRVQEVPHEGPMCDLLWSDPDDRCGWGISPRGAGYTFGQDISEQFNQTNSLKLIARAHQLVMEGFNWGHDQKVVTIFSAPNYCYRCGNMASILEVDDCKGHTFIQFEPAPRRGEPDVTRRTPDYFL

SEQ ID NO: 18326 - protein, 307 aa, Festuca arundinacea
MGNPHGGLDEEIEQLLQCKPLAEPKLKALCEKAKEILMEESNVQPVRSPVTICGDIHGQFHDLAELFRIGGKCPDTNYLFMGDYVDRGYYSVETVSLLVALKVRYPQRITILRGNHESRQITQVYGFYDECLRKYGSANVWKTFTDLFDYLPLTALVESEIFCLHGGLSPSIETLDNVRSFDRVQEVPHEGPMCDLLWSDPDDRCGWGISPRGAGYTFGQDISEQFNHTNGLKLISRAHQLVMEGFNWAHEQKVVTIFSAPNYCYRCGNMASILEVDDCREHTFIQFEPAPRRGEPDVTRRTPDYFL

SEQ ID NO: 18327 - protein, 311 aa, Flaveria ramosissima
SVDLASNTHGNLDEQISQLMECKPLTEPEVKTLCEKAKEILMAESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFDPAPRRGEPDVTRRTPDYFL

SEQ ID NO: 18328 - protein, 311 aa, Panax ginseng
MDPVHSSANGNLDEEIVQLMQCKPLSEQEVRVLCEKAKEILMDESNVQPVKSPVTICGDIHGQFHDLAELFQIGGKCPDTNYLFMGDYVDRGYYSVETVTLLAALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFL

SEQ ID NO: 18329 - protein, 311 aa, Panax ginseng
MDPVHSSANGNLDEEIAQLMQCKPLSEQEVRVLCEKAKEILMDESNVQPVKSPVTICGDIHGQFHDLAELFQIGGKCPDTNYLFMGDYVDRGYYSVETVTLLVALKVRYPQRITILRGNHESRQITQVYGFYDECLRKYSNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFL

SEQ ID NO: 18330 - protein, 314 aa, Liriodendron tulipifera
MSADPVPSSNSHGQLDEQISQLMQCKPLSEQEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNKLKLIARAHQLVMEGFNWGHEHKVVTIFSAPNYCYRCGNMASILEVDDCKGHTFIQFEPAPRRGEPDVTRRTPDYFL

SEQ ID NO: 18331 - protein, 312 aa, Nicotiana benthamiana
MSLDPVVSSQGNLDEQIAQLMQCKPLSEQEVRGLCGKAKEILMNESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGAMCDLLWSDPDDRCGWGISPRGAGYTFGQDISEQFNHTNNLKLIARAHQLVMEGFNWAHDQKVVTIFSAPNYCYRCGNMASILEVDDCNGHTFIQFEPAPRRGEPDVTRRTPDYFL

SEQ ID NO: 18332 - protein, 310 aa, Nicotiana benthamiana
PVPSSASHGNLDEQIAQLMQCKPLSEQEVRGLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGAMCDLLWSDPDDRCGWGISPRGAGYTFGQDISEQFNHTNNLKLIARAHQLVMEGFNWAHDQKVVTIFSAPNYCYRCGNMASILEVDDSRERTFIQFEPAPRRGEPDVTRRTPDYFL

SEQ ID NO: 18333 - protein, 314 aa, Allium cepa
MGVDPVPSSNSHGNLDEEIAQLMQCKPLSEQEVKVLCEKAKEILMEESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18334 - protein, 313 aa, Podocarpus macrophillus
MSVEPVSANGYGQLDNQIEQLMQCKPLSEQEVRGLCERAKEILMEESNVQPVKCPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDYKGHTFIQFEPAPRRGEPDVTRRTPDYFL

SEQ ID NO: 18335 - protein, 313 aa, Papaver somniferum
MSVDPVSTNTHGNIDEQISQLMQCKPLPEQEVRTLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCRGHTFIQFEPAPRRGEPDVTRRTPDYFL

SEQ ID NO: 18336 - protein, 313 aa, Papaver somniferum
MSVDPVSTNTHGNIDEQISQLMQCKPLPEQEVRTLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFL

SEQ ID NO: 18337 - protein, 313 aa, Primula obconica
MSTDLVQSNAHGNLDEQIQQLMQCKPLSEPEVRGLCEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRSFDRVQEVPHEGPMCDLLWSDPDDRCGWGISPRGAGYTFGQDISEQFNHTNSLKLIARAHQLVMEGFNWGHDQKVVTIFSAPNYCYRCGNMASILEVDDCKGHTFIQFEPAPRRGEPDVTRRTPDYFL

SEQ ID NO: 18338 - protein, 313 aa, Rhizophora mangle
MSLDSIPSNTHGSLDEQINQLMQCKPLSEHEVRVLCEKAKEILMEENNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18339 - protein, 314 aa, Picea glauca
MSGEPVSSSSGYGQLDAQIEQLMQCKPLSEQEVRGLCEKAKEILMEESNVQPVKCPVTICGDIHGQFHDLAELFRIGGKCPDTNYLFMGDYVDRGYYSVETVTLLVSLKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDTKGHTFIQFEPAPRRGEPDVTRRTPDYFL

SEQ ID NO: 18340 - protein, 315 aa, Triphysaria pusilla
MDTTMASTGGGASGNLDEQIAQLMQCKPLSEQEVRALCEKAKEILMNESNVQPVKSPVTICGDIHGQFHDLAELFRIGGKCPDTNYLFMGDYVDRGYYSVETVTLLVALKVRFPQRLTILRGNHESRQITQVYGFYDECLRKYGNANVWKTFTDLFDYFPLTALVESEIFCLHGGLSPSIETLDNVRNFDRVQEVPHEGAMCDLLWSDPDDRCGWGISPRGAGYTFGQDISEQFNHTNGLKLIARAHQLVMEGFNWAHEQKVVTIFSAPNYCYRCGNMASILEVDDCRGHSFIQFEPAPRRGEPDVTRRTPDYFL

SEQ ID NO: 18341 - protein, 315 aa, Triphysaria pusilla
MDTTMASAGGGASGNLDEQIAQLMQCKPLSEQEVRALCEKAKEILMDESNVQPVKSPVTICGDIHGQFHDLAELFRIGGKCPDTNYLFMGDYVDRGYYSVETVTLLVALKVRFPQRLTILRGNHESRQITQVYGFYDECLRKYGNANVWKTFTDLFDYFPLTALVESEIFCLHGGLSPSIETLDNVRNFDRVQEVPHEGAMCDLLWSDPDDRCGWGISPRGAGYTFGQDISEQFNHTNGLKLIARAHQLVMEGFNWAHEQKVVTIFSAPNYCYRCGNMASILEVDDCRGHSFIQFEPAPRRGEPDVTRRTPDYFL

SEQ ID NO: 18342 - protein, 313 aa, Triphysaria pusilla
MSADLVAESTNGNLDEQIAQLMQCKPLPEPEVRALCEKAKEILMVESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLNLIARAHQLVMEGFNWAHEQKVVTIFSAPNYCYRCGNMASILEVDDCGDQTFIQFEPAPRRGEPDVTRRTPDYFL

SEQ ID NO: 18343 - protein, 313 aa, Valeriana officinalis
MSFDPVPSGAQGNLDEEISQLMQCKPLSEQEVRVLCEKAKEILMNESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFDPAPRRGEPDVTRRTPDYFL

SEQ ID NO: 18344 - protein, 307 aa, Triticum aestivum
MGNPRGGLDEQIEQLLQCKPLVEPELKALCEKAKEILMEESNVQPVRSPVTICGDIHGQFHDLAELFRIGGKCPDTNYLFMGDYVDRGYYSVETVSLLVALKVRYPHRLTILRGNHESRQITQVYGFYDECLRKYGSANVWKTFTDLFDYLPLTALVESEIFCLHGGLSPSIETLDNVRGFDRIQEVPHEGPMCDLLWSDPDDRCGWGISPRGAGYTFGQDISEQFNHTNSLKLIARAHQLVMEGFNWAHEQKVVTIFSAPNYCYRCGNMASILEVDDCREHTFIQFEPAPRRGEPDVTRRTPDYFL

SEQ ID NO: 18345 - protein, 307 aa, Triticum aestivum
MGNPRGGLDEQIEQLLQCKPLVEPELKALCEKAKEILMEESNVQPVRSPVTICGDIHGQFHDLAELFRIGGKCPDTNYLFMGDYVDRGYYSVETVSLLVALKVRYPHRLTILRGNHESRQITQVYGFYDECLRKYGSANVWKTFTDLFDYLPLTALVESEIFCLHGGLSPSIETLDNVRGFDRIQEVPHEGPMCDLLWSDPDDRCGWGISPRGAGYTFGQDISEQFNHTNSLKLIARAHQLVMEGFNWAHEQKVVTIFSAPNYCYRCGNMASILEVDDCKEHTFIQFEPAPRRGEPDVTRRTPDYFL

SEQ ID NO: 18346 - protein, 314 aa, Epimedium sagittatum
MSVDQIPSSNSQGNLDEQISQLMQCKPLSEQEVRGLCEKAKEILMEENNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCRGHTFIQFEPAPRRGEPDVTRRTPDYFL

SEQ ID NO: 18347 - protein, 313 aa, Eschscholzia californica
MSVDQIASNSHGNLDEQISQLMQCKPLSEQEVRTLCEKAKEILMTESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGFNWGHEQKVVTIFSAPNYCYRCGNMASILEVDDCRGHTFIQFEPAPRRGEPDVTRRTPDYFL

SEQ ID NO: 18348 - protein, 313 aa, Mimulus guttatus
MSADLVAASTNGNLDEQIAQLMQCKPLSEPEVRTLCEKAKEILMLESNVQPVKSPVTICGDIHGQFHDLAELFRIGGKCPDTNYLFMGDYVDRGYYSVETVTLLVSLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWAHEQKVVTIFSAPNYCYRCGNMASILEVDDCREHTFIQFEPAPRRGEPDVTRRTPDYFL

SEQ ID NO: 18349 - protein, 317 aa, Tabernaemontana elegans
MSSDPAVASSGGAHHGNLDEQISQLMQCKPLSEQEVRGLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSVETLDNIRNFDRVQEVPHEGPMCDLLWSDPDDRCGWGISPRGAGYTFGQDISEQFNHTNNLKLIARAHQLVMEGFNWAHDQKVVTIFSAPNYCYRCGNMASILEVDDCKGHTFIQFEPAPRRGEPDVTRRTPDYFL

SEQ ID NO: 18350 - protein, 317 aa, Vinca minor
MSSNPAVASSGGAHHGNLDEQISQLMQCKPLSEPEVRGLCEKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWAHDQKVVTIFSAPNYCYRCGNMASILEVDDCKGHTFIQFEPAPRRGEPDVTRRTPDYFL

SEQ ID NO: 18351 - protein, 307 aa, Hordeum vulgare
  Sequence also found in Organisms: Secale cereale, Triticum aestivum
MSSPHGGLDDQIERLMQCKPLPEAEVRALCEKAKEILMEESNVQPVRSPVTICGDIHGQFHDLAELFRIGGKCPDTNYLFMGDYVDRGYYSVETVTLLVSLKVRYPQRITILRGNHESRQITQVYGFYDECLRKYGNATVWKTFTDLFDYFPLTALVESEIFCLHGGLSPSIETLDNIRNFDRTQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 18352 - protein, 311 aa, Glycine max
  Sequence also found in Organisms: Vigna unguiculata, Cajanus cajan
MDSVPSNSHGNLDEQISQLMQCKPLSEQEVRVLCDKAKEILMEESNVQPVKSPVTICGDIHGQFHDLAELFRIGGKCPDTNYLFMGDYVDRGYYSVETVTLLVALKVRYRQRITILRGNHESRQITQVYGFYDECLRKYGSANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPRRGEPDVTRRTPDYFL

SEQ ID NO: 18353 - protein, 312 aa, Ambrosia trifida
MSTDLATNTHGNLDEQIAQLMECKPLTEPEVKTLCEKAKEILMGESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDSIRNFDRVQEVPHEGPMCDLLWSDPDDRCGWGISPRGAGYTFGQDISEQFNHTNSLKLIARAHQLVMEGYNWGHEQKVVTIFSAPNYCYRCGNMASILEVDDCKGHTFIQFDPAPRRGEPDVTRRTPDYFL

SEQ ID NO: 18354 - protein, 313 aa, Arabidopsis thaliana
  Sequence also found in Organisms: Arabidopsis lyrata
MGANSIPTDATIDLDEQISQLMQCKPLSEQQVRALCEKAKEILMDESNVQPVKSPVTICGDIHGQFHDLAELFRIGGMCPDTNYLFMGDYVDRGYYSVETVTLLVALKMRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMDGYNWAHEQKVVTIFSAPNYCYRCGNMASILEVDDCRNHTFIQFEPAPRRGEPDVTRRTPDYFL

SEQ ID NO: 18355 - protein, 313 aa, Arabidopsis thaliana
  Sequence also found in Organisms: Arabidopsis lyrata
MGANSLPTDATLDLDEQISQLMQCKPLSEQQVRALCEKAKEILMDESNVQPVKSPVTICGDIHGQFHDLAELFRIGGKCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMDGFNWAHEQKVVTIFSAPNYCYRCGNMASILEVDDCRNHTFIQFEPAPRRGEPDVTRRTPDYFL

SEQ ID NO: 18356 - protein, 312 aa, Arnica chamissonis
MSVDLASNTHGNLDEQISQLMECKPLTEPEVKTLCEKAKEILMGESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDSIRNFDRVQEVPHEGPMCDLLWSDPDDRCGWGISPRGAGYTFGQDISEQFNHTNSLKLIARAHQLVMEGFNWGHEQKVVTIFSAPNYCYRCGNMASILEVDDCKGHTFIQFDPAPRRGEPDVTRRTPDYFL

SEQ ID NO: 18357 - protein, 312 aa, Artemisia annua
  Sequence also found in Organisms: Chrysanthemum coronarium
MSVDLASNTHGNLDEQISQLMECKPLIEPEVKTLCEKAKEILMNESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNSLKLIARAHQLVMEGFNWGHEQKVVTIFSAPNYCYRCGNMASILEVDDCKGHTFIQFDPAPRRGEPDVTRRTPDYFL

SEQ ID NO: 18358 - protein, 314 aa, Musa acuminata
MSAKAVPAPNSHGNLEEQIAQLMQCKPLSEQEVRVLCEKAKEVLMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPRRGEPDVTRRTPDYFL

SEQ ID NO: 18359 - protein, 311 aa, Phaseolus vulgaris
MDSVPSNSHGNLDEQISQLMQCKPLSEQEVRVLCDKAKEILMEESNVQPVKSPVTICGDIHGQFHDLAELFRIGGKCPDTNYLFMGDYVDRGYYSVETVTLLVALKVRYRQRITILRGNHESRQITQVYGFYDECLRKYGTANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPRRGEPDVTRRTPDYFL

SEQ ID NO: 18360 - protein, 313 aa, Manihot esculenta
MGTNSLSSDSVSDLDEQISQLMQCRPLSELQVRALCDKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDGVRNFDRVQEVPHEGAMCDLLWSDPDDRCGWGISPRGAGYTFGQDISEQFNHTNNLKLIARAHQLVMDGFNWAHEQKVVTIFSAPNYCYRCGNMASILEVDDCKAHTFIQFEPAPRRGEPDVTRRTPDYFL

SEQ ID NO: 18361 - protein, 312 aa, Cirsium arvense
MSVDLASNTHGNLDEQISQLMQCKPLNEPEVRTLCEKAKEILMGESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHDQKVVTIFSAPNYCYRCGNMASILEVDDCKGHTFIQFDPAPRRGEPDVTRRTPDYFL

SEQ ID NO: 18362 - protein, 313 aa, Cyclamen graecum
MSSDLLQSNAHGNLDEQIEQLMQCKPLSEPEVRGLCEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRSFDRVQEVPHEGPMCDLLWSDPDDRCGWGISPRGAGYTFGQDISEQFNNTNSLKLIARAHQLVMEGFNWGHDQKVVTIFSAPNYCYRCGNMASILEVDDCKGHTFIQFEPAPRRGEPDVTRRTPDYFL

SEQ ID NO: 18363 - protein, 313 aa, Fagopyrum esculentum
MSFDPVPSNSHHNLDEQIAQLMQCKPLSEQEVRGLCEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGYNWGHDQKVVTIFSAPNYCYRCGNMASILEVDDCKGHTFIQFEPAPRRGEPDVTRRTPDYFL

SEQ ID NO: 18364 - protein, 313 aa, Humulus lupulus
MGMNSISSESNIDLNEQISQLMECKPLSEQQVRALCDKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKSHTFIQFEPAPRRGEPDVTRRTPDYFL

SEQ ID NO: 18365 - protein, 313 aa, Lotus japonicus
MGANSLPSESTHDLDEQISQLMQCKPLSEQQVKELCEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKTFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 18366 - protein, 308 aa, Medicago truncatula
MDSNSHGNLDEQISQLMQCKPLSEQEVRVLCDKAKEILMEESNVQPVKSPVTICGDIHGQFHDLAELFRIGGKCPDTNYLFMGDYVDRGYYSVETVTLLVSLKVRYRQRITILRGNHESRQITQVYGFYDECLRKYGSANVWKMFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18367 - protein, 311 aa, Tropaeolum majus
MDSVPSNSHGNLDEEINQLMQCKPLSEQEVRVLCEKAKEVLMKENNVQPVKSPVTICGDIHGQFHDLAELFRIGGKWPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCQGHTFIQFDPAPRRGEPDVTRRTPDYFL

SEQ ID NO: 18368 - protein, 313 aa, Phalaenopsis aphrodite
MSVNPVQASSHGNLDEQITQLMQCKPLTEQEVRVLCDKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMDGYNWGHDQKVVTIFSAPNYCYRCGNMASILEVDDCKGHTFIQFDPAPRRGEPDVTRRTPDYFL

SEQ ID NO: 18369 - protein, 312 aa, Solanum lycopersicum
  Sequence also found in Organisms: Solanum tuberosum, Solanum phureja
MSSDLIANTHGNLDEQISQLMQCKPLSEPEVRALCEKAKEILMEESNVQPVKSPVTICGDIHGQFHDLAELFRIGGQCPDTNYLFMGDYVDRGYYSVETVTLLVALKVRYPQRLTILRGNHESRQITQVYGFYDECLRKYGNANVWKTFTDLFDYFPLTALVESEIFCLHGGLSPSIETLDNVRSFDRVQEVPHEGAMCDLLWSDPDDRCGWGMSPRGAGYTFGQDISEQFHHTNNLKLIARAHQLVMEGYNWSHEQKVVTIFSAPNYCYRCGNMASILEVDDCRGHTFIQFDPAPRRGEPDVTRRTPDYFL

SEQ ID NO: 18370 - protein, 313 aa, Primula obconica
MSTDLVQSNAHGNLDLQIQQLMQCKPLSEPEVRGLCEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIDTLDNIRSFDRVQEVPHEGPMCDLLWSDPDDRCGWGISPRGAGYTFGQDISEQFNHTNSLKLIARAHQLVMEGFNWGHDQKVVTIFSAPNYCYRCGNMASILEVDDCKGHTFIQFEPAPRRGEPDVTRRTPDYFL

SEQ ID NO: 18371 - protein, 313 aa, Chenopodium quinoa
MSFDPVPSNSHHNLDEQIGQLMQCKPLSEQEVRTLCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISDQFNHTNNLKLIARAHQLVMEGFNWAHDQKVVTIFSAPNYCYRCGNMASILEVDDCKGHTFIQFEPAPRRGEPDVTRRTPDYFL

SEQ ID NO: 18372 - protein, 302 aa, Secale cereale
GGLDDQIERLMQCKPLPEAEVRALCEKAKEILMEESNVQPVRSPVTICGDIHGQFHDLAELFRIGGKCPDTNYLFMGDYVDRGYYSVETVTLLVSLKVRYPQRITILRGNHESRQITQVYGFYDECLRKYGNATVWKTFTDLFDYFPLTALVESEIFCLHGGLSPSIETLDNIRNFDRTQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 18373 - protein, 313 aa, Solanum phureja
MSLDPVVSSSQGNLDEQIAQLMQCKPLSEQEVKGLCQKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSVETLDNIRNFDRVQEVPHEGAMCDLLWSDPDDRCGWGISPRGAGYTFGQDISEQFNHTNGLKLIARAHQLVMEGFNWAHDQKVVTIFSAPNYCYRCGNMASILEVDDCNGHTFIQFEPAPRRGEPDVTRRTPDYFL

SEQ ID NO: 18374 - protein, 313 aa, Thalictrum flavum
MSVDPVSTHSHGHIDEQISQLMQCKPLSEQEVRTLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCRGHTFIQFEPAPRRGEPDVTRRTPDYFL

SEQ ID NO: 18375 - protein, 313 aa, Eutrema halophilum
MGANSIPTDATIDLDEQISQLMQCKPLSEQQVKALCEKAKEILMDESNVQPVKSPVTICGDIHGQFHDLAELFRIGGMCPDTNYLFMGDYVDRGYYSVETVTLLVALKMRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNNLKLIARAHQLVMDGYNWAHEQKVVTIFSAPNYCYRCGNMASILEVDDCRNHTFIQFEPAPRRGEPDVTRRTPDYFL

SEQ ID NO: 18376 - protein, 312 aa, Nicotiana tabacum
MDPVPSSASHGNLDEQIAQLMQCKPLSEQEVRGLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTASVESHIFCLHGGLSPSIETLDNIRNFDRVQEVPHEGAMCDLLWSDPDDRCGWGISPRGAGYTFGQDISEQFNHTNNLKLIARAHQLVMEGFNWAHDQKVVTIFSAPNYCYRCGNMASILEVDDSRERTFIQFEPAPRRGEPDVTRRTPDYFL

SEQ ID NO: 18377 - protein, 313 aa, Solanum lycopersicum
MSLDPVVSSSQGNLDEQIAQLMQCKPLSEQEVKGLCQKAKEILMDESNVQPVKSPVTICGDIHGQFHDLAELFRIGGKCPDTNYLFMGDYVDRGYYSVETVTLLVSLKVRYPQRITILRGNHESRQITQVYGFYDECLRKYGNANVWKTFTDLFDYFPLTALVESEIFCLHGGLSPSIETLDNIRNFDRVQEVPHEGAMCDLLWSDPDDRCGWGISPRGAGYTFGQDISEQFNHTNGLKLIARAHQLVMEGFNWAHDQKVVTIFSAPNYCYRCGNMASILEVDDCNGHTFIQFEPAPRRGEPDVTRRTPDYFL

SEQ ID NO: 18378 - protein, 308 aa, Trigonella foenum-graecum
MDSNSHGNLDEQISQLMQCKPLSEQEVRVLCDKAKEILMEESNVQPVKSPVTICGDIHGQFHDLAELFRIGGKCPDTNYLFMGDYVDRGYYSVETVTLLVALKVRYRQRITILRGNHESRQITQVYGFYDECLRKYGSANVWKMFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPRRGEPDVTRRTPDYFL

SEQ ID NO: 18379 - protein, 310 aa, Tripterygium wilfordii
MSLDSNSHGNLDEQISQLMQCKPLSEHEVRVLCDKAKEILMDESNVQPVKSPVTICGDIHGQFHDLAELFRIGGKCPDTNYLFMGDYVDRGYYSVETVALLVALKVRYPQRITILRGNHESRQITQVYGFYDECLRKYGSANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18380 - protein, 313 aa, Tripterygium wilfordii
MSLDSVPSNSHGNLDEQISQLMQCKPLSEHEVRVLCDKAKEILMDESNVQPVKSPVTICGDIHGQFHDLAELFRIGGKCPDTNYLFMGDYVDRGYYSVETVALLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHANNLKLIARAHQLVMEGYNWGHEQKVVTIFSAPNYCYRCGNMASILEVDDCKGHTFIQFEPAPRRGEPDVTRRTPDYFL

SEQ ID NO: 18381 - protein, 317 aa, Amsonia hubrichtii
MSSDPAVASSGGAHHGNLDEQISQLMQCKPLSEQEVRGLCEKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSVETLDNIRNFDRVQEVPHEGPMCDLLWSDPDDRCGWGISPRGAGYTFGQDISEQFNHTNNLKLIARAHQLVMEGFNWAHDQKVVTIFSAPNYCYRCGNMASILEVDDCKGHTFIQFEPAPRRGEPDVTRRTPDYFL

SEQ ID NO: 18382 - protein, 317 aa, Vinca minor
MSSDPAVASSGGAHHGNLDEQISQLMQCKPLSEPEVRGLCEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWAHDQKVVTIFSAPNYCYRCGNMASILEVDDCNGHTFIQFDPAPRRGEPDVTRRTPDYFL

SEQ ID NO: 18383 - protein, 313 aa, Aquilegia formosa
MSVDPVSTHSHGHIDEQISQLMQCKPLSEQEVRTLCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCRGHTFIQFEPAPRRGEPDVTRRTPDYFL

SEQ ID NO: 18384 - protein, 313 aa, Theobroma cacao
MGANPSPTDSTTDLDEQISQLMQCKPLSEQQVRALCDKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCQSHTFIQFEPAPRRGEPDVTRRTPDYFL

SEQ ID NO: 18385 - protein, 311 aa, Daucus carota
MNADLASSNANLDEQISQLMQCKPLSEPQVRALCDKAKEILMKESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGYNWGHDQKVVTIFSAPNYCYRCGNMASILEVDDCNGHTFIQFEPAPRRGEPDVTRRTPDYFL

SEQ ID NO: 18386 - protein, 313 aa, Daucus carota
MSYDPVQSSANGNLDEQIAQLIQCKPLSEQEVRVLCEKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFM

SEQ ID NO: 18387 - protein, 311 aa, Trifolium pratense
  Sequence also found in Organisms: Vicia sativa
MDSVPSNSHGNLDEQIAQLMQCKPLSEQEVRVLCDKAKEILMEESNVQPVKSPVTICGDIHGQFHDLAELFRIGGKCPDTNYLFMGDYVDRGYYSVETVTLLVSLKVRYRQRITILRGNHESRQITQVYGFYDECLRKYGSANVWKMFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPRRGEPDVTRRTPDYFL

SEQ ID NO: 18388 - protein, 313 aa, Cucumis sativus
MGTDSMLSEANSSLDEQISQLMQCKPLSEQQVRALCDKAKEVLMEESNVQPVKSPVTICGDIHGQFHDLAELFQIGGKCPDTNYLFMGDYVDRGYYSVETVTLLVALKVRYPHRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHMNNLKLIARAHQLVMDGFNWAHEQKVVTIFSAPNYCYRCGNMASILEVDDCKSHTFIQFEPAPRRGEPDVTRRTPDYFL

SEQ ID NO: 18389 - protein, 313 aa, Eucalyptus grandis
MSLDSVPANSHGNIDEEISQLMQCKPLSEQEVRVLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNNLKLIARAHQLVMEGYNWSHEQKVVTIFSAPNYCYRCGNMASILEVDDCRAHTFIQFEPAPRRGEPDVTRRTPDYFL

SEQ ID NO: 18390 - protein, 312 aa, Flaveria ramosissima
MSVDLASNSHGNLDEQISQLMQCKPLSEPEVKGLCQKAKETLMDESNVQPVKSPVTICGDIHGQFHDLAELFRIGGKCPDTNYLFMGDYVDRGYYSVETVTLLVALKVRYPQRITILRGNHESRQITQVYGFYDECLRKYGTANVWKMFTDLFDYFPLTALVESEIFCLHGGLSPSIETLDSIRSFDRVQEVPHEGPMCDLLWSDPDDRCGWGISPRGAGYTFGQDISEQFNHTNNLKLIARAHQLVMEGFNWGHDQKVVTIFSAPNYCYRCGNMASILEVDDCKGHTFIQFDPAPRRGEPDVTRRTPDYFL

SEQ ID NO: 18391 - protein, 313 aa, Panax ginseng
MSVDLAASKAHGNLDEQISQLMQCKPLPEPEVMALCDKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISDQFNHTNNLKLIGRAHQLVMEGFNWGHEQKVVTIFSAPNYCYRCGNMASILEVDDCNGHTFIQFEPAPRRGEPDVTRRTPDYFL

SEQ ID NO: 18392 - protein, 313 aa, Panax ginseng
MNFDLVQPSANGNVDEEIAQLMQCKPLSEQEVRVLCEKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFL

SEQ ID NO: 18393 - protein, 313 aa, Cucumis melo
  Sequence also found in Organisms: Citrullus lanatus
MGTDSMLSEANSSLDEQISQLMQCKPLSEQQVRALCDKAKEVLMEESNVQPVKSPVTICGDIHGQFHDLAELFQIGGKCPDTNYLFMGDYVDRGYYSVETVTLLVALKVRYPHRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHMNNLKLIARAHQLVMDGFNWAHEQKVVTIFSAPNYCYRCGNMASILEVDDCRSHTFIQFEPAPRRGEPDVTRRTPDYFL

SEQ ID NO: 18394 - protein, 314 aa, Nicotiana benthamiana
MSSSDLVAASTPGNLDEQISQLMQCKPLSEPDVRALCEKAKEILMEESNVQPVKSPVTICGDIHGQFHDLAELFRIGGQCPDTNYLFMGDYVDRGYYSVETVTLLVALKVRYPQRLTILRGNHESRQITQVYGFYDECLRKYGNANVWKTFTDLFDYFPLTALVESEIFCLHGGLSPSIETLDNVRSFDRVQEVPHEGAMCDLLWSDPDDRCGWGMSPRGAGYTFGQDISEQFHQTNNLKLIARAHQLVMEGYNWSHEQKVVTIFSAPNYCYRCGNMASILEVDDCRGHTFIQFDPAPRRGEPDVTRRTPDYFL

SEQ ID NO: 18395 - protein, 313 aa, Olea europaea
MSADLVAANTHGNLDEQIAQLMQCKPLSEPEVRTLCEKAKETLMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLNLIARAHQLVMEGYNWSHEQKVVTIFSAPNYCYRCGNMASILEVDDNREHTFIQFEPAPRRGEPDVTRRTPDYFL

SEQ ID NO: 18396 - protein, 313 aa, Olea europaea
MSADPVAANTHGNLDEQIAQLMQCKPLSEPEVRTLCEKAKETLMEESNVQPVKSPVTICGDIHGQFHDLAELFRIGGKSPDTNYLFMGDYVDRGYYSVETVTLLVALKVRYPQRITILRGNHESRQITQVYGFYDECLRKYGNANVWKTFTDLFDYFPLTALVESEIFCLHGGLSPSVETLDNIRNFDRVQEVPHEGPMCDLLWSDPDDRCGWGISPRGAGYTFGQDISEQFNHTNNLKLIARAHQLVMEGYNWAHEQKVVTIFSAPNYCYRCGNMASILEVDDCREHTFIQFEPAPRRGEPDITRRTPDYFL

SEQ ID NO: 18397 - protein, 312 aa, Tragopogon dubius
MNVELASNTHGNLDEQISQLMECKPLTEPEVRTLCEKAKEILMDESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHDQKVVTIFSAPNYCYRCGNMASILEVDDCKGHTFIQFEPAPRRGEPDVTRRTPDYFL

SEQ ID NO: 18398 - protein, 313 aa, Brassica napus
  Sequence also found in Organisms: Brassica oleracea, Brassica rapa, Raphanus sativus
MGANSIPTDATIGLDEQISQLMQCKPLSEQQVRALCEKAKEILMDESNVQPVKSPVTICGDIHGQFHDLAELFRIGGMCPDTNYLFMGDYVDRGYYSVETVTLLVALKLRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGYNWAHEQKVVTIFSAPNYCYRCGNMASILEVDDCRNHTFIQFEPAPRRGEPDVTRRTPDYFL

SEQ ID NO: 18399 - protein, 313 aa, Manihot esculenta
MVADSLSSDSITDLDEQISQLMQCKPLSETQVRALCDKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGNATVWKTFTDLFDYFPLTALVESEIFCLHGGLSPSIETLDSIRNFDRVQEVPHEGAMCDLLWSDPDDRCGWGISPRGAGYTFGQDISEQFNHTNNLKLIARAHQLVMDGFNWAHEQKVVTIFSAPNYCYRCGNMASILEVDDCKAHTFIQFEPAPRRGEPDVTRRTPDYFL

SEQ ID NO: 18400 - protein, 310 aa, Trifolium pratense
DSVPSNSHGNLDEQIAQLMQCKPLSEQEVRVLCDKAKEILMEESNVQPVKSPVTICGDIHGQFHDLAELFRIGGKCPDTNYLFMGDYVDRGYYSVETVTLLVSLKVRYRQRITILRGNHESRQITQVYGFYDECLRKYGTANVWKMFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPRRGEPDVTRRTPDYFL

SEQ ID NO: 18401 - protein, 308 aa, Lupinus angustifolius
MDSDSHGNLDEQISHLMQCKPLSEQEVRALCDKAKEILMEESNVQPVKSPVTICGDIHGQFHDLAELFRIGGKCPDTNYLFMGDYVDRGYYSVETVTLLVTFKVRYRQRITILRGNHESRQITQVYGFYDECLRKYGSANVWKIFTDLFDYFPLTALVESEIFCLHGGLSPSIETLDNVRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPRRGEPDVTRRTPDYFL

SEQ ID NO: 18402 - protein, 313 aa, Prunus persica
MGVNSVSSDTSSDLNEQIEQLMQCKPLSEPQVRGLCEKAKEILMGESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIENLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASVLEVDDCRGHTFIQFEPAPRRGEPDVTRRTPDYFL

SEQ ID NO: 18403 - protein, 313 aa, Helianthus annuus
MSSGPDVSGANGNIDEYISQLMQCKPLSEQEVRVLCEKAKEILMVESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKTFTDLFDYFPLTALVESEIFCLHGGLSPSIETLDNIRNFDRVQEVPHEGPMCDLLWSDPDDRCGWGISPRGAGYTFGQDISEQFNHTNGLKLIARAHQLVMEGFNWGHEQKVVTIFSAPNYCYRCGNMASILEVDDCKGHTFIQFDPAPRRGEPDVTRRTPDYFL

SEQ ID NO: 18404 - protein, 313 aa, Eutrema halophilum
MGANSLPTDSTLDLDEQISQLMQCKPLSEQQVRSLCEKAKEILMDESNVQPVKSPVTICGDIHGQFHDLAELFRIGGKCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMDGFNWAHEQKVVTIFSAPNYCYRCGNMASILEVDDCRNHTFIQFEPAPRRGEPDVTRRTPDYFL

SEQ ID NO: 18405 - protein, 313 aa, Tragopogon dubius
MSLGPAVSGANGNVDEYISQLMECKPLSEQEVRLLCEKAKEILMVESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKTFTDLFDYFPLTALVESEIFCLHGGLSPSIETLDNIRNFDRVQEVPHEGPMCDLLWSDPDDRCGWGISPRGAGYTFGQDISEQFNHTNGLKLIARAHQLVMEGFNWGHEQKVVTIFSAPNYCYRCGNMASILEVDDCKGHTFIQFEPAPRRGEPDVTRRTPDYFL

SEQ ID NO: 18406 - protein, 317 aa, Vinca minor
MSSDTAVASSGGAHHGNLDEQISQLMQCKPLSEPEVRGLCEKAKEILMEESNVQPVKSPVTICGDIHGQFHDLQELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLGNIRNFDRVQEVPHEGPMCDLLWSDPDDRCGWGISPRGAGYTFGQDISEQFNHTNNLKLIARAHQLVMEGFNWAHDQKVVTIFSAPNYCYRCGNMASILEVDDCKGHTFIQFEPAPRRGEPDVTRRTPDYFL

SEQ ID NO: 18407 - protein, 312 aa, Vinca minor
AADLVAPSSNGNLDEQISQLMQCKPLSETEVRTLCEKAKDILMEESNVQPVRSPVTICGDIHGQFHDLAELFRIGGKCPDTNYLFMGDYVDRGYYSVETVTLLVALKVRYSKRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWSHEQKVVTIFSAPNYCYRCGNMASILEVDDCRQHTFIQFEPAPRRGEPDVTRRTPDYFL

SEQ ID NO: 18408 - protein, 309 aa, Cycas rumphii
MSVEPVSSNGHGQLDAQTEQLMQCKPLAEQEVRVLCEKAKEILMEESNVQPVKCPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNSLKLIARAHQLVMEGYNWGHEQKVVTIFSAPNYCYRCGNMASILEVDDNKGYTFIQFEPAPRRGEPDVTRRTP

SEQ ID NO: 18409 - protein, 313 aa, Amaranthus tuberculatus
MSFDPVPSNSHHNLDEQIAQLMQCKPLSEQEVRGLCDKAKEVLMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISDQFNHTNNLKLIARAHQLVMEGFNWAHDQKVVTIFSAPNYCYRCGNMASILEVDDCKGHTFIQFEPAPRRGEPDVTRRTPDYFL

SEQ ID NO: 18410 - protein, 313 aa, Amaranthus tuberculatus
MSFDPVPSNSHYNLDEQIAQLMQCKPLSEQEVRVLCDKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKTFTDLFDYFPLTALVESEIFCLHGGLSPSIETLDNIRNFDRVQEVPHEGPMCDLLWSDPDDRCGWGISPRGAGYTFGQDISDQFNHTNNLKLIARAHQLVMEGFNWAHDQKVVTIFSAPNYCYRCGNMASILEVDDCKGHTFIQFEPAPRRGEPDVTRRTPDYFL

SEQ ID NO: 18411 - protein, 312 aa, Ambrosia trifida
MSVELASDTHGNLDEQISQLMQCKPLSEPEVRTLCDKAKEILIDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGFNWGHEQKVVTIFSAPNYCYRCGNMASILEVDDCKGHTFIQFEPAPRRGEPDVTRRTPDYFL

SEQ ID NO: 18412 - protein, 313 aa, Arnica chamissonis
MSMGPDVSSTNGNIDEYISQLMQCKPLSEQEVRVLCEKAKEILMVESNVQPVKSPVTICGDIHGQFHDLAELFRIGGKCPDTNYLFMGDYVDRGYYSVETVTLLVALKVRYPQRITILRGNHESRQITQVYGFYDECLRKYGSASVWKTFTDLFDYFPLTALVESEIFCLHGGLSPSIETLDSIRNFDRVQEVPHEGPMCDLLWSDPDDRCGWGISPRGAGYTFGQDISEQFNHTNGLKLIARAHQLVMEGFNWGHEQKVVTIFSAPNYCYRCGNMASILEVDDCKGHTFIQFDPAPRRGEPDVTRRTPDYFL

SEQ ID NO: 18413 - protein, 312 aa, Cichorium intybus
MSVDLASNTHGNLDEQISQLMQCKPLTEPEVKTLCEKAKEILMTESNVKPVKSPVTICGDIHGQFHDLAELFRIGGKCPDTNYLFMGDYVDRGYYSVETVSLLVALKVRYPQRITILRGNHESRQITQVYGFYDECLRKYGSANVWKTFTDLFDYFPLTALVESEIFCLHGGLSPSIETLDSIRNFDRVQEVPHEGPMCDLLWSDPDDRCGWGISPRGAGYTFGQDISEQFNHTNSLKLIARAHQLVMEGFNWGHEKKVVTIFSAPNYCYRCGNMASILEVDDCKGHTFIQFDPAPRRGEPDVTRRTPDYFL

SEQ ID NO: 18414 - protein, 312 aa, Cichorium intybus
MSAELASNTHGNLDEQISQLMECKPLTEPEVRTLCEKAKEILMDESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHDQKVVTIFSAPNYCYRCGNMASILEVDDCKGHTFIQFEPAPRRGEPDVTRRTPDYFL

SEQ ID NO: 18415 - protein, 313 aa, Panax ginseng
MNFDLVQPSANGNVDEEIAQLMQCKPLSEQEVRVLCEKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGYTFIQFEPAPRRGEPDVTRRTPDYFL

SEQ ID NO: 18416 - protein, 314 aa, Nicotiana benthamiana
MSSSDLVAASTQGNLDEQISQLMQCKPLSEPDVRTLCEKAKEILMEESNVQPVKSPVTICGDIHGQFHDLAELFRIGGQCPDTNYLFMGDYVDRGYYSVETVTLLVALKVRYPQRLTILRGNHESRQITQVYGFYDECLRKYGNANVWKTFTDLFDYFPLTALVESEIFCLHGGLSPSIETLDNVRSFDRVQEVPHEGAMCDLLWSDPDDRCGWGMSPRGAGYTFGQDISEQFHQTNNLKLIARAHQLVMEGYNWSHEQKVVTIFSAPNYCYRCGNMASILEVDDCRGHTFIQFDPAPRRGEPDVTRRTPDYFL

SEQ ID NO: 18417 - protein, 313 aa, Rosa hybrid cultivar
MGVNSASSDSGNDLNEQIEQLMQCKPLSEQQVRVLCEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNASVWKTFTDLFDYFPLTALVESEIFCLHGGLSPSIENLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASVLEVDDCRGHTFIQFEPAPRRGEPDVTRRTPDYFL

SEQ ID NO: 18418 - protein, 313 aa, Fragaria vesca
MGVNLASSDSSNDLNEQIEQLMQCKPLSEQQVRALCEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNASVWKTFTDLFDYFPLTALVESEIFCLHGGLSPSIENLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASVLEVDDCRGHTFIQFEPAPRRGEPDVTRRTPDYFL

SEQ ID NO: 18419 - protein, 312 aa, Helianthus annuus
MSVELASDTHGNLDEQISQLMQCKPLIEPEVRTLCDKAKEILIDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGFNWGHEQKVVTIFSAPNYCYRCGNMASILEVDDCKGHTFIQFEPAPRRGEPDVTRRTPDYFL

SEQ ID NO: 18420 - protein, 314 aa, Nicotiana tabacum
MSSSDLVAASIQGNLDEQISQLMQCKPLSEPDVRALCEKAKEILMEESNVQPVKSPVTICGDIHGQFHDLAELFRIGGQCPDTNYLFMGDYVDRGYYSVETVTLLVALKVRYPQRLTILRGNHESRQITQVYGFYDECLRKYGNANVWKTFTDLFDYFPLTALVESEIFCLHGGLSPSIETLDNVRSFDRVQEVPHEGAMCDLLWSDPDDRCGWGMSPRGAGYTFGQDISEQFHQTNNLKLIARAHQLVMEGYNWSHEQKVVTIFSAPNYCYRCGNMASILEVDDCRGHTFIQFDPAPRRGEPDVTRRTPDYFL

SEQ ID NO: 18421 - protein, 315 aa, Zostera marina
MTAGENVPSSNAHGNVDEQIVQLMQCKPLSEQEVKTLCEKAKEILMEESNVQPVKSPVTICGDIHGQFHDLAELFKIGGKCPDTNYLFMGDYVDRGYYSVETVSLLVALKVRHSQRITILRGNHESRQITQVYGFYDECLRKYGNPNVWKTFTDLFDYFPLTALVESEIFCLHGGLSPSIETLDHIRNFDRVQEVPHEGPMCDLLWSDPDDRCGWGISPRGAGYTFGQDISEQFNHTNSLKLIARAHQLVMEGYNWGHEQKVVTIFSAPNYCYRCGNMASILEVDDCKEHTFIQFEPAPRRGEPDVTRRTPDYFL

SEQ ID NO: 18422 - protein, 313 aa, Cycas rumphii
MSADSIPSNTNGELDNQIAQLMQCKPLSEQEVRLLCEKAKEILMDESNVQPVKCPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIDTLDNIRNLDRVQEVPHEGPMCDLLWSDPDDRCGWGISPRGAGYTFGQDISEQYNHTNGLKLIARAHQLVMEGYNWGHEQKVVTIFSAPNYCYRCGNMASILEVDDNRGHTFTQFEPAPRRGEPDVTRRTPDYFL

SEQ ID NO: 18423 - protein, 313 aa, Glycine max
MGANSMLSESSHDLDDQISQLMQCKPLSEQQVRGLCEKAKEILMDESNVQPVKSPVTICGDIHGQFHDLAELFRIGGKCPDTNYLFMGDYVDRGYYSVETVSLLVALKVRYPQRITILRGNHESRQITQVYGFYDECLRKYGNANVWKTFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 18424 - protein, 313 aa, Brassica napus
  Sequence also found in Organisms: Brassica oleracea
MGANSIPTDATLDLDEQISQLMQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNNLKLIARAHQLVMDGFNWAHEQKVVTIFSAPNYCYRCGNMASILEVDDCRNHTFIQFEPAPRRGEPDVTRRTPDYFL

SEQ ID NO: 18425 - protein, 313 aa, Brassica oleracea
MGANSVPTDATLDLDEQISQLMQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGFNWAHEQKVVTIFSAPNYCYRCGNMASILEVDDCRNHTFIQFEPAPRRGEPDVTRRTPDYFL

SEQ ID NO: 18426 - protein, 313 aa, Cichorium intybus
MSSAPVVSSANGNVDEYITQLMQCKPLSEQEVRLLCEKAKEILMVESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKTFTDLFDYFPLTALVESEIFCLHGGLSPSIETLDNIRNFDRVQEVPHEGPMCDLLWSDPDDRCGWGISPRGAGYTFGQDISEQFNHSNGLKLIARAHQLVMEGFNWGHEQKVVTIFSAPNYCYRCGNMASILEVDDCKGHTFIQFDPAPRRGEPDVTRRTPDYFL

SEQ ID NO: 18427 - protein, 313 aa, Vigna unguiculata
MGANSMLSEFSHDVDDQISQLMQCKPLSEQQVRVLCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 18428 - protein, 307 aa, Avena sativa
MSSPHGGLDEQIERLLQCKPLPEAEVRALCEKAKEILMEESNVQPVKSPVTICGDIHGQFHDLAELFRIGGKCPDTNYLFMGDYVDRGYYSVETVTLLVSLKVRYPQRITILRGNHESRQITQVYGFYDECLRKYGSATVWKTFTDLFDYFPLTALVESEIFCLHGGLSPSIETLDNIRNFDRIQEVPHEGPMCDLLWSDPDDRCGWGISPRGAGYTFGQDISEQFNHSNNLRLIARAHQLVMEGFNWAHEQKVVTIFSAPNYCYRCGNMASILEVDDCREHTFIQFEPAPRRGEPDVTRRTPDYFL

SEQ ID NO: 18429 - protein, 307 aa, Avena sativa
MGNPHGGLDEEIAQLLQCKPLAEPKLKALCEKAKEILMEESNVQPVRSPVTICGDIHGQFHDLAELFRIGGKCPDTNYLFMGDYVDRGYYSVETVSLLVALKVRYPQRITILRGNHESRQITQVYGFYDECLRKYGSANVWKTFTDLFDYLPLTALVESEIFCLHGGLSPSIETLDNVRSFDRIQEVPHEGPMCDLLWSDPDDRCGWGISPRGAGYTFGQDISEQFNHTNSLKLISRAHQLVMEGFNWAHEQKVVTIFSAPNYCYRCGNMASILEVDDCREHTFIQFDPAPRRGEPDVTRRTPDYFL

SEQ ID NO: 18430 - protein, 313 aa, Populus trichocarpa
MGTNSLSFESITDLDQQIEQLMQCKPLSEPQVRALCEKAKEILMQESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPTIETLDNIRNFDRVQEVPHEGAMCDLLWSDPDDRCGWGISPRGAGYTFGQDISEQFNHTNSLKLIARAHQLVMDGFNWAHEQKVVTIFSAPNYCYRCGNMASILEVDDCNGHTFIQFEPAPRRGEPDVTRRTPDYFL

SEQ ID NO: 18431 - protein, 294 aa, Papaver somniferum
QLMQCKPLSEQEVRGLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCRGHTFIQFEPAPRRGEPDVTRRTPDYFL

SEQ ID NO: 18432 - protein, 313 aa, Prunus mume
MGVNSISSDTSSDLNEQIEQLMQCKPLSEPQVRGLCEKAKEILMGESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIENLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASVLEVDDCRGHTFIQFEPAPRRGEPDVTRRTPDYFL

SEQ ID NO: 18433 - protein, 313 aa, Raphanus sativus
MGANSIPTDATLDLDEQISQLMQCKPLSEQQVKSLCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMEGFNWAHEQKVVTIFSAPNYCYRCGNMASILEVDDCRNHTFIQFEPAPRRGEPDVTRRTPDYFL

SEQ ID NO: 18434 - protein, 316 aa, Rosmarinus officinalis
MDAAVASGGGEGTNGNLDEQIAQLVQCKPLSEPEVRMLCGKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDFFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWAHDQKVVTIFSAPNYCYRCGNMASILEVDDCRGHTFIQFEPAPRRGEPDVTRRTPDYFL

SEQ ID NO: 18435 - protein, 313 aa, Rosmarinus officinalis
MSADLGAPTAHGKLDEQISPLMQCKPLSEPEARTLCEKAKVILMQESSVQPVKSPVTICGNIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWAHEQKVVTIFSAPNYCYRCGNMASILEVDDCREHTFIQFEPAPRRGEPDVTRRTPDYFL

SEQ ID NO: 18436 - protein, 313 aa, Amaranthus tuberculatus
MSFDPVPSNSHYNLDEQIAQLMQCKPLSEQEVRVLCDKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKTFTDLFDYFPLTALVESEIFCLHGGLSPSIETLDNIRNFDRVQEVPHEGPMCDLLWSDPDDRCGWGISPRGAGYTFGQDISDQFNHTNSLKLIARAHQLVMEGFNWAHDQKVVTIFSAPNYCYRCGNMASILEVDDCKGHTFIQFEPAPRRGEPDVTRRTPDYFL

SEQ ID NO: 18437 - protein, 313 aa, Arnica chamissonis
MSMGPDVSSTNGNIDEYISQLMQCKPLSEQEVRVLCEKAKEILMVESNVQPVKSPVTICGDIHGQFHDLAELFRIGGKCPDTNYLFMGDYVDRGYYSVETVTLLVALKVRYPQRITILRGNHESRQITQVYGFYDECLRKYGSASVWKTFTDLFDYFPLTALVESEIFCLHGGLSPSIESLDNIRNFDRVQEVPHEGPMCDLLWSDPDDRCGWGISPRGAGYTFGQDISEQFNHTNGLKLIARAHQLVMEGFNWGHEQKVVTIFSAPNYCYRCGNMASILEVDDCKGHTFIQFDPAPRRGEPDVTRRTPDYFL

SEQ ID NO: 18438 - protein, 313 aa, Artemisia annua
  Sequence also found in Organisms: Chrysanthemum coronarium
MSLGPAVSNANGNVDEYIIQLMQCKPLSEQEVRVLCEKAKEILMVESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKTFTDLFDYFPLTALVESEIFCLHGGLSPSIETLDNIRNFDRVQEVPHEGPMCDLLWSDPDDRCGWGISPRGAGYTFGQDISEQFNHANGLKLIARAHQLVMEGFNWGHEQKVVTIFSAPNYCYRCGNMASILEVDDCKGHTFIQFDPAPRRGEPDVTRRTPDYFL

SEQ ID NO: 18439 - protein, 314 aa, Musa acuminata
MSVNTVPASASHGNLDEQIAQLMQCKPLPEQEVRMLCEKAKEVLMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDSIRSFDRVQEVPHEGPMCDLLWSDPDDRCGWGISPRGAGYTFGQDISEQFNHTNNLRLIARAHQLVMDGYNWGHEQKVVTIFSAPNYCYRCGNMASIMEVDECKGQTFIQFEPAPRRGEPDVTRRTPDYFL

SEQ ID NO: 18440 - protein, 312 aa, Centaurea maculosa
MSLDLVQRVNRNVDEHIAQLMQCKPLSEQEVRSLCDKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFL

SEQ ID NO: 18441 - protein, 317 aa, Centaurea maculosa
IQERRVSVDLASNTHGSLDEQISQLMQCKPLIEPEVKALCEKAKEILMGESNVQPVRSPVTICGDIHGQFHDLAELFRIGGKCPDTNYLFMGDYVDRGYYSVETVTLLVALKVRYPQRLTILRGNHESRQITQVYGFYDECLRKYGSANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHDQKVVTIFSAPNYCYRCGNMASILEVDDCKGHTFIQFDPAPRRGEPDVTRRTPDYFL

SEQ ID NO: 18442 - protein, 313 aa, Cirsium arvense
  Sequence also found in Organisms: Cynara scolymus
MSLDPVVQRVNRNVDEHIAQLMQCKPLSEQEVRSLCDKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFL

SEQ ID NO: 18443 - protein, 313 aa, Cirsium arvense
MSLGPAVSSANGNVDEYISQLMQCKPLSEQEVRVLCEKAKEILMVESNVQPVKSPVTICGDIHGQFHDLAELFRIGGKCPDTNYLFMGDYVDRGYYSVETVTLLVALKVRYPQRLTILRGNHESRQITQVYGFYDECLRKYGNASVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGFNWGHEQKVVTIFSAPNYCYRCGNMASILEVDDCKGHTFIQFEPAPRRGEPDVTRRTPDYFL

SEQ ID NO: 18444 - protein, 313 aa, Fagopyrum esculentum
MSFDPMSSNTHHNLDEQIVQLMQCKPLSEQEVRALAEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKVFTDLFDYFPLTALVESEIFCLHGGLSPSIETLDNIRNFDRVQEVPHEGPMCDLLWSDPDDRCGWGISPRGAGYTFGQDISEQFNHTNSLKLISRAHQLVMEGYNWGHDQKVVTIFSAPNYCYRCGNMASIMEVDDCKDHKFIQFEPAPRRGEPDVTRRTPDYFL

SEQ ID NO: 18445 - protein, 312 aa, Flaveria ramosissima
MSVEMASDTHGNLDEQISQLMQCKPLTESEVRTLCDKAKEILIDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGFNWGHDQKVVTIFSAPNYCYRCGNMASILEVDDCKGHTFIQFEPAPRRGEPDVTRRTPDYFL

SEQ ID NO: 18446 - protein, 315 aa, Zingiber officinale
MSANTVPAPPSSHGNLDEQIEQLMQCRPLSEQEVRALCQKAKEVLMEESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPTIETLDGIRSFDRVQEVPHEGAMCDLLWSDPDDRRGWGISPRGAGYTFGQDISEQFNHTNNLNLIARAHQLVMEGYNWGHDQKVVTIFSAPNYCYRCGNMAAILEVDDCKGHTFIQFEPAPRRGEPDVTRRTPDYFL

SEQ ID NO: 18447 - protein, 313 aa, Phalaenopsis aphrodite
MSANPMPASSHGNLDEQIAQLMQCKPLSEQEVRVLCDKAKEILMEESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHNNNLKLIARAHQLVMDGYNWGHDQKVVTIFSAPNYCYRCGNMASILEVDDCKGHTFIQFDPAPRRGEPDVTRRTPDYFL

SEQ ID NO: 18448 - protein, 313 aa, Plantago ovata
MSTDLIAPSTHGNLDEQISQLMQCKPLSEPEVRGLCEKAKEILMQESNVQPVKSPVTICGDIHGQFHDLQELFRIGGKCPDTNYLFMGDYVDRGYYSVETVTLLVSLKVRYPQRITILRGNHESRQITQVYGFYDECLRKYGNANVWKIFTDLFDYFPLTALVESEIFCLHGGLSPSVETLDNIRNFDRVQEVPHEGPMCDLLWSDPDDRCGWGISPRGAGYTFGQDISEQFNHSNSLKLIARAHQLVMEGYNWAHEQKVVTIFSAPNYCYRCGNMASILEVDDCRDHTFIQFEPAPRRGEPDVTRRTPDYFL

SEQ ID NO: 18449 - protein, 314 aa, Silene vulgaris
MSFDPVPSSNSHLNLDEQIAQLMQCKPLSEQEVRGLCDKAKEILMEESNVQPVKSPVTICGDIHGQFHDLAELFRIGGKCPDTNYLFMGDYVDRGYYSVETVTLLVALKVRYRQRITILRGNHESRQITQVYGFYDECLRKYGNANVWKVFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMEGFNWAHDQKVVTIFSAPNYCYRCGNMASILEVDDCQGHTFIQFEPAPRRGEPDVTRRTPDYFL

SEQ ID NO: 18450 - protein, 314 aa, Zostera marina
MNVDFVPPSTSHGDLDQKISQLMQCKPLSEQEVKSLCEKAKEILMEENNVQPVKSPVTICGDIHGQFHDLAELFRIGGKCPDTNYLFMGDYVDRGYYSVETVTLLVSLKVRYPQRITILRGNHESRQITQVYGFYDECLRKYGNPNVWKTFTDLFDYLPLTALVESEIFCLHGGLSPSIETLDNIRNFDRVQEVPHEGPMCDLLWSDPDDRCGWGISPRGAGYTFGQDISEQFNHTNSLKLIARAHQLVMEGFNWGHEQKVVTIFSAPNYCYRCGNMASILEVDDCKNHTFIQFDPAPRRGEPDVTRRTPDYFL

SEQ ID NO: 18451 - protein, 313 aa, Glycine max
MGANSMLAEFSHDLDDQISQLMQCKPLSEQQVRGLCEKAKEILTDESNVQPVKSPVTICGDIHGQFHDLAELFRIGGKCPDTNYLFMGDYVDRGYYSVETVSLLVALKVRYPQRITILRGNHESRQITQVYGFYDECLRKYGNANVWKTFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 18452 - protein, 296 aa, Ambrosia trifida
IAQLMECKPLSEPEVKTLCEKAKEILMGESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFDPAPRRGEPDVTRRTPDYFL

SEQ ID NO: 18453 - protein, 313 aa, Arnica chamissonis
MSSDPVTQRVNHNVDEHITQLMQCKPLSEQEVRSLCDKAKEILMQESNVQPVKSPVTICGDIHGQFHDLAELFRIGGKCPDTNYLFMGDYVDRGYYSVETVTLLVALKVRHPQRITILRGNHESRQITQVYGFYDECLRKYGSANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGYNWGHEQKVVTIFSAPNYCYRCGNMASILEVDDCKGHTFIQFDPAPRRGEPDVTRRTPDYFL

SEQ ID NO: 18454 - protein, 313 aa, Brassica napus
  Sequence also found in Organisms: Brassica rapa
MGANSIPTDATLDLDEQISQLMQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGFNWAHEQKVVTIFSAPNYCYRCGNMASILEVDDCRNHTFIQFEPAPRRGEPDVTRRTPDYFL

SEQ ID NO: 18455 - protein, 311 aa, Brassica napus
  Sequence also found in Organisms: Brassica rapa
MNSAPTDATLDLDEQISQLMQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGFNWAHEQKVVTIFSAPNYCYRCGNMASILEVDDCRNHTFIQFEPAPRRGEPDVTRRTPDYFL

SEQ ID NO: 18456 - protein, 308 aa, Centaurea maculosa
AVSSGHGSIDEFISQLMQCKPLSEQEVRVLCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKIFTDLFDYLPLTALVESEIFCLHGGLSPSIETLDNIRNFDRVQEVPHEGPMCDLLWSDPDDRCGWGISPRGAGYTFGQDISEQFNHTNGLKLIARAHQLVMEGYNWGHEQKVVTIFSAPNYCYRCGNMASVLEVDDCKGHTFIQFEPAPRRGEPDVTRRTPDYFL

SEQ ID NO: 18457 - protein, 313 aa, Ceratodon purpureus
MSVPPVSPNTHGQLDAQIAQLIQCKPLPEYEVRGLCEKAKEILMEENNVQPVKCPVTICGDIHGQFHDLAELFRIGGMCPDTNYLFMGDYVDRGYYSVETATLLVALKVRYQDRITILRGNHESRQITQVYGFYDECLRKYGNANVWKIFTDLFDYFPLTALVESEIFCLHGGLSPSIDSLDHIRDLDRVQEVPHEGPMCDLLWSDPDDRCGWGISPRGAGYTFGQDISEQFNHNNNLKLVARAHQLVMEGYNWGHEQKVVTIFSAPNYCYRCGNMAAILEVDDNMGHTFIQFEPAPRRGEPDVTRRTPDYFL

SEQ ID NO: 18458 - protein, 313 aa, Ceratodon purpureus
MSVPPVSSNTHGQLDAQIAQLIQCKPLPEHEVRRLCEKAKEILMEENNVQPVKCPVTICGDIHGQFHDLAELFRIGGMCPDTNYLFMGDYVDRGYYSVETATLLVALKVRYQDRITILRGNHESRQITQVYGFYDECLRKYGNANVWKIFTDLFDYFPLTALVESEIFCLHGGLSPSIDSLDHIRDLDRVQEVPHEGPMCDLLWSDPDDRCGWGISPRGAGYTFGQDISEQFNHNNNLKLVARAHQLVMEGYNWGHEQKVVTIFSAPNYCYRCGNMAAILEVDDNMGHTFIQFEPAPRRGEPDVTRRTPDYFL

SEQ ID NO: 18459 - protein, 313 aa, Cicer arietinum
MGANSMLTESTHDLDEQISQLMQCKPLSEQQVKELCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFDPAPRRGEPDVTRRTPDYFL

SEQ ID NO: 18460 - protein, 310 aa, Gossypium hirsutum
  Sequence also found in Organisms: Gossypium raimondii
MGAPTDSALDLDEQISQLMQCKPLSEQQVRALCDKAKEILMEESNVQPVKAPVTICGDIHGQFHDLQELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIETLDNVRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKNQSFIQFEPAPRRGEPDVTRRTPDYFL

SEQ ID NO: 18461 - protein, 313 aa, Lupinus angustifolius
MGANSLPSESSHDLDEQISQLMQCKPLSEQQVKVLCEKAKEILTDESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCMNHTFIQFEPAPRRGEPDVTRRTPDYFL

SEQ ID NO: 18462 - protein, 313 aa, Medicago truncatula
MGANSMIADVTHDLNEQISQLMQCKPLSEQQVKELCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 18463 - protein, 313 aa, Arachis hypogaea
MGANSLPSDSTHDLDEQISQLMQCKPLSEQQVRVLCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDFFPLTALVESEIFCLHGGLSPSIETLDNIRSFDRVQEVPHEGAMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 18464 - protein, 313 aa, Cajanus cajan
MGANSMLSESSHDLDEQISQLMQCKPLSEQQVRGLCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKIFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 18465 - protein, 313 aa, Brassica napus
MGVDSLPTDATIDLDEQISQLMQCKPLSEQQVRSLCEKAKEILMDESNVQPVKSPVTICGDIHGQFHDLAELFRIGGMCPDTNYLFMGDYVDRGYYSVETVTLLVALKMRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNGLKLIARAHQLVMDGYNWAHEQKVVTIFSAPNYCYRCGNMASILEVDDCMSHSFIQFEPAPRRGEPDVTRRTPDYFL

SEQ ID NO: 18466 - protein, 313 aa, Elaeis guineensis
MDVDPVPANSHGNVEEQISQLMQCKPLSEQEVRVLCDKAKEILIEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPHVDTLDGIRNFDRVQEVPHEGAMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18467 - protein, 312 aa, Raphanus sativus
MGSAAPKDATLDLDEQISQLMQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGYNWAHEQKVVTIFSAPNYCYRCGNMASILEVDDCRNHTFIQFEPAPRRGEPDVTRRTPDYFL

SEQ ID NO: 18468 - protein, 313 aa, Helianthus annuus
MSLDPVMQRVTHNVDEHISQLMECKPLSEQEVRSLCDKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDSIRNFDRVQEVPHEGPMCDLLWSDPDDRCGWGISPRGAGYTFGQDISEQFNHTNSLKLIARAHQLVMEGFNWGHEQKVVTIFSAPNYCYRCGNMASILEVDDCKGHTFIQFEPAPRRGEPDVTRRTPDYFL

SEQ ID NO: 18469 - protein, 313 aa, Trigonella foenum-graecum
MGANSMIADSTHDLNEQISQLMQCKPLSEQQVKELCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 18470 - protein, 309 aa, Artemisia annua
MSLDHVNHNVDEYITQLMQCKPLSEQEVKSLCDKAKEILMKESNVQPVKSPVTICGDIHGQFHDLAELFRIGGKCPDTNYLFMGDYVDRGYYSVETVSLLVALKVRYPQRITILRGNHESRQITQVYGFYDECLRKYGSANVWKIFTDLFDYFPLTALVESEIFCLHGGLSPSIETLDNIRNFDRVQEVPHEGPMCDLLWSDPDDRCGWGISPRGAGYTFGQDISEQFNHTNGLKLIARAHQLVMEGFNWSHEQKVVTIFSAPNYCYRCGNMASILEVDDCKGHTFLQFEPAPRRGEPDVTRRTPDYFL

SEQ ID NO: 18471 - protein, 313 aa, Brassica napus
  Sequence also found in Organisms: Brassica oleracea
MGANSIPTDATLDLGEQISQLMQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGFNWAHEQKVVTIFSAPNYCYRCGNMASILEVDDCRNHTFIQFEPAPRRGEPDVTRRTPDYFL

SEQ ID NO: 18472 - protein, 313 aa, Phaseolus vulgaris
MGANSMLSESSHDVDDQISQLMQCKPLSEQQVRVLCEKAKEILIDESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKTFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 18473 - protein, 311 aa, Daucus carota
MNADLASSNANLDEQISQLMQCKPLSEPQVRALCDKAKEILMKESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYLPLTALVESEIFCLHGGLSPSIETLDNIRKFDRVQEVPHEGPMCDLLWSDPDDRCGWGISPRGAGYTFGQDISEQFNQTNSLKLIARAHQLVMEGFNWGHEQKVVTIFSAPNYCYRCGNMASILEVDDCNGHTFIQFDPAPRRGEPDVTRRTPDYFL

SEQ ID NO: 18474 - protein, 313 aa, Ricinus communis
MGANSPSSDSISDLDEQISQLMQCKPLSEPQVRALSEKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIETLDNIRNFDRVQEVPHEGAMCDLLWSDPDDRCGWGISPRGAGYTFGQDISEQFNHTNSLKLIARAHQLVMDGFNWAHEQKVVTIFSAPNYCYRCGNMASILEVDDCRAHTFIQFEPAPRRGEPDVTRRTPDYFL

SEQ ID NO: 18475 - protein, 313 aa, Euphorbia peplus
MGANSPSTDSISDLDEQISQLMQCKPLSETQVRSLCDKGKEILMQESNVQPVKSPVTICGDIHGQFHDLAELFRIGGKCPDSNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGAMCDLLWSDPDDRCGWGISPRGAGYTFGQDISEQFNHTNSLKLIARAHQLVMDGFNWAHEQKVVTIFSAPNYCYRCGNMASILEVDDCNSHTFIQFEPAPRRGEPDVTRRTPDYFL

SEQ ID NO: 18476 - protein, 313 aa, Allium cepa
MSAGTINSNSHGNLDEEIAQLMQCKPLSEPEVKILCDKAKEILMKESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDERCGWGISPRGAGYTFGQDISEQFNRVNNLKLIARAHQLVMEGYNWGHEQKVVTIFSAPNYCYRCGNMASILEVDDCKGHTFIQFEPAPRRGEPDVTRRTPDYFL

SEQ ID NO: 18477 - protein, 313 aa, Physcomitrella patens
MSVPPVSSNVHGQLDAQIAQLIQCKPLPELEVRALCEKAKEILMEENNVQPVKCPVTICGDIHGQFHDLAELFRIGGMCPDTNYLFMGDYVDRGYYSVETATLLVALKVRHQDRITILRGNHESRQITQVYGFYDECLRKYGNANVWKIFTDLFDYFPLTALVESEIFCLHGGLSPSIDSLDHIRDLDRVQEVPHEGPMCDLLWSDPDDRCGWGISPRGAGYTFGQDISEQFNHNNNLKLVARAHQLVMEGYNWGHEQKVVTIFSAPNYCYRCGNMAAILEVHDNMAHTFIQFEPAPRRGEPDVTRRTPDYFL

SEQ ID NO: 18478 - protein, 313 aa, Populus trichocarpa
MGTNSLSSESITDLDQQIEQLMQCKPLSEPQVRTLCEKAKEILMQESNVQPVKSPVTICGDIHGQFHDLAELFRIGGKCPDTNYLFMGDYVDRGYYSVETVTLLVALKVRYHHRITILRGNHESRQITQVYGFYDECLRKYGNANVWKIFTDLFDYFPLTALVESEIFCLHGGLSPTIETLDNIRNFDRVQEVPHEGAMCDLLWSDPDDRCGWGISPRGAGYTFGQDISEQFNHVNSLKLIARAHQLVMDGFNWAHEQKVVTIFSAPNYCYRCGNMASILEVDDCKGHTFIQFEPAPRRGEPDVTRRTPDYFL

SEQ ID NO: 18479 - protein, 313 aa, Brassica oleracea
MGVDSLPTDATIDLDEQISQLMQCKPLSEQQVRSLCEKAKEILMDESNVQPVKSPVTICGDIHGQFHDLAELFRIGGMCPDTNYLFMGDYVDRGYYSVETVTLLVALKMRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNGLKLIARAHQLVMDGYNWAHEQKVVTIFSAPNYCYRCGNMASILEVDDCMNHSFIQFEPAPRRGEPDVTRRTPDYFL

SEQ ID NO: 18480 - protein, 313 aa, Gossypium hirsutum
  Sequence also found in Organisms: Gossypium raimondii
MGANSSPTDLTTDLDEQISQLMQCKPLSEQQVRALCDKAKEILMKESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKSHTFIQFEPAPRRGEPDVTRRTPDYFL

SEQ ID NO: 18481 - protein, 314 aa, Pteridium aquilinum
MSVAPAIVERNGHLDAHIAQLMQCKPLLEPEVRSLCEKAKEILMEENNVQPVKCPVTICGDIHGQFHDLAELFRIGGKCPDTNYLFMGDYVDRGYYSVETATLLVALKVRYPDRITILRGNHESRQITQVYGFYDECLRKYGNANVWKIFTDLFDYFPLTALVESEIFCLHGGLSPSIDTLDHVRKLERVQEVPHEGPMCDLLWSDPDDRCGWGISPRGAGYTFGQDISAQFNHTNNLKLIARAHQLVMEGFNWGHEQKVVTIFSAPNYCYRCGNMASILEVDDNMGHTFIQFEPAPRRGEPADVTRRTPDYFL

SEQ ID NO: 18482 - protein, 313 aa, Brassica rapa
MGANSIPTDATIDLDEQIGQLMQCKPLSEQQVRSLCEKAKEILMDESNVQPVKSPVTICGDIHGQCHDLAELFRIGGMCPDTNYLFMGDYVDRGYYSVETVTLLVALKLRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNGLKLIARAHQLVMDGYNWAHEQKVVTIFSAPNYCYRCGNMASILEVDDCRNHSFIQFEPAPRRGEPDVTRRTPDYFL

SEQ ID NO: 18483 - protein, 313 aa, Brassica napus
MGANSIPTDATIDLDEQISQLMQCKPLSEQQVRSLCEKAKEILMDESNVQPVKSPVTICGDIHGQFHDLAELFRIGGMCPDTNYLFMGDYVDRGYYSVETVTLLVALKLRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPCGAGYTFGQDISEQFNHSNSLKLIARAHQLVMDGYNWAHEQKVVTIFSAPNYCYRCGNMASILEVDDCRNHSFIQFEPAPRRGEPDVTRRTPDYFL

SEQ ID NO: 18484 - protein, 312 aa, Centaurea maculosa
MSLDLVQRVNRNVDEHIAQLMQCKPLSEQEVRSLCDKAKEILMQESNVQPVKSPVTICGDIHGQFHDLAELFRIGGKCPDTNYLFMGDYVDHGYYSVETVTLLVALKVRYPQRITILRGNHESRQITQVYGFYDECLRKYGSANVWKTFTDLFDYFPLTALVESEIFCLHGGLSPSIETLDNIRNFDRVQEVPHEGPMCDLLWSDPDDRCGWGISPRGAGYTFGQDISEQFNHTNKLKLIARAHQLVMEGFNWGHEQKVVTIFSAPNYCYRCGNMASILEVDDCKGHTFIQFEPAPRRGEPDVTRRTPDYFL

SEQ ID NO: 18485 - protein, 313 aa, Ceratodon purpureus
MSIPPMSSNVHGQLDAQIAQLIQCKPLPEHEVRGLCEKAKEILMEENNVQPVKCPVTICGDIHGQFHDLAELFRIGGMCPDTNYLFMGDYVDRGYYSVETATLLVALKVRYQDRITILRGNHESRQITQVYGFYDECLRKYGNANVWKIFTDLFDYFPLTALVESEIFCLHGGLSPSIDSLDHIRDLDRVQEVPHEGPMCDLLWSDPDDRCGWGISPRGAGYTFGQDISEQFNHNNNLKLVARAHQLVMEGYNWGHEQKVVTIFSAPNYCYRCGNMAAILEVDDNMGHTFIQFEPAPRRGEPDVTRRTPDYFL

SEQ ID NO: 18486 - protein, 312 aa, Trifolium pratense
MGANSLADPTHDLNEQISQLMQCKPLSEQQVKELCEKAKEILMHESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 18487 - protein, 292 aa, Orobanche aegyptiaca
MQCKPLSEPEVRALCEKAKEILMEESNVQPVKSPVTICGDIHGQFHDLAELFRIGGKCPDTNYLFMGDYVDRGYYSVETVSLLVALKVRYPQRITILRGNHESRQITQVYGFYDECLRKYGNANVWKIFTDLFDYFPLTALVESEIFCLHGGLSPSVETLDNIRNFDRVQEVPHEGPMCDLLWSDPDDRCGWGISPRGAGYTFGQDISEQFNHTNNLKLIARAHQLVMEGYNWAHEQKVVTIFSAPNYCYRCGNMASILEVDDCREHTFIQFEPAPRRGEPDVTRRTPDYFL

SEQ ID NO: 18488 - protein, 311 aa, Physcomitrella patens
MSVPPISSNGQLDTQIAQLIQCKPLSEVEVRGLCEKAKEILMRENNVQPVKCPVTICGDIHGQFHDLAELFRIGGMCPDTNYLFMGDYVDRGYYSVETATLLVALKVRYPDRITILRGNHESRQITQVYGFYDECLRKYGNANVWKIFTDLFDYFPLTALVESEIFCLHGGLSPSIDSLDHIRDLDRVQEVPHEGPMCDLLWSDPDDRCGWGISPRGAGYTFGQDISEQFNHNNNLKLVARAHQLVMEGYNWGHEHKVVTIFSAPNYCYRCGNMASILEVDDNMGHTFIQFEPAPRRGEPDVTRRTPDYFL

SEQ ID NO: 18489 - protein, 313 aa, Raphanus sativus
MGANSIPTEATIDLDEQISQLMQCKPLSEQQVRSLCEKAKEILIDESNVQPVKSPVTICGDIHGQFHDLAELFRIGGMCPDTNYLFMGDYVDRGYYSVETVTLLVALKMRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGYNWAHEQKVVTIFSAPNYCYRCGNMASILEVDDCMNHSFIQFEPAPRRGEPDVTRRTPDYFL

SEQ ID NO: 18490 - protein, 316 aa, Rosmarinus officinalis
MDAAVASGGGEGTNGNLDEQIAQLVQCKPLSETEVRMLCGKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDFFPLTALVESEIFCLHGGFSPSIEALDNIRNFDRVQEVPHEGPLCDLLWSDPDDRCGWGISPRGAGYTFGQDISEQFNHTNNLKLIARAHQLVMEGFNWAHDQKVVTIFSAPNYCCRCGNMASILEVDDCRGHTFIQFEPAPRRGEPDVTRRTPDYFL

SEQ ID NO: 18491 - protein, 313 aa, Brassica rapa
MGVDSIPTDATIDLDEQISQLMQCKPLSEQQVRSLCEKAKEILMDESNVQPVKSPVTICGDIHGQFHDLAELFRIGGMCPDTNYLFMGDYVDRGYYSVETVTLLVALKMRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNGLNLIARAHQLVMDGYNWAHEQKVVTIFSAPNYCYRCGNMASILEVDDCMNHSFIQFEPAPRRGEPDVTRRTPDYFL

SEQ ID NO: 18492 - protein, 313 aa, Vicia sativa
MGANSNLAESTHDLNEQISQLMQCKPLSEQQVKELCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 18493 - protein, 310 aa, Nicotiana benthamiana
MSLDPVVSSQGNLDEQIAQLMQCKPLSEQEIRGLCGKAKEILMNKSNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTVLVESEIFCLHGGLSPSIQTLDNIFDRVQEVPHEGAICDLLWSDPDDRCGWGISPRGAGYTFGQDISEQFNHTNNLKLIARAHQLVMEGFNWAHDQKVVTIFSAPNYCYRCGNMASILEVDNCNGHTFIQFEPAPRRGEPDVTRRTPDYFL

SEQ ID NO: 18494 - protein, 292 aa, Ambrosia trifida
MECKPLSEPEVKTLCEKAKEILMGESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFDPAPRRGEPDVTRRTPDYFL

SEQ ID NO: 18495 - protein, 313 aa, Brassica oleracea
MGANSIPTDATIDLDEQIGQLMQCKPLSEQQVRSLCEKAKEILMDESNVQPVKSPVTICGDIHGQFHDLAELFRIGGMCPDTNYLFMGDYVDRGYYSVETVTLLVALKLRYPQRITILRGNHESRQITQVYGFYDECLRKYGNANVWKIFTDLFDFFPLTALVESEIFCLHGGLSPSIETLDNIRNFDRVQEVPHEGPMCDLLWSDPDDRCGWGISPRGAGYTFGQDISEQFNHSNGLKLIARAHQLVMDGYNWAHEQKVVTIFSAPNYCYRCGNMASILEVDDCRNHSFMQFEPAPRRGEPDVTRRTPDYFL

SEQ ID NO: 18496 - protein, 313 aa, Euphorbia peplus
MDSNTPSTDSVSDLNEHISQLMQCRPLSEPQVRSLCDKAKEILMQESNVQPVRSPVTICGDIHGQFHDLAELFRIGGKCPDSNYLFMGDYVDRGYYSVETVTLLVALKVRYPERITILRGNHESRQITQVYGFYDECLRKYGNANVWKTFTDLFDYFPLTALVESEIFCLHGGLSPSIETLDNIRNFDRVQEVPHEGAMCDLLWSDPDDRCGWGISPRGAGYTFGQDISEQFNHSNNLKLIARAHQLVMDGFNWAHEQKVVTIFSAPNYCYRCGNMASILEVDDCRGHTFIQFEPAPRRGEPDVTRRTPDYFL

SEQ ID NO: 18497 - protein, 312 aa, Gossypium raimondii
MESSVGLNSHDNLDKQISQLMQCKPLSEQEIKLLCDKAKEILRDESNVQPVKSPVTICGDIHGQFHDLAELFRIGGKCPDTNYLFMGDYVDRGYYSVETVTLLVAIKARYPQRITILRGNHESRQITQVYGFYDECLRKYGTANVWKTFTDLFDYFPLTALVESEIFCLHGGLSPAIETLDNIRNFDRVQEVPHEGPMCDLLWSDPDDRCGWGISPRGAGYTFGQDISEQFNHKNSLKLIARAHQLVMEGFNWGHEQNVVTIFSAPNYCYRCGNMASILEVDDCKAHTFIQFEPAPRRGEPDVTRRTPEYFL

SEQ ID NO: 18498 - protein, 306 aa, Solanum tuberosum
  Sequence also found in Organisms: Solanum phureja
MDSVGNLDEQIGLLMQCKPLSEQAVRGLCEKAKEILVQESNVQPVKSPVTICGDIHGQFHDLAELFRIGGKCPDTNYLFMGDYVDRGYYSVETVSLLVALKVRYPQRITILRGNHESRQITQVYGFYDECLRKYGNANVWKTFTDLFDYFPLTALVESEIFCLHGGLSPTIETLDDIRNFDRVQEVPHEGAMCDLLWSDPDDRCGWGISPRGAGYTFGQDISEQFNHTNNLNLIARAHQLVMEGFNWAHDQKVVTIFSAPNYCYRCGNMASILEVDDAKDRTFIQFEPAPRRGEPDVTRRTPDYFL

SEQ ID NO: 18499 - protein, 313 aa, Helianthus annuus
MSSDPVMQGVNHNVDEYISQLMQCKPLSEPEVKSLCDKAKEILMQESNVQPVKSPVTICGDIHGQFHDLAELFRIGGKCPDTNYLFMGDYVDRGYYSVETVSLLVALKVRYPQRLTILRGNHESRQITQVYGFYDECLRKYGTANVWKTFTDLFDYLPLTALVESEIFCLHGGLSPSIETLDNIRNFDRVQEVPHEGPMCDLLWSDPDDRCGWGISPRGAGYTFGQDISEQYNHTNGLKLIARAHQLVMEGFNWGHERKVVTIFSAPNYCYRCGNMASILEVDDCKGHTFIQFEPAPRRGEPDVTRRTPDYFL

SEQ ID NO: 18500 - protein, 314 aa, Vigna unguiculata
MGANSLPSAESNFDLDEQISQLMQCKPLSEHQVRVLCEKAKEILMDESNVQPVKSPVTICGDIHGQFHDLAELFRIGGKCPDTNYLFMGDYVDRGYYSVETVTLLVSLKVRYPQRITILRGNHESRQITQVYGFYDECLRKYGNANVWKTFTDLFDFFPLTALVESEIFCLHGGLSPSIETLDNIRNFDRVQEVPHEGPMCDLLWSDPDDRCGWGISPRGAGYTFGQDISEQFNHSNKLKLIARAHQLVMDGFNWAHEQKVVTIFSAPNYCYRCGNMASILEVDDSKGHTFIQFDPAPRRGEPDVTRRTPDYFL

SEQ ID NO: 18501 - protein, 323 aa, Capsicum annuum
MKENFNPITEKMSLDPVVSSQGNLDEQISQLMQCKPLSEQEVKGLCEKAKEILMDESNVQPVKSPVTICGDIHGQFHDLAELFRIGGKCPDTNYLFMGDYVDRGYYSVETVSLLVALKVRYPQRITILRGNHESRQITQVYGFYDECLRKYGNATVWKTFTDLFDYFPLTALVESEIFCLHGGLSPSVETLDNIRNFDRVQEVPHEGAMCDLLWSDPDDRFGWGISPRGAGYTFGQDISEQFNHTNNLKLIARAHQLVMEGFNWAHDQKVVTIFSAPNYCYRCGNMASILEVDDCNGHTFIQFEPAPRRGEPDVTRRTPDYFL

SEQ ID NO: 18502 - protein, 303 aa, Platanus occidentalis
MSVDPVPSNSHSHLDEQISQLMQCKPLSEQEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCRGHTFIQFEPAPRRGEPD

SEQ ID NO: 18503 - protein, 321 aa, Gnetum gnemon
MSLDSSVTAAASATSSASYGQLDAQIEQLMQCKPLLEPEVRGLCEKAKEILMQESNVQPVKCPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDNRGHTFIQFEPAPRRGEPDVTRRTPDYFL

SEQ ID NO: 18504 - protein, 306 aa, Solanum lycopersicum
MDSVGNLDEKIGLLMQCKPLSEQAVRGLCEKAKEILVQESNVQPVKSPVTICGDIHGQFHDLAELFRIGGKCPDTNYLFMGDYVDRGYYSVETVSLLVALKVRYPQRITILRGNHESRQITQVYGFYDECLRKYGNANVWKTFTDLFDYFPLTALVESEIFCLHGGLSPTIETLDDIRNFDRVQEVPHEGAMCDLLWSDPDDRCGWGISPRGAGYTFGQDISEQFNHTNNLNLIARAHQLVMEGFNWAHDQKVVTIFSAPNYCYRCGNMASILEVDDAKDRTFIQFEPAPRRGEPDVTRRTPDYFL

SEQ ID NO: 18505 - protein, 313 aa, Cichorium intybus
MSFDPVMQRVNRNVDEHISQLMQCKPLSEQEVRSLCDKAKEILMKESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGFNWGHEQKVVTIFSAPNYCYRCGNMASILEVDDCKGHTFIQFEPAPRRGEPDVTRRTPDYFL

SEQ ID NO: 18506 - protein, 314 aa, Amorphophallus konjac
MTMADPVPSDSHGNIDEQISQLMQCKPLSEQEVRVLCDKAKEMLMEESNVQPVKSPVTICGDIHGQFHDLAELFRIGGKCPDTNYLFMGDYVDRGYYSVETVTLLVALKVRYPQRITLLRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHANNLNLIARAHQLVMDGYNWGHEQKVVTIFSAPNYCYRCGNMASIMEVDDTKGRMFIQFEPAPRRGEPDVTRRTPDYFL

SEQ ID NO: 18507 - protein, 314 aa, Glycine max
MGANSLSSAESTLDLDEQISQLMQCKPLSEHQVRVLCEKAKEILMDESNVQPVKSPVTICGDIHGQFHDLAELFRIGGKCPDTNYLFMGDYVDRGYYSVETVTLLVSLKVRYPQRITILRGNHESRQITQVYGFYDECLRKYGNASVWKIFTDLFDFFPLTALVESEIFCLHGGLSPSIETLDNIRNFDRVQEVPHEGPMCDLLWSDPDDRCGWGISPRGAGYTFGQDISEQFNHTNKLKLIARAHQLVMDGFNWAHEQKVVTIFSAPNYCYRCGNMASILEVDDSMGHTFIQFDPAPRRGEPDVTRRTPDYFL

SEQ ID NO: 18508 - protein, 314 aa, Glycine max
MGANSLPSAESNFDLDEQISQLMQCKPLSEHQVRVLCEKAKEILMEESNVQPVKSPVTICGDIHGQFHDLAELFRIGGKCPDTNYLFMGDYVDRGYYSVETVTLLVSLKVRYPQRITILRGNHESRQITQVYGFYDECLRKYGNASVWKIFTDLFDFFPLTALVESEIFCLHGGLSPSIETLDNIRNFDRVQEVPHEGPMCDLLWSDPDDRCGWGISPRGAGYTFGQDISEQFNHSNKLKLIARAHQLVMDGFNWAHEQKVVTIFSAPNYCYRCGNMASILEVDDSKGHTFIQFDPAPRRGEPDVTRRTPDYFL

SEQ ID NO: 18509 - protein, 292 aa, Centaurea maculosa
MQCKPLSEQEVRSLCDKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDNIRNFDRVQEVPHEGPMCDLLWSDPDDRCGWGISPRGAGYTFGQDISEQFNHTNKLKLIARAHQLVMEGFNWGHEQKVVTIFSAPNYCYRCGNMASILEVDDCKGHTFIQFEPAPRRGEPDVTRRTPDYFL

SEQ ID NO: 18510 - protein, 300 aa, Raphanus sativus
LDEQISQLMQCKPPSEQQVRSLCEKAKEILMDESNVQPVKSPVTICGDIHGQFHDLAELFRIGGMCPDTNYLFMGDYVDRGYYSVETVTLLVALKLRYPQRLPILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGYNWAHEQKVVTIFSAPNYCYRCGNMASILEVDDCMNHSFIQFEPAPRRGEPDVTRRTPDYFL

SEQ ID NO: 18511 - protein, 309 aa, Brassica juncea
PTDATLDLDEQISQLMQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGYNWAHEQKVVTIFSAPNYCYRCGNMASILEVDDCRNHTFIQFEPAPRRGEPDVTRRTPRTTSYK

SEQ ID NO: 18512 - protein, 314 aa, Eucalyptus grandis
MSSDSLSSSHSHAGIDGHVSQLLQCKPLSEQQVRVLCEKAKEILMEEDNVQPVKSPVTICGDIHGQFHDLAELFRIGGKCPDTNYLFMGDYVDRGYYSVETVSLLVALKVRHPQRITILRGNHESRQITQVYGFYDECLRKYGNANVWKIFTDLFDYLPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPKRGEPDVTRRMPDYFL

SEQ ID NO: 18513 - protein, 305 aa, Arnica chamissonis
MSVELASDTHGNLDEQITQLMQCKPLIEPEVRTLCDKAKEILIDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGFNWGHDQKVVTIFSAPNYCYRCGNMASILEVDDCKGHTFIQFEPAPRRGEPDVTR

SEQ ID NO: 18514 - protein, 292 aa, Brassica juncea
MQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGFNWAHEQKVVTIFSAPNYCYRCGNMASILEVDDCRNHTFIQFEPAPRRGEPDVTRRTPDYFL

SEQ ID NO: 18515 - protein, 287 aa, Ocimum basilicum
LSEPEVKALCEKAKEILMQESNVQPVKSPVTICGDIHGQFHDLAELFRIGGKCPDTNYLFMGDYVDRGYYSVETVTLLVSLKVRYPQRITILRGNHESRQITQVYGFYDECLRKYGTANVWKTFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMEGYNWAHEQKVVTIFSAPNYCYRCGNMASILEVDDCKEHTFIQFEPAPRRGEPDVTRRTPDYFL

SEQ ID NO: 18516 - protein, 299 aa, Fagopyrum esculentum
TDRPAHAVTTSPFRARGEVLCVEKAKEILMEESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGYNWGHDQKVVTIFSAPNYCYRCGNMASILEVDDCNGHTFIQFEPAPRRGEPDVTRRTPDYFL

SEQ ID NO: 18517 - protein, 311 aa, Olea europaea
VAESVAATTHGKYWTSRLLSSCSASLVDRGQGLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSVETLDNIRNFDRVQEVPHEGPMCDLLWSDPDDRCGWGISPRGAGYTFGQDISEQFNHTNNLKLIARAHQLVMEGYNWAHEQKVVTIFSAPNYCYRCGNMASILEVDDCREHTFIQFEPAPRRGEPDITRRTPDYFL

SEQ ID NO: 18518 - protein, 310 aa, Ambrosia trifida
MSLDPATQRVNHNVDEHISQLMQCKPLSEQEVRSLCDKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYLPLTALVESEIFCLHGGLSPSIETLDNIRNFDRVQEVPHEGPMCDLLWSDPDDRCGWGISPRGAGYTFGQDISEQYNHTNGLKLIARAHQLVMEGFNWGHERKVVTIFSAPNYCYRCGNMASILEVDDCKGHTFIQFEPAPRRGEPDVTRRTPD

SEQ ID NO: 18519 - protein, 317 aa, Zostera marina
MNADTTAFKASPIHGDSIDEQIEQLMDCKPLSEREVKALCEKAKEILMEESNVQPVKSPVTICGDIHGQFHDLAELFRIGGKCPDTNYLFMGDYVDRGYYSVETVTLLVSLKVRYPSRITILRGNHESRQITQVYGFYDECLRKYGSPTVWKTFTDLFDYLPLTALVESEIFCLHGGLSPSIETLDNIRNFDRVQEVPHEGAMCDLLWSDPDDRCGWGISPRGAGYTFGQDISEQFNHNNNLNLIARAHQLVMEGFNWGHEQKVVTIFSAPNYCYRCGNMASILEVDDCKKHTFIQFEPAPRRGEPDVTRRTPDYFL

SEQ ID NO: 18520 - protein, 313 aa, Phaseolus vulgaris
MGANSLPSTESNLDLDEQISQLMQCKPLSELQVRALCEKAKEILMDESNVQPVKSPVTICGDIHGQFHDLAELFRIGGKFPDTNYLFMGDYGRGYYSVETVTLLVSLKVRYPQRITILRGNHESRQITQVYGFYDECLRKYGNANVWKTFTDLFDFFPLTALVESEIFCLHGGLSPSIETLDNIRNFDRVQEVPHEGPMCDLLWSDPDDRCGWGISPRGAGYTFGQDISEQFNHTNKLKLIARAHQLVMDGFNWAHEQKVVTIFSAPNYCYRCGNMASILEVDDSKGHTFIQFDPAPRRGEPDVTRRTPDYFL

SEQ ID NO: 18521 - protein, 288 aa, Cedrus atlantica
PLSEQEVRGLCEKAKEILMEESNVQPVKCPVTICGDIHGQFHDLAELFRIGGKCPDTNYLFMGDYVDRGYYSVETVTLLVSLKVRYPQRITILRGNHESRQITQVYGFYDECLRKYGNANVWKIFTDLFDYFPLTALVESEIFCLHGGLSPSIDTLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDTKGHTFIQFEPAPRRGEPDVTRRTPDYFL

SEQ ID NO: 18522 - protein, 282 aa, Carica papaya
VRVLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNVRNFDRVQEVPHEGPMCDLLWSDPDDRCGWGISPRGAGYTFGQDISEQFNHTNNLKLIARAHQLVMDGFNWAHEQKVVTIFSAPNYCYRCGNMASILEVDDCKGHTFIQFEPAPRRGEPDVTRRTPDYFL

SEQ ID NO: 18523 - protein, 322 aa, Ambrosia trifida
MSLDHVNHNVDEQITQLMECKPLSEQEVRALCDKAKEILMQESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMDGYNWGHEQKVVTIFSAPNYCYRCGNMASILEVDDCKGHTFIQFEPAPRRGEPDVTRRTPDYSYDVDLAILIRPTCT

SEQ ID NO: 18524 - protein, 329 aa, Nuphar advena
SSPPPPPETQTESDTHQGRPPPRPNPHRHLDSQIAQLMQCKPLSEQEVRPFCDKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNATVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFSWGHEQKVVTIFSAPNYCYRCGNMASILEVDDCKGHTFIQFEPAPRRGEPDVTRRTPDYFL

SEQ ID NO: 18525 - protein, 287 aa, Echinacea purpurea
DEQISQLMQCKPLPEPEVRTLCDKAKEILIDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNSLKLIARAHQLVMEGFNWGHEQKVVTIFSAPNYCYRCGNMASILEVDDCKGHTFIQFEPAPRRGE

SEQ ID NO: 18526 - protein, 282 aa, Festuca arundinacea
VRALCEKAKEILMEESNVQPVKSPVTICGDIHGQFHDLAELFRIGGKCPDTNYLFMGDYVDRGYYSVETVTLLVSLKVRYPQRITILRGNHESRQITQVYGFYDECLRKYGNAMVWKTFTDLFDYFPLTALVESEIFCLHGGLSPSIETLDNIRNFDRIQEVPHEGSMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 18527 - protein, 283 aa, Cicer arietinum
QVRVLCDKAKEILMEESNVQPVKSPVTICGDIHGQFHDLAELFRIGGKCPDTNYLFMGDYVDRGYYSVETVTLLVALKVRYRQRITILRGNHESRQITQVYGFYDECLRKYGSANVWKMFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPRRGEPDVTRRTPDYFL

SEQ ID NO: 18528 - protein, 290 aa, Carica papaya
MDSVPSNSHGNLDEQINQLMQCKPLSEQEVRSLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQ

SEQ ID NO: 18529 - protein, 318 aa, Vinca minor
MSTADLVAPSTHGNLDEQISQLMQCKPLSETEVRTLCEKAKEILMEESNVQPVRSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWSHEQKVVTIFSAPNYCYRCGNMASILEVDDCRQHTFIQVILSLYFFFMTVLFLLHHLFLAFTI

SEQ ID NO: 18530 - protein, 279 aa, Brassica juncea
LCEKAKEILMDESNVQPVKSPVTICGDIHGQFHDLAELFRIGGMCPDTNYLFMGDYVDRGYYSVETVTLLVALKLRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHSNSLKLIARAHQLVMDGFNWAHEQKVVTIFSAPNYCYRCGNMASILEVDDCRNHTFIQFEPAPRRGEPDVTRRTPDYFL

SEQ ID NO: 18531 - protein, 281 aa, Mimulus guttatus
MSVNYFANEILMLESNVQPVKSPVTICGDIHGQFHDLAELFRIGGKCPDTNYLFMGDYVDRGYYSVETVTLLVSLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWAHEQKVVTIFSAPNYCYRCGNMASILEVDDCREHTFIQFEPAPRRGEPDVTRRTPDYFL

SEQ ID NO: 18532 - protein, 289 aa, Ricinus communis
MSLESVPTNTHGNLDEQINQLMQCKPLSEQEVRGLCDKAKEILMEESNVQPVKSPVTICGDIHGQFHDLAELFRIGGKLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKGHTFIQFEPAPRRGEPDVTRRTPDYFL

SEQ ID NO: 18533 - protein, 278 aa, Triphysaria pusilla
MQKAKEILMDESNVQPVKSPVTICGDIHGQFHDLAELFRIGGKCPDTNYLFMGDYVDRGYYSVETVTLLVALKVRFPQRLTILRGNHESRQITQVYGFYDECLRKYGNANVWKTFTDLFDYFPLTALVESEIFCLHGGLSPSIETLDNVRNFDRVQEVPHEGAMCDLLWSDPDDRCGWGISPRGAGYTFGQDISEQFNHTNGLKLIARAHQLVMEGFNWAHEQKVVTIFSAPNYCYRCGNMASILEVDDCRGHSFIQFEPAPRRGEPDVTRRTPDYFL

SEQ ID NO: 18534 - protein, 330 aa, Euphorbia esula
MDSNSPSTDSVSDLNEQISQLMQCRPLSEPQVRSLCEKAKEILMQESNVQPVRSPVTICGDIHGQFHDLAELFRIGGKCPDSNYLFMGDYVDRGYYSVETVTLLVALKVRYPERITILRGNHESRQITQVYGFYDECLRKYGNANVWKIFTDLFDYFPLTALVESEIFCLHGGLSPSIETLDNIRNFDRVQEVPHEGAMCDLLWSDPDDRCGCGISPRGAGYTFGQDISEQFNHSNNLKLIARAHQLVMDGFNWAHEQKVVTIFSAPNYCYRCGNMASILEVDDCRGHTFIQFEPAPRRGEPDVTRRTPDYFLSHKPHVHTCLTCLRLRS

SEQ ID NO: 18535 - protein, 284 aa, Lupinus angustifolius
MDSNSHGNLDEQISQLMQCKPLSEQEVRALCDKAKEILMEESNVQPVKSPVTICGDIHGQFHDLAELFRIGGKCPDTNYLFMGDYVDRGYYSVETVTITQVYGFYDECLRKYGSANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGYNWGHDQKVVTIFSAPNYCYRCGNMASILEVDDCKGHTFIQFEPAPRRGEPDVTRRTPDYFL

SEQ ID NO: 18536 - protein, 264 aa, Panicum virgatum
QPVKSPVTICGDIHGQFHDLVELFRIGGKCPDTNYLFMGDYVDRGYYSVETVTLLVALKVRYPHRITILRGNHESRQITQVYGFYDECLRKYGSANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHSFIQFEPAPRRGEPDVTRRTPDYFL

SEQ ID NO: 18537 - protein, 292 aa, Cocos nucifera
MDVDPVPANSHGNVEEQISQLMQCKPLSEQEVRVLCDKAKEILIEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGAMCDLLWSDPDDRCGWGISPRGAGYTFGQDISEQFNHTNNLKLIARAHQLVMEGYNWGHEQKVVTIFSAPNYCYRCGNMASILEVDDCKGHTFIQ

SEQ ID NO: 18538 - protein, 270 aa, Flaveria ramosissima
MAESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFDPAPRRGEPDVTRRTPDYFL

SEQ ID NO: 18539 - protein, 270 aa, Vitis vinifera
MEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHEQKVVTIFSAPNYCYRCGNMASILEVDDCKGHTFIQFEPAPRRGEPDVTRRTPDYFL

SEQ ID NO: 18540 - protein, 270 aa, Cannabis sativa
MDESNVQPVKSPVTICGDIHGQFHDLAELFRIGGKCPDTNYLFMGDYVDRGYYSVETVTLLVALKVRYSQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHEQKVVTIFSAPNYCYRCGNMASILEVDDCKNHTFIQFEPAPRRGEPDVTRRTPDYFL

SEQ ID NO: 18541 - protein, 322 aa, Musa acuminata
MSVNPMPASVTHGNLDEQIAQLMQCKPLSEQEVRMLCEKAKEVLMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDSIRSFDRVQEVPHEGPMCDLLWSDPDDRCGWGISPRGAGYTFGQDISEQFNHTNNLKLIARAHQLVMEGYNWGHEQKVVTIFSAPNYCYRCGNMASIMEVDECKGQTFIQVIILVIFCLSQQTQFNGSSIVLSLNICLL

SEQ ID NO: 18542 - protein, 302 aa, Flaveria ramosissima
MSVELASDTHGNLDEQISQLMQCKPLIESEVRTLCDKAKEILIDESNVQPVKSPVTICGDIHGQFHDLAELFRIGGKCPDTNYLFMGSYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWGHDQKVVTIFSAPNYCYRCGNMASILEVDDCKGHTVIQLNLLLGEENLM

SEQ ID NO: 18543 - protein, 270 aa, Ambrosia trifida
MQESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMDGYNWGHEQKVVTIFSAPNYCYRCGNMASILEVDDCKGHTFIQFEPAPRRGEPDVTRRTPDYFL

SEQ ID NO: 18544 - protein, 270 aa, Bupleurum chinense
MKESNVQPVKSPVTICGDIHGQFHDLAELFRIGGKCPDTNYLFMGDYVDRGYYSVETVTLLVALKVRYHQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGFNWGHDQKVVTIFSAPNYCYRCGNMASILEVDDCNGHTFIQFEPAPRRGEPDVTRRTPDYFL

SEQ ID NO: 18545 - protein, 290 aa, Euphorbia esula
MGANSPSTDSISDLDEQISQLMQCKPLSETQVRSLCDKAKEILMQESNVQPVKSPVTICGDIHGQFHDLAELFRIGGKCPDSNYLFMGDYVDRGYYSVETVTLLVALKVRYPQRITILRGNHESRQITQVYGFYDECLRKYGNANVWKIFTDLFDYFPLTALVESEIFCLHGGLSPSIETLDNIRNFDRVQEVPHEGAMCDLLWSDPDDRCGWGISPRGAGYTFGQDISEQFNHTNNLKLIARAHQLVMDGFNWAHEQKVVTIFSAPNYCYRCGNMASILEVDDCNSHTF

SEQ ID NO: 18546 - protein, 270 aa, Secale cereale
MEESNVQPVRSPVTICGDIHGQFHDLAELFRIGGKCPDTNYLFMGDYVDRGYYSVETVTLLVSLKVRYPQRITILRGNHESRQITQVYGFYDECLRKYGNATVWKTFTDLFDYFPLTALVESEIFCLHGGLSPSIETLDNIRNFDRTQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 18547 - protein, 292 aa, Flaveria ramosissima
MSVEMASDTHGNLDEQISQLMQCKPLTESEVRTLCDKAKEILIDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGFNWGHDQKVVTIFSAPNYCYRCGNMASILEVDDCKGHTGYRV

SEQ ID NO: 18548 - protein, 342 aa, Carthamus tinctorius
MSSDTAVSSGHGSIDEFISQLMQCKPLSEQEVRVLCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGNASVWKIFTDLFDYLPLTALVESEIFCLHGGLSPSIETLDNIRNFDRVQEVPHEGPMCDLLWSDPDDRCGWGISPRGAGYTFGQVSPLPSFLSCRILFLTVAKYFIIWYFIYQDISEQFNHTNSLKLIARAHQLVMEGFNWGHEQKVVTIFSAPNYCYRCGNMASVLEVDDCKGHTFIQFEPAPRRGEPDVTRRTPDYFL

SEQ ID NO: 18549 - protein, 270 aa, Chrysanthemum coronarium
MKESNVQPVKSPVTICGDIHGQFHDLAELFRIGGKCPDTNYLFMGDYVDRGYYSVETVSLLVALKVRYPQRITILRGNHESRQITQVYGFYDECLRKYGTANVWKTFTDLFDYFPLIALVESEIFCLHGGLSPSIETLDNIRNFDRVQEVPHEGPMCDLLWSDPDDRCGWGISPRGAGYTFGQDISEQFNHTNGLKLIARAHQLVMEGFNWGHEQKVVTIFSAPNYCYRCGNMASILEVDDCKGHTFLQFEPAPRRGEPDVTRRTPDYFL

SEQ ID NO: 18550 - protein, 270 aa, Cynara scolymus
MVGRNVQPVKSPVTICGDIHGQFHDLAELFRIGGKCPDTNYLFMGDYVDRGYYSVETVTLLVALKVRYPQRLTILRGNHESRQITQVYGFYDECLRKYGNASVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGFNWGHEQKVVTIFSAPNYCYRCGNMASILEVDDCKGHTFIQFEPAPRRGEPDVTRRTPDYFL

SEQ ID NO: 18551 - protein, 306 aa, Populus trichocarpa
MPSHVDLDRQIEHLMQCKPLAEAEVKALCEQARAVLVEEWNVQPVKCPVTVCGDIHGQFHDLVELFRIGGNAPDTNYLFMGDYVDRGYYSVETVTLLVALKVRYRDRITILRGNHESRQITQVYGFYDECLRKYGNANVWKHFTDLFDYLPLTALIESQIFCLHGGLSPSLDTLDNIRSLDRIQEVPHEGPMCDLLWSDPDDRCGWGISPRGAGYTFGQDISQQFNHTNGLALISRAHQLVMEGYNWSQDKNVVTVFSAPNYCYRCGNMAAILEIGENMEQNFLQFDPAPRQIEPDTTRRTPDYFL

SEQ ID NO: 18552 - protein, 306 aa, Populus trichocarpa
MPSHVDLDRQIEHLMQCKPLAEAEVKALCEQARAVLVEEWNVQPVKCPVTVCGDIHGQFHDLVELFRIGGNAPDTNYLFMGDYVDRGYYSVETVTLLVALKVRYRDRITILRGNHESRQITQVYGFYDECLRKYGNANVWKYFTDLFDYLPLTALIESQIFCLHGGLSPSLDTLDNIRSLDRIQEVPHEGPMCDLLWSDPDDRCGWGISPRGAGYTFGQDISQQFNHTNGLTLISRAHQLVMEGYNWSQDKNVVTVFSAPNYCYRCGNMAAILEIGENMEQNFLQFDPAPRQIEPDTTRRTPDYFL

SEQ ID NO: 18553 - protein, 285 aa, Flaveria ramosissima
MSVEMASDTHGNLDEQISQLMQCKPLTESEVRTLCDKAKEILIDESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLKLIARAHQLVMEGFNWGHDQKVVTIFSAPNYCYRCGNMASILEVDDCK

SEQ ID NO: 18554 - protein, 306 aa, Ricinus communis
MPSHVDLDRQIEHLMQCKPLSEGEVKALCEQARAILVEEWNVQPVKCPVTVCGDIHGQFHDLVELFRIGGNAPDTNYLFMGDYVDRGYYSVETVTLLVALKVRYRDRITILRGNHESRQITQVYGFYDECLRKYGNANVWKHFTDLFDFLPLTALIESQIFCLHGGLSPSLDTLDNIRALDRIQEVPHEGPMCDLLWSDPDDRCGWGISPRGAGYTFGQDISQQFNHTNGLTLISRAHQLVMEGYNWAQDKNVVTVFSAPNYCYRCGNMAAILEIGENMEQNFLQFDPAPRQIEPDTTRRTPDYFL

SEQ ID NO: 18555 - protein, 256 aa, Avena sativa
ICGDIHGQFHDLVELFRIGGKCPDTNYLFMGDYVDRGYYSVETVSLLVALKVRHPHRITILRGNHESRQITQVYGFYDECLRKYGNASVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHSFIQFEPAPRRGEPDVTRRTPDYFL

SEQ ID NO: 18556 - protein, 461 aa, Saccharum officinarum
MVGSYANGGGAAALVAEEKLDALRRLLGKSDGDPLRVVGVGAGAWGSVFCALLQDAYGRHRDRVQVRVWRRPGRAVDRADAERLFEVINSREDVLRRLIRRCAYLKYVEARLGDRTLHADEILRDGFCLNMLDTPLCPLKVVTNLQEAVWDADIVVNGLPSTETREVFEEIGRYWKERITQPLIISLAKGIEASLDPVPRIITPTQMISNATGSPLENILYLGGPNIASEIYNKEYANARICGADKWRKPLANFLRQPHFIVWDNSDLITHEVMGGLKNVYAIGAGMVAALTNESATSKSVYFSLCTSEMIYITHLLAREPEKLAGPLLADTYVTLLKGRNAWYGQKLAKGELTLETGDSIKGKGTIQGVSAVNAFYELLSQGSLSVMHPETKKAVAPVELCPILKTLYKILIKRELTTNSILQAIRDESMYDPRERIELAQRQSLYRPSLLGLPKGDAKA

SEQ ID NO: 18557 - protein, 462 aa, Zea mays
MVGSYANGGGAAPAAVAAEKLDELRLLLGKSDGDTLRVVGVGAGAWGSVFCALLQDAYGRHRDRVQVRVWRRAGRAVDRADAERLFEVINSREDVLRRLIRRCAYLKYVEARLGDRTLHADEILRDGFCLNMLDTPLCPLKVVTNLQEAVWDADIVINGLPSTETREVFGEIGRYWKERISQPLIISLAKGIEASLDPVPRIITPTQMISNATGVPLENILYLGGPNIASEIYNKEYANARICGADKWRKHLANFLRQPHFIVWDNSDLITHEVMGGLKNVYAIGAGMVAALTNESATSKSVYFSLCTSEMIYITHLLAPEPEKLAGPLLADTYVTLLKGRNAWYGQKLAKGELTLEMGDSIKGKGTIQGVSAVNAFYELLSQGSLSVMHPETKKAVAPVELCPILKTLYKILIKRELTTNSILQAIRDESMYDPRERIEMAQRQSLYRPSLLGLPKADAKA

SEQ ID NO: 18558 - protein, 457 aa, Panicum virgatum
MVGTYANGGSAAEEKLDELRRLLGKSDGDPLRVVGVGAGAWGSVFCALLQDAYGRYRDRVQVRVWRRAGRAVDRADAERLFEVINAREDVLRRLIRRCAYLKYVEARLGDRTLHADEILRDGFCLNMLDTPLCPLKVVTNLQEAVWDADIVVNGLPSTETREVFGEIGRYWKERITQPLIISLAKGIEASLDPVPRIITPTQMISNATGVPLENILYLGGPNIASEIYNKEYANARICGADKWRKPLAKFLRQPHFIVWDNSDLITHEVMGGLKNIYAIGAGMVAALTNESATSKSVYFSLCTSEMIYITHLLAREPEKLAGPLLADTYVTLLKGRNAWYGQKLAKGELTLEMGDSIKGKGTIQGVSAVNAFYELLSQGSLCVMHPETKKPVAPVELCPILKTLYKILIKRELATDSILQAIRDESMYDPRERIEMAQRQSLYRPSLLGLPKGDAKA

SEQ ID NO: 18559 - protein, 459 aa, Panicum virgatum
MVGSYASGGSAAAAAEKLDELRRLLGKSDGDPLRVVGVGAGAWGSVFCALLQDAYGRHRDRVQVRVWRRPGRAVDRADAERLFEVINAREDVLRRLIRRCAYLKYVEARLGDRTLHADEILRDGFCLNMLDTPLCPLKVVTNLQEAVWDADIVVNGLPSTETREVFEEIGRYWKERITQPLIISLAKGIEASLDPVPRIITPTQMISNATGVPLENILYLGGPNIASEIYNKEYANARICGADKWRKPLAKFLRQPHFIVWDNSDLITHEVMGGLKNVYAIGAGMVAALTNESATSKSVYFSLCTSEMIYITHLLAREPEKLAGPLLADTYVTLLKGRNAWYGQKLAKGELTLEMGDSIKGKGTIQGVSAVNAFYELLSQGSLCVMHPETKKPVAPVELCPILKTLYKILIKRELATDSILQAIRDESMYDPRERIEMAQRQSLYRPSLLGLPNGDAKA

SEQ ID NO: 18560 - protein, 464 aa, Setaria italica
MVGSYANGGGADAAAALAAEEKLDELRRLLGKSDGDPLRVVGVGAGAWGSVFCALLQDAYGRHRDRVQVRVWRRAGRAVDRADAERLFEVINAREGVLRRLIRRCAYLKYVEARLGDRTLTADEILRDGFCLNMLDTPLCPLKVVTNLQEAVWDADIVVNGLPSTETREVFGEIGRYWKERITQPLIISLAKGIEASLDPVPRIITPTQMISNATGVPLENILYLGGPNIASEIYNKEYANARICGAEKWRKPLAKFLRQPHFIVWDNSDLITHEVMGGLKNVYAIGAGMVAALTKESATSKSVYFSLCTSEMIYITHLLAREPEKLAGPLLADTYVTLLKGRNAWYGQKLANGELTLEMGDSIKGKGTIQGVSAVNAFYELLSQGSLCVMHPETKKPVAPVELCPILKTLYKILIKRELGTDSILQAIRDESMYDPRERIEMAQRQSLYRPSLLGLPKGDAKA

SEQ ID NO: 18561 - protein, 464 aa, Brachypodium distachyon
MGGSYTNGVGGGAANGAAEGKLDELRRLLGKAEGDPLRIAGVGAGAWGSVFCALLQDAYGRDYRDKAQVRVWRRPGRTVDRATAEHLFEVINSREDVLRRLIRRCAYLKYVEARLGDRTLYADEILRDGFCLNMIDTPLCPLKVVTNLQEAVWDADIVINGLPSTETREVFGEIGRYWKERINPPVIISLAKGVEASLDPVPRIITPTQMITDATGVPLENVLYLGGPNIASEIYNKEYANARICGADKWRKPLSKFLRQPHFIVWDNSDLITHEVMGGLKNIYAIGAGMVAALTNESATSKSVYFSLCTSEMIYITHLLAEEPEKLSGPLLADTYVTLLKGRNAWYGHKLAKGELTLEMGDSIKGKGTIQGVSAVNAFYELLSQGSLSVMHPETKKHVAPVELCPILKTLYKILIKRDLGTNSILQAIRDESMYDPRERIEMAQRQSLYRPSLLGLPKGDTKS

SEQ ID NO: 18562 - protein, 465 aa, Oryza sativa
MVGSYAAGGGRGAAVAAVAEGKLDELRRRMGKADGDLLRIVGVGGGAWGSAFCALLQDAYGRHRDKAQVRVWRRPGRAVDRATAEHLFEVINSREDVLRRLIRRCAYLKYVEARLGDRTLYADEILRDGFCLNMVDTPLCPLKVVTNLQEAVWDADIVINGLPSTETREVFGEIGRYWKERIRPPVIISLAKGIEASIDPVPRIITPTQMISNATGVPLENILYLGGPNIASEIYNKEYANARICGADKWRKPLAKFLRQPHFIVWDNSDLITHEVMGGLKNIYAIGAGMVAALTNESATSKSVYFSLCTSEMIYITHLLAEDPEKLAGPLLADTYVTLLKGRNAWYGQKLAKGELTLEMGDSIKGKGTIQGVSAVHAFYELLSQSSLSVTHPEVKKLVAPVELCPILKTLYKILIKRELATDSILQAIRDESMYDPRERIEMSQRQCLYRPSLLGLPKVDITQA

SEQ ID NO: 18563 - protein, 467 aa, Secale cereale
MVGTYANGAGGGGGGGKNGAAEGRLDELRRRLGKAEGDPLRIAGVGAGAWGSVFCALLQDAYGRDHRDKAQVRVWRRAGRAVDRATAEHLFEVINAREGVLRRLIRRCAYLKYVEARLGDRTLYADEILRDGFCLNMIDTPLCPLKVVTNLQEAVWDADIVINGLPSTETREVFGEIGRYWKERISPPIIISLAKGIEASLDPMPRIITPTQMIANATGVPLENILYLGGPNIASEIYNKEYANARICGADKWRKPLSKFLRQPHFIVWDNSDLITHEVMGGLKNIYAIGAGMVAALTNESATSKAVYFSLCTSEMIYITHLLAEEPEKLSGPLLADTYVTLLKGRNAWYGHKLAKAELTLEMGDSIKGKGTIQGVSAVNAFYELLSQGSISVTHPETKKHVAPVELCPILKTLYKILIKRELGTSSILEAIRDESMSDPRERIEMAQRQSLYRPSLLGLPKGDIKL

SEQ ID NO: 18564 - protein, 460 aa, Hordeum vulgare
MVGSYANGAGLGKKGAAEGKLDELRRRLGKAEGDPLRIAGVGAGAWGSVFCALLQDAYGRDHRDKAQVRVWRRPGRAVDRATAEHLFEVINAREGVLRRLIRRCAYLKYVEARLGDRTLYADEILRDGFCLNMIDTPLCPLKVVTNLQEAVWDADIVINGLPSTETREVFGEIGRYWKERINPPIIISLAKGIEASLDPMPRIITPTQMIANATGVPLENILYLGGPNIASEIYNKEYANARICGADKWRKPLSKFLRQPHFIVWDNSDLVTHEVMGGLKNIYAIGAGMVAALTNESATSKSVYFSLCTSEMIYITHLLAEEPERLSGPLLADTYVTLLKGRNAWYGHKLAKAELTLEMGDSIKGKGTIQGVSAVNAFYELLSQGSISVTHPETKKHVAPVELCPILKTLYKILIKRELGTSSILEAIRDESMSDPRERIEMAQRQSLYRPSLLGLPKVK

SEQ ID NO: 18565 - protein, 467 aa, Oryza sativa
MGGAEDAPRAAAANGHGNGATVEEKLDELRRLLGKADGDPLRIVGVGAGAWGSVFCALMQDAYGHLRDKVQVRIWRRPGRAVDRATAEHLFEVINAREDVLRRLIRRCAYLKYVEGRLGDRTLYADEILRDGFCLNMIDTPLCPLKVVTNLQEAVWDADIVINGLPSTDTREVFGEIGRYWKERITAPIILSLAKGIEASLDPLPRIITPTQMISNATGVPLENILYLGGPNIASEIYNKEYANARICGADKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGQKLAKGELTLEMGDSIKGKGTIQGVSAVNAFYELLSQDSLSVMHPEANRSVAPVEMCPILKALYKILIKRELPPDSILQAIRDETMYDPRERIEMAQGHSLYRPSLLGQPKGDAKA

SEQ ID NO: 18566 - protein, 467 aa, Oryza sativa
MGGAEDAPRAAAANGHGNGATVEEKLDELRRLLGKADGDPLRIVGVGAGAWGSVFCALMQDAYGHLRDKVQVRIWRRPGRAVDRATAEHLFEVINAREDVLRRLIRRCAYLKYVEGRLGDRTLYADEILRDGFCLNMIDTPLCPLKVVTNLQEAVWDADIVINGLPSTDTREVFGEIGRYWKERITAPIILSLAKGIEASLDPLPRIITPTQMISNATGVPLENILYLGGPNIASEIYNKEYANARICGADKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGQKLAKGELTLEMGDSIKGKGTIQGVSAVDAFYELLSQDSLSVMHPEANRSVAPVEMCPILKALYKILIKRELPPDSILQAIRDETMYDPRERIEMAQGHSLYRPSLLGQPKGDAKA

SEQ ID NO: 18567 - protein, 456 aa, Panicum virgatum
HPNGHANGAVVEEKLDELRRQLGKADGDPLRIVGVGAGAWGSVFCALLQDAYGHLRDKAQVRIWRRPGRAVDRATAEHLFEVINAREDVLRRLIRRCAYLKYVEARLGDRTLYADEILRDGFCLNMIDTPLCPLKVVTNLQEAVWDADIVVNGLPSTDTREVFGEIGRYWNERITAPIIISLAKGIEASLDPLPRIITPTQMISNATGVPLENILYLGGPNIASEIYNKEYANARICGADKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGQKLAKGELTLEMGDSIKGKGTIQGVSAVDAFYELLSQDSLSVMHPEANRSVAPVEMCPILKALHRILIKRDRPADSILQAIRDETMYDPRERIEMAQGHSLYRPSLLGQPKGDVKA

SEQ ID NO: 18568 - protein, 464 aa, Panicum virgatum
MGGAEGPGHPNGHASGAVVAEKLDELRRQLGKADGDPLRIVGVGAGAWGSVFCALLQDAYGHLRDRAQVRIWRRPGRAVDRATAEHLFEVINAREDVLRRLIRRCAYLKYVEARLGDRTLYADEILRDGFCLNMIDTPLCPLKVVTNLQEAVWDADIVVNGLPSTDTREVFGEIGRYWKERITAPIIISLAKGIEASLDPLPRIITPTQMISNATGVPLENILYLGGPNIASEIYNKEYANARICGADKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGQKLAKGELTLEMGDSIKGKGTIQGVSAVDAFYELLSQDSLSVMHPEANRSVAPVEMCPILKALHRILIKRDRPADSILQAIRDETMYDPRERIEMAQGHSLYRPSLLGQPKGDVKA

SEQ ID NO: 18569 - protein, 464 aa, Setaria italica
MGGAEGPGHPNGHANGAVAEEKLDELRRQLGKADGDPLRIAGVGAGAWGSVFCALLQDAYGHLRDKAQVRIWRRPGRAVDRATAGHLFDVINAREDVLRRLIRRCAYLKYVEARLGDRTLYADEILRDGFCLNMIDTPLCPLKVVTNLQEAVWDADIVVNGLPSTDTREVFGEIGRYWKERITAPIIISLAKGIEASLDPLPRIITPTQMISNATGVPLENILYLGGPNIASEIYNKEYANARICGADKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGQKLAKGELTLEMGDSIKGKGTIQGVSAVDAFYELLSQDSLSVMHPEANRSVAPVEMCPILKALHRILIKRDRPADSILQAIRDETMYDPRERIEMAQGHSLYRPSLLGQPKGDVKA

SEQ ID NO: 18570 - protein, 464 aa, Zea mays
MGGAEALGQPDGHANGAVVEEKLDLLRRQLGKADGDPLRIVGVGAGAWGSVFCALLQDAYGHLRDKAQVRIWRRPGRAVDRATAEHLFDVINAREDVLRRLIRRCAYLKYVEARLGDRTLYADEILRDGFCLNMIDTPLCPLKVVTNLQEAVWDADIVVNGLPSTDTREVFGEIRRYWKERITAPIIISLAKGIEASLDPLPRIITPTQMISNATGVPSENILYLGGPNIASEIYNKEYANARICGADKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGQKLAKGELTLEMGDSIKGKGTIQGVSAVDAFYELLSQDSLSVMHPEANRSVAPVEMCPILKALHRILITRDRPADSILQAIRDETMYDPRERIEMAQGHSLYRPSLLGQPKGDVKT

SEQ ID NO: 18571 - protein, 463 aa, Brachypodium distachyon
MGGAEDAPNGHAPANGGVEEKVDELRRLMGKADGDPLRIVGVGAGAWGSVFCALLQDAYGHLRDKVQLRIWRRPGRAVDRATAEHLFEVINAREDVLRRLIRRCAYLKYVEGRLGDRTLYADEILRDGFCLNMIDTPLCPLKVVTNLQEAVWDADIVINGLPSTETRDVFGEIGRYWKERVNDPVIISLTKGIEASLDPVPRIITPTQMISNATRVPLDNILYLGGPNIASEIYNKEYANARICGTDKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGHKLAKGELTLEMGDSIKGKGTIQGVSAVDAFYKLLSQDSLSVMHPEGNKSVAPVEMCPILKRLYKILIKRELPTESILQAIRDESMYDPRERIEMAQGHSLYRPSILGQPHGVAKA

SEQ ID NO: 18572 - protein, 464 aa, Pennisetum glaucum
MGGAEGPGHHPNGHTNGSVAEEKLDELRRQLGKADGDPLRIAGVGAGAWGSVFCALLQDAYGHLRDKAQVRIWRRPGRAVDRATAGHLFDVINAREDVLRRLIRRCAYLKYVEARLGDRTLYADEILRDGFCLNMIDTPLCPLKVVTNLQEAVWDADIVVNGLPSTDTREVFGEIGRYWKERITPPIIISLAKGIEASLDPLPRIITPTQMISNATGVPLENILYLGGPNIASEIYNKEYANARICGADKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGHKLAKGELTLEMGDSIKGKGTIQGVSAVDAFYELLSQDSLSVMHPEANRSVAPVEMCPILKALHRILIKRDRPADSILQAIRDETMYDPRERIEMAQGHSLYRPSLLGQPKDVKV

SEQ ID NO: 18573 - protein, 493 aa, Oryza sativa
MVGSYAAGGGRGAAVAAVAEGKLDELRRRMGKADGDLLRIVGVGGGAWGSAFCALLQDAYGRHRDKAQVRVWRRPGRAVDRATAEHLFEVINSREDVLRRLIRRCAYLKYVEARLGDRTLYADEILRDGFCLNMVDTPLCPLKVVTNLQEAVWDADIVINGLPSTETREVFGEIGRYWKERIRPPVIISLAKGIEASIDPVPRIITPTQMISNATGVPLENILYLGGPNIASEIYNKEYANARICGADKWRKPLAKFLRQPHFIVWDNSDLITHEVMGGLKNIYAIGAGMVAALTNESATSKSVYFSLCTSEMIYITHLLAEDPEKLAGPLLADTYVTLLKGRNAWYGQKLAKGELTLEMGDSIKGKGTIQGVSAVHAFYELLSQSSLSVTHPEVKKLVAPVELCPILKTLYKILIKRLVRLPLLLFLLVLIYVYRLKFFAHFTCRELATDSILQAIRDESMYDPRERIEMSQRQCLYRPSLLGLPKVDITQA

SEQ ID NO: 18574 - protein, 464 aa, Sorghum bicolor
MGGAEGLGQPDGHANGAAVVEEKLDALRRQLGKADGDPLRIVGVGAGAWGSVFCALLQDAYGHLRDKAQVRIWRRPGRAVDRATAQHLFDVINAREDVLRRLIRRCAYLKYVEARLGDRTLYADEILRDGFCLNMVDTPLCPLKVVTNLQEAVWDADIVVNGVPSTDTREVFGEIGRYWKERITAPIIISLAKGIEASLDPLPRIITPTQMISNATGVPMENILYLGGPNIASEIYNKEYANARICGADKWRKPLAKFLRQPHFIVWDNSDLITHEVMGGLKNVYAIGAGMVAALTNESATSKSVYFALCTSEMIYITHILEEEPEKLAGPLLADTYVTLLKGRNAWYGQKLAKGELTLEMGDSIKGKGTIQGVSAVEAFYELLSQDSLSVMHPEANRSVAPVEMCPILKALHRILITRDRPADSILQAIRDETMYDPRERIEMAHGHSLYRPSLLGQPKDVKT

SEQ ID NO: 18575 - protein, 464 aa, Hordeum vulgare
MGGAEDGTHASNGHANGAVEDKVDELRRLMGKADGDPLRIVGVGAGAWGSVFCALLQDAYGHLRDKVQLRIWRRPGRAVDRATAEHLFNVINAREDVLRRLIRRCAYLKYVEGRLGDRTLYADEILRDGFCLNMIDTPLCPLKVVTNLQEAVWNADIVINGLPSTETRGVFGEIGRYWKERVNAPVIISLTKGIEASVDPVPRIITPTQMICNATKVPLDNVLYLGGPNIASEIYNKEYANARICGTDKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGHRLAKGELTLEMGDSIKGKGTIQGVSAVDAFYNLLSQDSLSVMHPEANKSVAPVEMCPILKTLYKILIKRELPTESILQAIRDESMCDPRERIEMARGQSLYRPSILGQPNGDVKA

SEQ ID NO: 18576 - protein, 469 aa, Secale cereale
MGGAEDGAHAAGGHASNGHANGAVEDKVDELRRLMGKADGDPLRIVGVGAGAWGSVFCALLQDAYGHLRDKVQLRIWRRPGRAVDRATAEHLFDVINAREDVLRRLIRRCAYLKYVEARLGDRTLYADEILRDGFCLNMIDTPLCPLKVVTNLQEAVWNADIVINGLPSTETRDVFGEIGRYWKERVNAPVIISLTKGIEASLDPVPRIITPTQMISNATKVPLDNILYLGGPNIASEIYNKEYANARICGTNKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGHRLAKGELTLEMGDSIKGKGTIQGVSAVDAFYKLLSQDSLSVMHPEANKSVAPVEMCPILKTLYKILIKRELPTESILQAIRDESMCDPRERIEMARGQSLYRPSILGLPNGDVKA

SEQ ID NO: 18577 - protein, 469 aa, Triticum aestivum
MGGAEDGAHAAGGHASNGHANGAVEEKVDELRRVMGKADGDPLRIVGVGAGAWGSVFCALLQDAYGHLRDKVQLRIWRRPGRAVDRATAEHLFNVINAREDVLRRLIRRCAYLKYVEGRLGDRTLYADEILRDGFCLNMIDTPLCPLKVVTNLQEAVWDADIVINGLPSTETRVVFGEIGRYWKERVNAPVIISLTKGIEASLDPVPRIITPTQMISKATKVPLDNILYLGGPNIASEIYNKEYANARICGTDKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGHKLAKGELTLEMGDSIKGKGTIQGVSAVDAFYKLLSQDSLSVMHPEANKSVAPVEMCPILKTLHKILIKRELPTESILQAIRDESMCDPRERIEMARGQSLYRPSILGQPNGDVKA

SEQ ID NO: 18578 - protein, 463 aa, Cocos nucifera
MVGSVVGVHSSPHSNGSVHHSNGAEDKLDELRRLLGKSEGDPLKIVGVGAGAWGSVFVALLQDAYGHFRDKVQIRIWRRPGRPVDRCTAEHLFEVINSREDVLRRLIRRCAYLKYVEGRLGDRTLYADEILRDGFCLNMIDTPLCPLKVVTNLQEAVWDADIVVNGLPSTETREVFEEIGRYWEERTRDPVIISLAKGIEAALDPVPHIITPTQMISHATGVPIENILYLGGPNIASEIYNKEYANARICGAVKWRKPLAQFLRQPHFIVWDNSDLITHEVMGGLKNVYAIGAGMVAALTNESATSKSVYFAHCTSEMIFITHLLAEEPEKLAGPLLADTYVTLLKGRNAWYGQMLAKGELSLDMGDSIKGKGTIQGVSAVDAFYELLSQSSLSVLHPEENKPVAPVELCPFLKTLYKILIKRELLTPAILQALRDETMYDPRDRIEMAQSHALYRPSLLGQP

SEQ ID NO: 18579 - protein, 463 aa, Ananas comosus
MVSTVEGVHSSPYANGSSHHSNGVEEKLDELRRLLGKSEGDLLKIVGVGAGAWGSVFAALLQDAYGHLREKVQIRIWRRPGRPVDRATAEHLFEVINSREDVLRRLIRRCAYLKYVEARLGDRTLYADEILRDGFCLNMIDTPLCQLKVVTNLQEAVWDADIVINGLPSTETREVFEEIGKYWKERITVPIIISLAKGIEASLDPVPRIITPTEMINRATGIPIENILYLGGPNIASEIYNKEYANARICGAEKWRKPLAKFLRQPHFIVWDNSDLVTHEVMGGLKNVYAIGAGMVAALTNESATSKSVYFAHCTSEMIFITHLLAEEPEKLAGPLLADTYVTLLKGRNAWYGQMLAKGELSLDMGDSIKGKGTIQGVSAVNAFYELLSQTSLSVLHPEAKKHVAPVELCPILKTLYKILIKRDLSTASILQALRDESMYDPRDRIEMAQSHALYRPSLLGQP

SEQ ID NO: 18580 - protein, 463 aa, Elaeis guineensis
MVGSIVGVHSSPHSNGSVHYSNGAEEKLDELHRLLGKSEGDPLKIVGVGAGAWGSVFVALLQDAYGHFRDKVQIRIWRRPGRPVDRSTAEHLFEVINSREDVLRRLIRRCAYLKYVEGRLGDRTLYADEILRDGFCLNMIDTPLCPLKVVTNLQEAVWDADIVVNGLPSTDTRVVFEEIGRYWKERTRDPVIISLAKGIEAALDPVPHIITPTQMISHATGVPIENILYLGGPNIASEIYNKEYANARICGAVKWRKPLAKFLRQPHFIVWDNSDLITHEVMGGLKNVYAIGAGMVAALTSESATSKSVYFAHCTSEMIFITHLLAEEPEKLAGPLLADTYVTLLKGRNAWYGQMLAKGELSLDMGDSIKGKGTIQGVSAVDAFYELLSQSSLSVLHPEENKPVAPVELCPILKTLYKILIKRELLTPAILQALRDETMYDPRDRIEMAQSHALYRPSLLGQP

SEQ ID NO: 18581 - protein, 456 aa, Oryza sativa
MVGSVHVNGSVNGGNGTEERLDELRRLLGKSDGDLLKIVGIGAGAWGSVFAALLQDAYGRFREKVQIRIWRRAGRSVDRTTAEHLFEVINSREDVLRRLIRRCAYLKYVEARLGDRTLYADEILRDGFCLNMIDTPLCPLKVVTNLQEAVWDADIVVNGLPSTETREVFEEISKYWKERISVPVIISLAKGIEASLDPIPRIITPTQMISSATGVPTENILYLGGPNIASEIYNKEYANARICGSNKWRKPLAKFLRQPHFIVWDNSDLVTHEVMGGLKNVYAIGAGMVAALTNESATSKSVYFAHCTSEMIFITHLLTEQPEKLAGPLLADTYVTLLKGRNAWYGQMLAKGELSPDMGDSIKGKGMIQGISAVGAFFELLSQPSLSVQHPEENKQVAPAELCPILKRLYRILIKRELSTRDILQALRDETMNDPRERIEMAQSHAFYRPSLLGKP

SEQ ID NO: 18582 - protein, 456 aa, Brachypodium distachyon
MVGSVHVNGSLNGANGTEERLDELRRLLGKSEGDLLKIVSVGAGAWGSVFAALLQDAYGHFREKVQIRVWRRPGRAVDRSTAEHLFEVINSREDVLRRLIRRCAYLKYVEARLGDRTLYADEILRDGLCLNMVDTPLCPLKVVTNLQEAVWDADIVVNGLPSTETREVFEEISKYWKERIAVPVIISLAKGIEASLGPIPRIVTPTQMISSATGVPTENILYLGGPNIASEIYNKEYANARICGSNKWRKPLAKFLRQPHFIVWDNSDLITHEVMGGLKNVYAIGAGMVAALTNESATSKSVYFAHCTSEMIFITHLLTEQPEKLAGPLLADTYVTLLKGRNAWYGQMLAKGELSPDMGDSIKGKGMIQGISAVGAFFELLSQPSLSVQHPEENKQVAPAELCPILKRLYRILIKRELPVRDILQALRDETMNDPRERIEMAQSHAFYRPSLLGKP

SEQ ID NO: 18583 - protein, 456 aa, Triticum aestivum
MVGSVHVNGSVNGANGTEERLDELRRLLGKSDGDLLKIVSIGAGAWGSVFAALLQDAYGHFREKVQIRVWRRPGRAVDRSTAEHLFDVINSREDVLRRLIRRCAYLKYVEARLGDRTLYADEILRDGFCLNMVDTPLCPLKVVTNLQEAVWDADIVVNGLPSTETREVFEELSKYWKERISVPVIISLAKGIEASLDPIPRIITPTQMISSAAGVPTENILYLGGPNIASEIYNKEYANARICGSTKWRKPLAKFLRQPHFIVWDNSDLVTHEVMGGLKNVYAIGAGMVAALTNESATSKSVYFAHCTSEMIFITHLLTEQPEKLAGPLLADTYVTLLKGRNAWYGQMLAKGELRLDMGDSIKGKGMIQGISAVGAFFELLSQPSLSVLHPEENKQVAPAELCPILKRLYRILIKRELPVGDILQALRDETMNDPRERIEMAQSHAFYRPSLLGKP

SEQ ID NO: 18584 - protein, 464 aa, Cocos nucifera
MVGSVEGTHRSPSHSNGPVHYSNGVEEKLDELRRLLGKSEGDLLKIVGIGAGAWGSAFAALLQDAYGHFRDKVQIRIWRRPGRSVDRSTAEHLFEVINSREDVLRRLIQRCAYLKYVEARLGDRTLFADEILRDGFCLNMIDTPLCPLKVVTNLQEAVWDADIVVNGLPSTETREVFEEIGRYWKERIRVPIIISLAKGIEAALDQVPRIITPTQMISHATGVSIENILYLGGPNIASEIYNKEYANARICGPDKWRKPLAKFLRQPHFIVWDNSDLVTHEVMGGLKNVYAIGAGMVAALTNESATSKSVYFAHCTSEMIFITHLLAEEPEKLAGPLLADTYVTLLKGRNAWYGQMLAKGELSVDMGDSIKGKGTIQGVSAVDAFYELLSESSLSVLHPEENKPVAPVELCPILKTLYKILIKRELPTKAILQALRDETMYDPRERIEMGQSHVLYRPSLLGQP

SEQ ID NO: 18585 - protein, 456 aa, Hordeum vulgare
MVGSVHVNGSANGANGTEERLDELRRLLGKSDGDLLKIVSIGAGAWGSVFAALLQDAYGHFREKVQIRVWRRPGRAVDRSTAEHLFDVINSREDVLRRLIRRCAYLKYVEARLGDRTLYADEILRDGFCLNMVDTPLCPLKVVTNLQEAVWDADIVVNGLPSTETREVFDELSKYWKERISVPVIISLAKGIEASLDPIPRIITPTQMISSAAGVPTENILYLGGPNIASEIYNKEYANARICGSTKWRKPLAKFLRQPHFIVWDNSDIVTHEVMGGLKNVYAIGAGMVAALTNESATSKSVYFAHCTSEMIFITHLLTEQPEKLAGPLLADTYVTLLKGRNAWYGQMLAKGELRLDMGDSIKGKGMIQGISAVGAFFELLSQPSLSVLHPEENKQVAPAELCPILKRLYRILIKRELPVRDILQALRDETMNDPRERIEMAQSHTFYRPSLLGKP

SEQ ID NO: 18586 - protein, 456 aa, Triticum aestivum
MVGSVHVNGAVNGANGTEERLDELRRLLGKSDGDLLKIVSIGAGAWGSVFAALLQDAYGHFREKVQIRVWRRQGRAVDRSTAEHLFDVINSREDVLRRLIRRCAYLKYVEARLGDRTLYADEILRDGFCLNMVDTPLCPLKVVTNLQEAVWDADIVVNGLPSTETREVFEELSKYWKERISVPVIISLAKGIEASLDPIPRIITPTQMISSAAGVPTENILYLGGPNIASEIYNKEYANARICGSTKWRKTLAKFLRQPHFIVWDNSDIVTHEVMGGLKNVYAIGAGMVAALTNESATSKSVYFAHCTSEMIFITHLLTEQPEKLAGPLLADTYVTLLKGRNAWYGQMLAKGELRLDMGDSIKGKGMIQGISAVGAFFELLSQPSLSVLHPEENKQVAPAELCPILKRLYRILIKRELPVGDILQALRDETMNDPRERIEMAQSHTFYRPSLLGKP

SEQ ID NO: 18587 - protein, 464 aa, Amborella trichopoda
MVSSKESSPNSIHSNGGIPHLNGVEEKLDELRLLLGKSEGDVLRIVGVGAGAWGSVFAALMQDAYGHLRDKIQVRIWRRAGRSVDRATAEHLFEVINSREDVLRRLIRRCAYLKYVEARLGDRTLYADEILKDGFCLNMIDTPLCPLKVVTNLQEAVWDADIVVNGLPSTETREVFQEISRYWKERLTPPIIISLSKGIEAALEPVPHIITPTQMINRATGVPMENILYLGGPNIASEIYNKEYANARICGADKWRKPLAKFLRQPHFIVWDNSDLITHEVMGGLKNVYAIGAGMVAALTNESATSKSVYFAHCTSEMIFITHLLAEEPEKLAGPLLADTYVTLLKGRNAWYGQMLAKGELRPDMGDSIKGKGMIQGVSAVGAFYELLSQSCLSVLHPEGKTPVAPVELCPILKTLYKILISREISTEGILQALRDETMNDPRDRIEIAQSHAFYRPSLLGQPK

SEQ ID NO: 18588 - protein, 458 aa, Sorghum bicolor
MVGSVHVNGSVHGGNGTATEERLDELRRLLGKSEGDLLKIVSVGAGAWGSVFAALLQDAYGHFRDKVQIRIWRRPGRTVDRSTAEHLFEVINSREDVLRRLIRRCAYLKYVEARLGDRTLYADEILKDGFCLNMIETPLCPLKVVTNLQEAVWDADIVVNGVPSTETREVFDEISKYWKERISVPVIISLAKGIEASLDPIPRIITPTQMISSAAGVPTENILYLGGPNIASEIYNKEYANARICGSNKWRKPLAKFLRQPHFIVWDNSDLVTHEVMGGLKNVYAIGAGMVAALTNESATSKSVYFSHCTSEMIFITHLLTEQPEKLAGPLLADTYVTLLKGRNAWYGQMLAKGELSPDMGDSIKGKGMIQGVSAVGAFFELLSQPSLSVQHPEENKLVAPAELCPILKRLYRILIKRELPARDILQALRDETMNDPRERIEMAQSHAFYRPSLLGKP

SEQ ID NO: 18589 - protein, 463 aa, Musa acuminata
MVGTVEINHSSVNSNGSRHNSNGAEERLDELRRLLGKTDGDLLKIVGVGAGAWGSVFAALLQDAYGHLRDKVQIRIWRRPGRSVDRSTAEHLFEVINSREDVLRRLIRRCAYLKYVEARLGDRTLYADEILRDGFCLNMIDTPLCPLKVVTNLQEAVWDADIVVNGLPSTETREVFEDISRYWKERITVPIIISLAKGIEAALDPVPRIVTPTQMIKCATGVPIENILYLGGPNIASEIYNKEYANARICGAEKWRKPLAKFLRQPHFIVWDNSDLVTHEVMGGLKNVYAIGAGMVAALTNESATSKSVYFAHCTSEMIFITHLLAEQPEKLAGPLLADTYVTLLKGRNAWYGQMLAKGELSLDMGDSIKGKGMIQGVSAVGAFYELLSQSSLSVLHPEEKKPVAPAELCPILKTLYKILIRRECPSQAILQALQDETMNDPRERIEIAQSQAFYRPSLLGQR

SEQ ID NO: 18590 - protein, 456 aa, Pennisetum glaucum
MVGSVHTNGSVHGANGTEERLDELRRLLGKSDGDLLKIVSVGAGAWGSVFAALLQDAYGHFREKVQIRIWRRPGRTVDRSTAEHLFEVINSREDVLRRLIRRCAYLKYVEARLGDRTLYADEILKDGFCLNMIETPLCPMKVVTNLQEAVWDADIVVNGVPSTETREVFEEISEYWKERISVPVIISLAKGIEASLDPIPRIITPTQMISSATGVPTENILYLGGPNIASEIYNKEYANARICGSNKWRKPLAKFLRQPHFIVWDNSDLVTHEVMGGLKNVYAIGAGMVAALTNESATSKSVYFAHCTSEMIFITHLLTEQPEKLAGPLLADTYVTLLKGRNAWYGQMLAKGELSPDMGDSIKGKGMIQGISAVGAFFELLSQPSLSVQHPEENKQVAPAELCPILKRLYRILIKRELPARDILQALRDETMNDPRERIEMAQSHAFYRPSLLGKP

SEQ ID NO: 18591 - protein, 456 aa, Populus trichocarpa
MVGSIKAVNHHNNGCGLEEKLDELRSLLGKADGDPLRIVGVGAGAWGSVFAALLQDSYGQFREKVQIRIWRRPGRAVDRATAEHLFEVINSREDVLRRLIWRCAYLKYVEARLGDRTLFADEILKDGFCLNMIDTPLCPLKVVTNLQEAVWDADIVVNGLPSTETREVFEEISQYWKERITAPIIISLAKGIEAALKPVPRIITPTQMINRATGVPMENILYLGGPNIASEIYNKEYANARICGADKWRKPLAKFLRQPHFIVWDNSDLVTHEVMGGLKNVYAIGAGMVAALTNESATSKSVYFAHCTSEMIFITHLLAEEPEKLAGPLLADTYVTLLKGRNAWYGQMLAKGEISRDMGDSISGKGMIQGVSAVGAFYELLSQSSLSVLHPDEKKPVAPVELCPILKTLYKILIIREQSSQAILQALRDETLNDPRERIEIAQSHAFYRPSLLGQP

SEQ ID NO: 18592 - protein, 458 aa, Zea mays
MVGSVHVNGSVHGGNGTATEERLDELRRLLGKSEGDLLKIVSVGAGAWGSVFAALLQDAYGHFRDKVQIRIWRRPGRTVDRSTAEHLFEVINSREDVLRRLIRRCAYLKYVEARLGDRTLYADEILKDGFCLNMIETPLCPLKVVTNLQEAVWDADIVVNGVPSTETREVFDEISEYWKERISVPVIISLAKGIEASLDPIPRIITPTQMISSATGVPTENILYLGGPNIASEIYNKEYANARICGSNKWRKPLAKFLRQPHFIVWDNSDLVTHEVMGGLKNVYAIGAGMVAALTNESATSKSVYFAHCTSEMIFITHLLTEQPEKLAGPLLADTYVTLLKGRNAWYGQMLAKGELSPDMGDSIKGKGMIQGISAVGAFFELLSQPSLSVQHPEENKQVAPAELCPILKRLYRILIKRELPARDILQALRDETMNDPRERIEMAQSHAFYRPSLLGKP

SEQ ID NO: 18593 - protein, 456 aa, Setaria italica
MVGSVHMNGSVHGANGTEERLDELRRLLGKSEGDLLKIVSVGAGAWGSVFAALLQDAYGHFREKVQIRIWRRPGRTVDRSTAEHLFEVINSREDVLRRLIRRCAYLKYVEARLGDRTLYADEILKDGFCLNMIETPLCPLKVVTNLQEAVWDADIVVNGVPSTETREVFEEISKYWKERISVPVIISLAKGIEASLDPIPHIITPTQMISSATGVPTENILYLGGPNIASEIYNKEYANARICGSNKWRKPLAKFLRQPHFIVWDNSDLVTHEVMGGLKNVYAIGAGMVAALTNESATSKSVYFAHCTSEMIFITHLLTEQPEKLAGPLLADTYVTLLKGRNAWYGQMLAKGELSPDMGDSIKGKGMIQGISAVGAFFELLSQPSLSVQHPEENKQVAPAELCPILKRLYRILIKRELPARDILQALRDETMNDPRERIEMAQSHAFYRPSLLGKP

SEQ ID NO: 18594 - protein, 464 aa, Musa acuminata
MVGSVDGTRGSSHSNGPVSCSNGAEERLDELRRLLGKSEGDLLKIVGVGAGAWGSVFAALLQDAYGQFREKVQIRIWRRPGRPVDRSTAEHLFEVINSREDVLRRLIRRCAYLKYVEARLGDRTLYADEILRDGFCLNMIDTPICPLKVVTNLQEAVWDADIVVNGLPSTETREVFGEISRYWKERIGAPIIISLAKGIEAALDPVPRIITPTQMINHATGVPIENILYVGGPNIASEIYNKEYANARICGAEKWRKPLAKFLRQPHFIVWDNSDLVTHEVMGGLKNVYAIGAGMIAALTNESATSKSVYFAHCTSEMIFITHLLAEDPEKLAGPLLADTYVTLLKGRNAWYGQMLAKGEISLDMGDSIKGKGTIQGVSAVHAFYELLSQPSLSVLDPEEQKHVAPVELCPIMKTLHKILIKRELRTNAILQALRDETMNDPRDRIELAQSHAFYRPSLLGHDH

SEQ ID NO: 18595 - protein, 469 aa, Populus trichocarpa
MVGSIKTMNHHGNGWSAQNCNGLEEKLDELRSLLGKTDGDPLRIVGVGAGAWGSVFAALLQDSYGRFREKVQIRIWRRPGRAVDRVTAEHLFEVINSREDVLRRLIRRCAYLKYVEARLGDRTLFADEILKDGFCLNMIDVPLCPLKVVTNLQEAVWDADIVVNAVPSTETREVFEEISQYWKERITTPIIISLAKGIEAALEPVPHIITPTQMINRATGVPTQNILYLGGPNIASEIYNKEYANARICGADKWRKPLAKFLRQPHFIVWDNSDLVTHEVMGGLKNVYAIGAGMVAALTNESATSKSVYFAHCTSEMIFITHLLAEEPEKLAGPLLADTYVTLLKGRNAWYGQMLAKGEISRDIGDNISGKGMIQGVSAVGAFYELLSQSSLSVLHPDEKKPVAPVELCPILKTLYKILIIREQSSQAILQALRDETLNDPRERIEIAQSHAFYRPSLLGQPLATLHCQ

SEQ ID NO: 18596 - protein, 455 aa, Citrullus lanatus
MSPSHSNGSTHNCNGLEEKLDELRRLIGKSDGDPLRIVGVGAGAWGSVFAALLQDSYGQFREKVQIRIWRRAGRVVDKATAEHLFEVINSREDVLRRLIRRCAYLKYVEARLGDRVLYADEILKDGFCLNMIDTPLCPLKVVTNLQEAVWDADIVVNGLPSTETREIFEEISKYWKERITVPIIISLAKGIEAALQPVPHIITPTLMINRATGVPIENILYLGGPNIASEIYNKEYANARICGAEKWRKPLANFLRQPQFIVWDNSDLVTHEVMGGLKNVYAIGAGMVAALTNESATSKSVYFAHCTSEMIFITYLLAEEPEKLAGPLLADTYVTLLKGRNAWYGQMLAKGELSLDMGDSISGKGMIQGVSAVSAFYEILSQSSLNVLHPEDNKPVAPVQLCPILKTLYKILIKRDGSPQAILEALRDETLNDPRDRIELAQSHAFYRPSLLGQP

SEQ ID NO: 18597 - protein, 341 aa, Zea mays
MPTAEATTPVPPELSSGQGRTVCVTGAGGFIASWLVKRLLEKGYTVRGTVRNPVDPKNDHLRSLDGADDRLVLLRADLLDPESLAEAFSGCDGVFHAASPVTDDPEMMIEPAIRGTRYVMAAAADAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKHDHA

SEQ ID NO: 18598 - protein, 341 aa, Setaria italica
MPTETPMPALSGHGRTVCVTGAGGFIASWLVKRLLEKGYTVRGTVRNPVDPKNDHLRALEGATDRLVLLRADLLDPDSLLAAFSGCEGVFHAASPVTDDPEKMIEPAILGTRYVITAAADTGVKRVVFTSSIGTVYMNPYRDPNKLVDDTCWSDLEYCKKTKNWYCYAKTVAEQGAWEVARMRGLDLIVVNPVLVLGPLLQPTVNASTDHVMKYLTGSAKTYVNAAQAYVHVMDVAEAHVRVYEAPGAHGRYICAESTLHRGELCRILAKLFPEYPIPTKCKDEVNPPVIGYKFTNQRLKDLGMEFVPVLQCLYETVKSLQEKGMLPVLPPNDQDQQLITS

SEQ ID NO: 18599 - protein, 341 aa, Echinochloa colona
MPVETPMPALSGHGRTVCVTGAGGFIASWLVKRLLEKGYTVRGTVRNPVDPKNDHLRALEGAADRLVLLRADLLDPDSLLAAFSGCEGVFHAASPVTDDPEKMIEPAIRGTRYVITAAADTGVKRVVFTSSIGTVYMNPYRDPSKPVDDTCWSDLEYCKKTENWYCYAKTVAEQGAWEVARKRGLDLIVVNPVLVLGPLLQPTVNASTDHVMKYLTGSAKTYVNAAQAYVHVKDVAEAHVRVYEAPDAHGRYICAESTLHRGDLCRILAKLFPEYPIPTRCKDEVNPPVIGYKFTNQRLKELGMEFVPVLQCLYETVKSLQEKGMLPVLPPNEQDQRLIAS

SEQ ID NO: 18600 - protein, 341 aa, Echinochloa colona
MPVETPMPALSGHGRMVCVTGAGGFIASWLVKRLLEKGYTVRGTVRNPVDPKNDHLRALEGAADRLVLLRADLLDPDSLLAAFSGCEGVFHAASPVTDDPEKMIEPAIRGTRYVITAAADAGVKRVVFTSSIGTVYMNPYRDPSKPVDDTCWSDLEYCKKTENWYCYAKTVAEQGAWEVARKRGLDLIVVNPVLVLGPLLQPTVNASTDHVMKYLTGSAKTYVNAAQAYVHVKDVAEAHVRVYEAPDAHGRYICAESTLHRGDLCRILTKLFPEYPIPTKCKDEVNPPVIGYKFTNQRLKGLGMEFVPVLQCLYETVKSLQEKGMLPVLPPNEQDQRLIAS

SEQ ID NO: 18601 - protein, 343 aa, Panicum virgatum
MPIETPMPALSGHGLTVCVTGAGGFIASWLVKRLLEKGYTVRGTVRNPVDPKNDHLRALEGAADRLTLVRADLLEPDSLLAAFSGCEGVFHAASPVTDDPEKMIEPAIRGTRHVMTVAADTGVKRVVFTSSIGTVYMNPYRDPNEPVDDTCWSDLEYCKKTENWYCYAKTVAEQGAWEVARKRGLDLVVVNPVLVLGPLLQPTVNASTDHVMKYLTGSAKTYVNAAQAYVHVKDVAEAHVRVYEAAHAHGRYICAESTLHRGELCRILAKLFPEYPIPTKCKDEVNPPVAGYKFSNQRLKDLGIEFVPVLQCLYETVKSLQEKGMLPVLPPNDDHHPDQLMTS

SEQ ID NO: 18602 - protein, 347 aa, Oryza sativa
MPTDETTAAAPATTALSGHGRTVCVTGAGGFIASWLVKRLLEKGYTVRGTVRNPMDPKNDHLRALDGAGERLVLLRADLLEPDSLVAAFTGCEGVFHAASPVTDDPEKMIEPAIRGTRYVITAAADTGIKRVVFTSSIGTVYMNPYRDPNKPVDDTCWSDLEYCKRTENWYCYAKTVAEQGAWEVARRRGVDLVVVNPVLVLGPLLQATVNASTEHVMKYLTGSAKTYVNAAQAYVHVRDVAEAHVRVYECGGARGRYICAESTLHRGDLCRALAKLFPEYPVPSRCKDEAAPPVKGYLFSNQRLRDLGMDFVPVRQCLYETVRSLQDKGLLPVLPPTADDHHHPSS

SEQ ID NO: 18603 - protein, 347 aa, Oryza sativa
MPTDETAAAAPATTALSGHGCTVCVTGAGGFIASWLVKRLLEKGYTVRGTVRNPMDPKNDHLRALDGAGERLVLLRADLLDPDSLVAAFTGCEGVFHAASPVTDDPEKMIEPAIRGTRYVITAAADTGIKRVVFTSSIGTVYMNPYRDPNKPVDDTCWSDLEYCKRTENWYCYAKTVAEQGAWEVARRRGVDLVVVNPVLVLGPLLQATVNASTEHVMKYLTGSAKTYVNAAQAYVHVRDVAEAHVRVYDCGGARGRYICAESTLHRGDLCRALAKLFPEYPVPSRCKDEAAPPVKGYLFSNQRLRDLGMDFVPVRQCLYETVRSLQDKGLLPVLPPTADDHHHPSS

SEQ ID NO: 18604 - protein, 357 aa, Triticum aestivum
MPIEAADNVPAELPGHGRTVCVTGAGGFIASWLVKRLLQKGYTVRGTVRNPVDPKNDHLRAFDGAADRLVLLRADLMEPETLVEAFTGCEGIFHAASPVTDDPEKMIEPAIRGTKYVITAAADMGIKRVVFTSTIGTVYMNPNRDPSKPVDDTCWSDLEYCKKTANWYCYAKTVAEQDALETARQRGIELIVVNPVLVLGPLLQPTVNASTEHVMKYLTGSAKTYVNAAQAYVHVKDVAEAHVRVYEAPGAHGRYICAEGTTLHRGELCRVLGKLFPEYPVPTKCKDEVNPPVKGYKFTNQRLKDLGMEFVPVLQSIYETVKSLQEKGMLPVLPPGDDVRDNLHEQLMMKPAQLLRN

SEQ ID NO: 18605 - protein, 358 aa, Hordeum vulgare
MPIETTDNVPAADLPGHGRTVCVTGAGGFIASWLVKRLLQKGYTVRGTVRNPVDPKNDHLRAFDGAADRLVLLRADLMEPETLVEAFTGCEGIFHAASPVTDDPEKMIEPAIRGTKYVITAAADMGIKRVVFTSTIGTVYMNPHRDPSKPVDDTCWSDLDYCKKTANWYCYAKTVAEQDALETARQRGIELVVVNPVLVLGPLLQPTVNASTEHVMKYLTGSAKTYVNAAQAYVHVKDVAEAHVRVYEAPDAHGRYICAEGTTLHRGELCRVLGKLFPEYPVPTKCKDEVNPPVKGYKFTNQRLKDLGMEFVPVLQSIYETVKSLQEKGMLPVLPPSDDVRDNMHEQLIMKPAQLLRN

SEQ ID NO: 18606 - protein, 357 aa, Secale cereale
MPIEAADNVPADLPGHGRTVCVTGAGGFIASWLVKRLLQKGYTVRGTVRNPVDPKNDHLRAFDGAADRLVLLRADLMEPETLVEAFTGCEGIFHAASPVTDDPEKMIEPAIRGTKYVITAAADMGIKRVVFTSTIGTVYMNPHRDPSKPVDDTCWSDLDYCKKTANWYCYAKTVAEQDALETARQRGIELIVVNPVLVLGPLLQPTVNASTEHVMKYLTGSAKTYVNAAQAYVHVKDVAEAHVRVYEAPGAHGRYICAEGTTLHRGELCRVLGKLFPEYPVPTKCKDEVNPPVKGYKFTNQRLKDLGMEFVPVLQSIYETVKSLQEKGMLPVLPPSDDVRDNMHEQLMLKPAQLLRN

SEQ ID NO: 18607 - protein, 357 aa, Brachypodium distachyon
MPMIETTTTGGDVPPVPEAAASLPGHGRTVCVTGAGGFIASWLVKRLLQKGYTVRGTVRNPVDPKNDHLRALEGAAERLVLVRADLLDPESLVAAFQGCEGVFHAASPVTDDPEKMIEPAIRGTRYVLSAAADMGIKRVVFTSTIGTVYMNPYRDADKPVDDTCWSDLDYCKKTANWYCYAKTVAEQAAWELAEQRGVSLLVVNPVLVLGPLLQPTVNASAEHVMKYLTGSAKTYANAAQAYVHVRDVAEAHVRVYERPTARGRYICAEGTTLHRGELCRVLAKLFPEYPVPTECKDRVNPPVKGYRFTNQRLKDLGMEFVPVLQSIYETVRSLQEKGLLPVLPTTTNNNDNNLLLS

SEQ ID NO: 18608 - protein, 356 aa, Avena sativa
MPIESTDSVPAADLPGHGRTVCVTGAGGFIASWLVKRLLQKGYTVRGTVRNPVDPKNDHLRAFDGAADRLVLLRADLMEPESLAAAFAGCEGIFHAASPVTDDPEKMIEPAIRGTNYVLTAAADLGIKRVVFTSTIGTVYMNPYRDAEKPVDDTCWSDLEYCKKTENWYCYAKTVAEQDAFASARQRGIELIVVNPVLVLGPLLQPTVNASAEHVLKYLTGSAKTYVNAAQAYVHVKDVAEAHVRVYEAPAARGRYICAEGTTLHRGELCRVLAKLFPEYPVPTRCKDEVNPPVKGYKFTNQRLKDLGMEFVPVLQSIYETVKSLQEKGMLPVLPEHHHDEDDVVVQDNDALLVRS

SEQ ID NO: 18609 - protein, 793 aa, Setaria italica
MGSSGCSSEIVESTEEEFDSAPIGGSSLLHIKLRDEEKRSKCHDYPVEDDLDQLLKAIDSRTFRRALSPGSTGGDALGKGVLKKPARSGLSQNAGIGISSKTVNMKQALRRLCISQASEMAAMKRLSMSPGSSSSSEAGTIHRLYASLMVQSSTEGLLHDDEKMNLIEISLTPEKIDKSSSRGTSEFSEDCEFETADGSAVTSIRSVSSTSAEVRKIRIQDVISGDPIDSESSLVENGKLGSKISAATDDGSPRVPILSKPITTSRLVKPVFRCKTAGKKKVKEEPSSLGDSSNSTKFCSSKESISLASTSCSSTSSVTNPTSCAEEEKSTPGPEKSDETSSEWLGAEEKGECSQNSKSSISEYGCSTSISDESQFGLCGYSNRPHMAKDLRWLTIRQLALQQGSLGLDNFKLLKRLGCGDIGTVYLAELVDSDCLFALKVMDIEYLINRKKMLRAQAEREILEMLDHPFLPTLYAHFTTDNLSCLVMEYCPGGDLHVLRQRQPGRSFPEPAARFYVAEVLLALEYLHMLGVIYRDLKPENILVREDGHIMLSDFDLSLRCSVNPVLLRSSSVTANHQPRKLAGPCAENYCINSSCLQQPSCAQTSCFTPRLPSIPKPRKPKSSQKRLPQLVVEPIDARSNSFVGTHEYLAPEIIKGDGHGSAVDWWTFGVFLYELLYGKTPFRGPGNDETLANVVSQNLRFPDNPAVSSNAKDLIRGLLVKEPENRLGSLRGAAEIKQHPFFEGLNWALIRSAAPPETQPCNVVTLAKERKKKEGKCLEFRSNSEDLEFEVF

SEQ ID NO: 18610 - protein, 790 aa, Zea mays
MESSGCSSEIVESTEEFDTTPSGGSSLLHIKLKDEEKRGKSHDYSVEDDLDQLLKAIDSRTFRRALSPGSTGGDALGKSVLKKPARSGLSQNAGIGISSKAVNMKQALRRLCISQASEMAAMKRLSMSPGSSSSSEAGTIHRLYASLMVQSSSEGLLHDDEKMNLIEVSITPEKIDKSSSRGTSEFSEDCEFETADGSAVTSTSICSASSTYTDIRKIRIQDVIIGDPMDNESSLGENGNLGNKFSAATDDGSPKVPILSKPITTSRLVKPVFRCKPSGKKKVKQEPSSLGDSSNSTKFCSSKESISLTSTSCSSTSSFTNPANRAEEKSSPGPEKSDGTSSEWLAEQNECSQNSKSSISEYGCSTSISGESQFGLCGYSNRPHMAKDLRWLTIRQLALQQGSLGLDNFKLLKRLGCGDIGTVYLAELVDSDCLFALKVMDIEYLINRKKMLRAQAEREILEMLDHPFLPTLYAHFTTDNLSCLVMEYCPGGDLHVLRQRQPGKSFPEPAARFYVAEVLLALEYLHMLGVIYRDLKPENILVREDGHIMLSDFDLSLRCSVNPVLLRSSSVTANHQPRKHTGPCAENYCINSSCLQQPSCAQTSCFTPRLPSIPKPRKPKSSQKRLPQLVVEPTDARSNSFVGTHEYLAPEIIKGDGHGSAVDWWTFGVFLYELLYGKTPFRGPGNDETLANVVSQNLRFPDHPAVSSNTKDLIRGLLVKEPENRFGSLRGAAEIKQHPFFEGLNWALIRSAAPPETQPCNIVTLAKERKKEGKCLEFRSNSEDLEFEVF

SEQ ID NO: 18611 - protein, 793 aa, Panicum virgatum
MGSSGCSSEIVESIEEEFDSAPIGGSSLLHIKLRDEEKRSKCHDYPVEDDLDQLLKAIDSRTFRRALSPASTGGDALGKSVLKKPARSGLSQNAGIGISSKTVNMKQALRRLCISQASEMAAMKRLSMSPGSSSSSEAGTIHRLYASLMVQSSTEGLLHDDEKMNLIEISITPEKMDKSSSRGMSEFSEDCEFETADGSAVTSVRSVSSTSAEIRKIRIQDVISGDPIDNESSLVESDKLGSKVSAATADGSPRVPILSKPITTSRLVKPVFRCKTAVKKKLKEEPSSLGDSSNSTKFCSSKESISLASTSCSSTSSITNPTSYAEEEKSTPGPEKSDETSSEWLGAEEKGECSQNSKSSISEYGCSTSISDESQFGLCGYNNRPHMAKDLRWLTIRQLALQQGSLGLDNFKLLKRLGCGDIGTVYLAELVDSDCLFALKVMDIEYLINRKKMLRAQAEREILEILDHPFLPTLYAHFTTDNLSCLVMEYCPGGDLHVLRQKQPGRSFPEPAARFYVAEVLLALEYLHMLGVIYRDLKPENILVREDGHIMLSDFDLSLRCSVNPVLLRSSSVEANHQPRKLAGPCAEKYCINSSCLQQPSCAQTSCFTPRLPSIPKPRKPKSSQKRLPQLVVEPIDARSNSFVGTHEYLAPEIIKGDGHGSAVDWWTFGVFLYELLYGKTPFRGPGNDETLANVVSQNLRFPDSPVVSSNAKDLIRGLLVKEPENRLGSLRGAAEIKQHPFFEGLNWALIRSAAPPETQPCNVVTLAKERKKKEGKCLEFRSNSEDLEFEVF

SEQ ID NO: 18612 - protein, 787 aa, Oryza sativa
MGSSGCSSEIVEFTEEFDDNAPVSCPNLMHIRVKPEEKDGRCYPVEDDLEQLLKAIDSRTFRRTLSPGQAGADALRKNGQKKSSRSGPAQAAGIGISSKPVNMKQALRRLCISQASEMAAMKRLSMSPGSSSSSEVGTIHRLYASLMVQSNGESHLHDDEKMNLIEISITPEKFSKNSSRATSEFSEDCDFETADGSAVTSLHSASSTSAEIRKIRIQDVISGDPIDSESSMVENEKLNKKVSTATDGSSPRAPILSKPITTSRLVKPVFRCKTIGKKKLKEEPPSLGTSSNSTKFCSSKESISLASTSCSSTSSITNPTSCADDEKTNLGPEKSGDKSPEWLRSEEKGECSQNSNSISEYGCSTSISDESQFGLCSYNNRPHMAKDLRWITIRELALQQGSLGLDNFKLLKRLGCGDIGTVYLAELVDSECLFALKVMDIEYLINRKKMLRAQAEREILEMLDHPFLPTLYAHFTTDNLSCLVMEYCPGGDLHVLRQRQPGRSFPEPAARFYVAEVLLALEYLHMLGVIYRDLKPENILVREDGHIMLSDFDLSLRCSVNPVLLRSSSVAANHQPRKLAGPCAESSCISSSCQPSCAQTSCFMARPPLPKPRKPKSSHRKLPQLVVEPIDARSNSFVGTHEYLAPEIIKGDGHGSAVDWWTFGVFLYELLYGKTPFRGPGNDETLANVVSQNLKFPENPSVSSNAKDLIKGLLVKEPENRLGSLRGAAEIKQHPFFEGLNWALIRSAAPPETRPCDVVTLATAKKKKEGKCLEFRSNSEDLEFEVF

SEQ ID NO: 18613 - protein, 789 aa, Brachypodium distachyon
MGSSGCCSEIVESTEELDNAPVSGSSLLHIKVKPEEKDGKCRGYPVEDELDQLLKAIDSRTYRRALSPGQAGADTLLKNAQKKTSRSGSSQNTGIGICSKPVNMKQALRRLCISQASEMAAMKRLSMSPGSSSSSEAGTIHRLYASLIVQSSDESPLHDDDKTNLIEISITPQKISKNSSRGTSDFSEDCDFETADGSAVTSLHSASSTSADIRKIRIQDVMGGDPIDSESSFVENGKLGENVSAATDDSSPRLTILSKPITTSRLVKPVFRCKTNSKSKMKEEQSSLGNSSNSTKFCSSKESISLASTSCSSASSVTNPTSCAEEQKTNTEPEISDERSSEWLRTQEKGECSQNSKSSISEYGCSTSISDESQFGLCGYTNRPHMAKDIRWITIRQLALQQGSLGLDNFKLLKRLGCGDIGTVYLAELVDSDCLFALKVMDIEYLISRKKMLRAQAEREILEMLDHPFLPTLYAHFTTDNLSCLVMEYCPGGDLHVLRQRQPGRSFPEPSARFYVAEVLLALEYLHMLGVIYRDLKPENILVRDDGHIMLSDFDLSLRCSVNAVLLRSSSVAVNQQPKKLAGPCAESYCINSSCLQPSCAQTSCFRPRPSNPKSRKPKSSLKRLPQLVVEPTEARSNSFVGTHEYLAPEIIKGDGHGSAVDWWTFGVFLYELLYGKTPFRGPGNDETLANVVSQNLRFPDNPVVSSNAKDLIRGLLVKEPENRLGTLRGAAEIKQHPFFEGLNWALIRSAAPPETRPCDVVTLATVKKKKEGKCLDFRSTEELEFEVF

SEQ ID NO: 18614 - protein, 787 aa, Oryza sativa
MGSSGCSSEIVEFTEEFDDNAPVSCPNLMHIRVKPEEKDGRCYPVEDDLEQLLKAIDSRTFRRTLSPGQAGADALRKNGQKKSSRSGPAQAAGIGISSKPVNMKQALRRLCISQASEMAAMKRLSMSPGSSSSSEVGTIHRLYASLMVQSNGESHLHDDEKMNLIEISITPEKFSKNSSRATSEFSEDCDFETADGSAVTSLHSASSTSAEIQKIRIQDVISGDPIDSESSMVENEKLNKKVSTATDGSSPRAPILSKPITTSRLVKPVFRCKTIGKKKLKEEPPSLGTSSNSTKFCSSKESISLASTSCSSTSSITNPTSCADDEKTNLGPEKSGDKSPEWLRSEEKGECSQNSNSISEYGCSTSISDESQFGLCSYNNRPHMAKDLRWITIRELALQQGSLGLDNFKLLKRLGCGDIGTVYLAELVDSECLFALKVMDIEYLINRKKMLRAQAEREILEMLDHPFLPTLYAHFTTDNLSCLVMEYCPGGDLHVLRQRQPGRSFPEPAARFYVAEVLLALEYLHMLGVIYRDLKPENILVREDGHIMLSDFDLSLRCSVNPVLLRSSSVAANHQPRKLAGPCAESSCISSSCQPSCAQTSCFMARPPLPKPRKPKSSHRKLPQLVVEPIDARSNSFVGTHEYLAPEIIKGDGHGSAVDWWTFGVFLYELLYGKTPFRGPGNDETLANVVSQNLKFPENPSVSSNAKDLIKGLLVKEPENRLGSLRGAAEIKQHPFFEGLNWALIRSAAPPETRPCDVVTLTTAKKKKEGKCLEFRSNSEDLEFEVF

SEQ ID NO: 18615 - protein, 789 aa, Lolium multiflorum
MGSSGCSSEIVESNEELDKAPVCGSSLLHVKVKPEDKDGRCRGYAVEDELDQLLKAIDSRTYRRALSPGQAGADSFLKNAQRKTSRSASSQTAGIGICSKPVNMKQALRRLCISQASEMAAMKRLSMSPGSSSSSEAGTIQRLYASLMVQSSDGSLVHDDDKMNLIEISITPENISKNSSRGTSDYSEDCDFETADGSAVTSMHSASSTSADIRKVRIQDVISGDTRESESSVVQNGKLGGKVSADTDDTSPRLPILSKPITTSRLVKPAFRCKASSKSKMKEEQSSLGNSSNSTKFCSSKESISLASTSCSSASSVTNPTSCVEQETNPGPEESDERSSEWLRTEEKGECSQHSKSSVSEYGCSTSISDESQFGLCNYNNRPHMAKDLRWITIRQLALQQGSLGLDNFKLLKRLGCGDIGTVYLAELVDSDCLFALKVMDIEYLISRKKMLRAQAEREILEMLDHPFLPTLYAHFTTDNLSCLVMEYCPGGDLHVLRQRQPGRNFPEPSARFYVAEVLLALEYLHMLGVIYRDLKPENILVRDDGHIMLSDFDLSLRCSVSAVLLRSSSVAANHQPKKHAGPCAESNCMNSSCLQPTSCAQTSCFRPRPSIPKPRKPKSSLKRLPQLVVEPTEARSNSFVGTHEYLAPEIIKGDGHGSAVDWWTFGVFLYELLYGKTPFRGPGNDETLANVVSQNLRFPDNPVVSSNARDLIRGLLVKEPENRLGTLRGAAEIKQHPFFEGLNWALIRSAAPPETRPCDVVTLATVRKKKEGKCLDFSNAEEVEFEVF

SEQ ID NO: 18616 - protein, 785 aa, Triticum aestivum
MGSSGCSSEIVESNEDLGNAPVSGSSVLHINVKTEEKDGRRRGHPVEDELDQLLKAIDSRTYCRALSPGQAGADSLLKHGQKTPRSGSSQIAVPGICSKPVNMKQALRRHCISQASEMAAMKRLSMSPGSSSSSEAGTIHRLYASLMVQSSDGSLVHDDKKNLIEISITPEKISKNLSRGTSGFSEDCDFETADGSAVTSIHSASSTSIDIQKVRIQDVISGDPVESESSIVQNGKTHKQVSAATDDSPSRIPILIKPITTSRLVKPVFRCKTSSKSKMKEEQPSLGNSSNSTKFCSSKESISHVSTSSSSVSSISNPTSCAEGEINPGPEKCDERSSEWLTLEKGECSQNSKSSISEYGCSTSISDESQFGLCGYNNRPHMVKDLCWITIRQLALQQGPLGLDNFRLLKRLGCGDIGTVYLAELVDSDCLFALKVMDIEYLISRKKMLRAQAEREILEMLDHPFLPTLYAHFTTDNLSCLVMEYCPGGDLHVLRQRQPGRSFPEPSARFYVAEVLLALEYLHMLGVIYRDLKPENILVRDDGHIMLSDFDLSLRCSVSAVLLRSSSVAANHQPKKLTSPCAESYCINSSCLQPSCAQTSCFRPRPWVPKPRKPKSSLKRLPQLVVEPTEARSNSFVGTHEYLAPEIIKGDGHGSAVDWWTFGVFLYELLYGRTPFRGPGNDETLANVVSQNLRFPDNPVVSSNAKDLIRGLLVKEPENRLGTLRGAAEIKQHPFFEGLNWALIRSAAPPETRPCDVVTLATVRKKKEGKCLDFRSPEELEFEVF

SEQ ID NO: 18617 - protein, 785 aa, Triticum aestivum
MGSSGCSSEIVESNEDLDNAPVSGSSVLHINVKTEEKDGRRRGHPVEDELDQLLKAIDSRTYRRALSPGQAGADSLSKHAQKTPRSGSSQIAVTGICSKPVNMKQALRRHCISQASEMAAMKRLSMSPGSSSSSEAGTIHRLYASLMVQSSDGSVVHDDKKNLIEISITPEKISKNLSRGTSGFSEDCDFETADGSAVTSIHSASSTSTDIQKVRIQDVISGDPVESESSIVQNGKTHKQVSATTDDSPSRIPILIKPITTSRLVKPVFRCKTSSKSKMKEEQPSLGNSSNSTKFCSSKESISHVSTSSSSASSISNPTSCAEGEINPGPEKSDERSSEWLTLEKGECSQNSKSSISEYGCSTSISDESQFGLCGYNNRPHMVKDLCWITIRQLALQQGPLGLDNFRLLKRLGCGDIGTVYLAELVDSDCLFALKVMDIEYLISRKKMLRAQAEREILEMLDHPFLPTLYAHFTTDNLSCLVMEYCPGGDLHVLRQRQPGRSFPEPSARFYVAEVLLALEYLHMLGVIYRDLKPENILVRDDGHIMLSDFDLSLRCSVSAVLLRSSSVAANHQPKKLTSPCAESYCINSSCLQPSCAQTSCFRPRPWVPKPRKPKSSLKGLPQLVVEPTEARSNSFVGTHEYLAPEIIKGDGHGSAVDWWTFGVFLYELVYGRTPFRGPGNDETLANVVSQNLRFPDNPVVSSNAKDLIRGLLVKEPENRLGTLRGAAEIKQHPFFEGLNWALIRSAAPPETRPCDVVTLATVRKKKEGKCLDFRSAEELEFEVF

SEQ ID NO: 18618 - protein, 786 aa, Hordeum vulgare
MESSGCSSEIVESNEDLDNAPVSGSSLLHINVKTEEKDGRRRGHPVEDELDQLLKAIDSRTYRRALSPGQAGADSLLKHAQKTPRSLSSQIAVTGICSKPVNMKQALRRHCISQASEMAAMKRLSMSPGSSSSSEAGTIHRLYASLMVQSSDGSLVHDDRKNLIEISITPERISKNLSGGTSGFSEDCDFETADGSAVTSMHSASSPSTDIQKVRIQDVINGDPVENESSIVQNGKTHKQVSAATDDSSSRIPILIKPISTSRLVKPVFRCKTSSNKSRMKEEQPSLGNSSNSTKFCSSKESISHVSTSSSSASSITNTTSCAEGEINPGPEKSDERSSEWLTLEKGERSQNSKSSISEYGCSTSISDESQFGLYGYNNRPHMVKDLCWITIRQLALQQGPLGLDNFRLLKRLGCGDIGTVYLAELVDSHCLFALKVMDIEYLISRKKMLRAQAEREILEMLDHPFLPTLYAHFTTDNLSCLVMEYCPGGDLHVLRQRQPGRSFPEPSARFYVAEVLLALEYLHMLGVIYRDLKPENILVRDDGHIMLSDFDLSLRCSVSAVLLRSSSVAANHQPKKLTSPCAESYCINSSCLQPSCAQTSCFKPRPWVPKPRKPKSSLKRLPQLVVEPTEARSNSFVGTHEYLAPEIIKGDGHGSAVDWWTFGVFLYELLYGRTPFRGPGNDETLANVVSQNLRFPDNPVVSSNAKDLIRGLLVKEPENRLGTLRGAAEIKQHPFFEGLNWALIRSVAPPETRPCDVVTLATVRKKKEGKCLDFRSAEELEFEVF

SEQ ID NO: 18619 - protein, 785 aa, Secale cereale
MGSSGCTSEIVESNEYLDNAPVSGSSVLHINVKTEEKDGRRCGHPVEDELDQLLKAIDSRTYRRALSPGQAGADSLLKRAQRTPRSGSSQIAVTGICSKPVNMKQALRRHCVSHASEMAAMKRLSMSPGSSSSSEAGTIHRLYASLMVQSTDGSLVHDDKKNLIEISITPEKISKNLSRGTSGFSEDCDFETAVGSAVTSMHSASSTSTDIQKVRIQDVISGDPVESESSILQNGKTHKQVSAATDDSSSRIPILIKPITTSRLVKPVFRCQTSSKSKMKEEQPSLGNSSNSTKFCSSKESISHVSTSSSSASSITNPTSSAEGEINPGPEKSDMRSSEWLTLEKGECSQNSKSSISEYGCSTSLSDESHFGLCGYNNRPHMVKDLCWITIRQLALQQGPLGLHNFRLLKRLGCGDIGTVYLAELVDSDCLFALKVMDIEYLISRKKMLRAQAEREILEMLDHPFLPTLYAHFTTDNLSCLVMEYCPGGDLHVLRQRQPGRSFPEQSARFYVAEVLLALEYLHMLGVIYRDLKPENILVRDDGHIMLSDFDLSLRCSVSAVLLRSSSVAANHQPKKLTSPCAESYCINSSCLQPSCAQTSCFRPRPWVPKPRKPKSSLKRLPQLVVEPTEARSNSFVGTHEYLAPEIIKGDGHGSAVDWWTFGVFLYELLYGRTPFRGPGNDETLANVVSQNLRFPDNPVVSSNAKDLIRGLLVKEPESRLGTLRGAAEIKQHPFFEGLNWALIRSAAPPETRPCDVVTLATVRKKKEGKCLDFRSTEELEFEVF

SEQ ID NO: 18620 - protein, 573 aa, Zea mays
MDIKERIRRSPPSSPQAVGEAAASAPGHPRGRKARVAVLPLSVACGVTLLLLAGVSAARRGAQFSGADPTTLSGNDDRGGFEQAGPRDGEHATTVSSKVQRDKLIGGLLAPGFDEQSCLSRYQSALYRKESPHLVSTYLLERLREHEVLQKKCGPYTDSYKKAIEQLNSGQDIMVGDCNYLVWVSYSGLGNRILTIASAFLYAILTNRVLLVDGDKGTADLFCEPFPETSWVLPPDFPITKFKNFSIGSPESYGNMAKTEAIHSDGSFKGPKPAFLYLHLAHDYDDHDKLFFCEHSQQHLQKIPWLILRSDNYFVPSLFLISSYQEELTRLFPQKDVVFHHLGRYLFHPTNAVWGLITRYYDSYLARADEKLGIQIRVFDTETGPFQHVLDQVLHCTLKEKLLPEINAQQPIISTGNIKSKVVLITSLNSGYYERIRNMYWEHPTENGEMISFHQPSHEEHQDSDKTMHNMKAWAEIYLLSLSDAMVTSAWSTFGYVAQGLSGSKTWLLFKPENRTAPNPPCRQVMSIEPCFHAPPFYDCKTRKGTDTGKLVPHVRHCEDMSWGLKLVDTGEL

SEQ ID NO: 18621 - protein, 575 aa, Setaria italica
MDIKERIHRSPPPTPQEQAGAAPAHPRGRKGRVAALPLSVAALVACGVVLLLLAGGSAARRGSQFLDADPASAGLAGDDRGDVHQARPRDGGHGTMESSKVQRDKLIGGLLAPGFDEQSCLSRYQSVLYRKKSPHLLSTYLLERLREQEVLQKKCGPHTESYKKAIELLKSGQDVKVGDCNYLVWVSYSGLGNRILTITSAFLYAILTNRVLLVDGDKGTADLFCEPFPETSWLLPLDFPINQFKNFSVGSPESYGNMVKTERIRSDGSFKGPKPAFIYLHLAHDYDDYDKLFFCEHSQQHLQRIPWLIIRSDNYFVPSLFLIPAYQEELMRLFPQKDAVFHHLGRYLFHPTNVVWGLITRYYDSYLATADEKLGVQIRVFDTETGPFQHVLDQVLSCTLKENLLPEVNAQQPIVSTRKLRSKVVLITSLNSGYYERIRNMYWEHPTMNGEVISFHQPSHEEHQDSDKKMHNMKAWAEIYLLSLSDVMVTSAWSTFGYVAQGLSGLKTWLMFKPENRTAPNPPCRQVMSMEPCFHAPPFYDCKARRGTDTGKLVPHVRHCEDMSWGLKLVDTDER

SEQ ID NO: 18622 - protein, 575 aa, Panicum virgatum
MDIKERIRRSPPPPTPPAAPAPGHPRGTKGRVAVLPLSVAALVACGVLLLLLLSGGSAARRGGQFLDADPATARPSGDGRGGLHQARPRDGGHVTMESSKVQRDKLIGGLLAPGFEEQSCLSRYQSALYRKESPHLLSAYLLERLREHEVLQKKCGPHTESYKKAIEQLKSGQDIEVGDCNYLVWVSYSGLGNRILTITSAFLYAILTNRVLLVDGDKGTADLFCEPFPETSWLLPSDFPINQFKNLNIGSPESYGKMLKTANIHSDGSFKGPKPTFIYLHLAHDYDDYDKLFFCEHSQQHLQRIPWLILRSDNYFVPSLFLIPAYQEELMRLFPQKDAVFHHLGRYLFHPTNVVWGLITRYFDSYLARADEKLGIQIRVFDTETGPFQHVLDQVLSCTLKENLLPEVNAQQPIVSTRKVKSKVVLITSLNSGYYERIRTMYWEHPTSNGEIISFHQPSHEEHQDSDKKMHNMKAWAEIYLLSLSDVMVTSAWSTFGYVAQGLSGLKTWLMFKPENHTVPNPPCRQVMSMEPCFHAPPFYDCKARRGADTGKLVPHVRHCEDMSWGLKLVDTDEW

SEQ ID NO: 18623 - protein, 577 aa, Panicum virgatum
MDIKERIRRSPPPPPTPQAAAPAPGHPRGRKGRVAVLPLSVAALVACVVLLLLLSGGSAARRGGQFLDADPATARRPSGDGRGGLHQPRPRDGGHGTMESSKLQSDKLIGGLLAPGFDEQSCLSRYQSALYRKESPHLLSTYLLERLREHEVLQKKCGPHTESYKKAIEQLKSGQDIEVGDCTYLVWISYSGLGNRILTITSAFVYAILTSRVLLVDGDKGTADLFCEPFPETSWLLPSDFPVNLFKNLNIGSPESYGKMLKTANIHSDGSFKGPTPAFIYLHLAHDYDDYDKHFFCEHSQQHLQRIPWLILRSDNYFVPSLFLIPAYQEELMRLFPQKDAVFHHLGRYLFHPTNAVWGLITRYYDSYLARADEKLGIQIRVFDTETGPFQHVLDQVLSCTLKENLLPEVNAQQPIVSARKVRSKVVLITSLNSGYYERIRTMYWEHPTSNGEIISFHQPSHEEHQDSDKKMHNMKAWAEIYLLSLSDVMVTSAWSTFGYVAQGLSGLKTWLMFKPENHTAPNPPCRQVMSMEPCFHAPPFYDCKARRGTDTGKLVPHVRHCEDMSWGLKLVDTDEW

SEQ ID NO: 18624 - protein, 504 aa, Zea mays
MAVGGDDDSMERDFAARLRLAHSPSPATPAAAASSSPTAAGGIAFRAPQEQFTADDFVLGKIYGVGSYSKVVRAKKKDTGRVYALKIMDKKFITKENKISYVKMERIVLDQLDHPGVIRLFFTFQDTYSLYMALESCEGGELFDQIVRKGRLSEDDARFYAAEIVDILEYLHGLGLIHRDVKPENLLLTSDGHIKIADFGSVKPTRDTPIKVLPNSTTERACTFVGTAAYVPPEVLNSAPATFGNDLWALGCTLYQMLSGSSPFKDASEWLIFQRIIARDLKFPEYFSAEARDLVDKLLDVDPGKRPGAGPDGYSSLKEHPFFRGIDWKNLRKTRPPKLAIDANANEDEDSQDSNWLAHMGSVAVNQQSNTVGNNGAPSSSEVRSHISKLASIDSFDSKWQEFLDPGESVVLISKLKKINKLANKKIQLILTDKPQLICVDPSKMVAKGNIIWSDDPSELSVQVSDSSHFRICTPKKVSTFEDAKQRAWQWKKAIEDLQRCQRN

SEQ ID NO: 18625 - protein, 508 aa, Setaria italica
MAVGGDDDTMERDFAARLRLAHSPSPAPPPATAAAVASSSPTAAGGIAFRAPQEQFTAADFELGKIYGVGSYSKVVRAKKKDTGNVYALKIMDKKFITKENKISYVKMERIVLDQLDHPGVIRLFFTFQDTYSLYMALESCEGGELFDQIIRKGRLSEDEARFYAAEIVDILEYLHSVGLIHRDVKPENLLLTSDGHIKIADFGSVKPTRDTPIKVLPNSTNERACTFVGTAAYVPPEVLNSAPATFGNDLWALGCTLYQMLSGSSPFKDASEWLIFQRIIARDIKFPEYFSDEARDLIDKLLDVDPSKRPGAGPDGYSSLKKHPFFRGIDWKNLRKTRPPKLAIDPNASEDEDSQDSNWLSHMGGTTVNQQSNTVSNNGVASSSEVRSHISKLASIDSFDSKWQEFLDPGESVVLISKLKKINKLANKKVQLILTDKPQLICVDPSKMVAKGNIIWSDDPSELNVQVTNSSHFRICTPKKVSTFEDAKQRAWQWKKAIEDLQRCQKY

SEQ ID NO: 18626 - protein, 505 aa, Panicum virgatum
MAVAGDDDDTMERDFAARLRLAHSPSPAPPAAAAFSSPTAAGGIAFRAPQEQFTAGDFELGKIYGVGSYSKVVRAKKKDTGNVYALKVMDKKFITKENKISYVKMERIVLDQLDHPGVIRLFFTFQDSYSLYMALESCEGGELFDQIVRKGRLSEDEARFYAAEIVDILEYLHSVGLIHRDVKPENLLLTSDGHIKIADFGSVKPTRDTPIKVLPNSTDERACTFVGTAAYVPPEVLNSAPATFGNDLWALGCTLYQMLSGSSPFKDATEWLIFQRIIARDIKFPEYFSDEARDLIDKLLDVDPSKRPGAGPDGYSSLKKHPFFRGIDWKDLRKTRPPKLAVDPNANEDEDSQDSNWLSHMGSTTVNQQSNTVSINSAASSSEVRSHISKLASIDSFDSKWQEFLDPGESVVLISKLKKINKLANKKVQLILTDKPQLICVDPSKMVAKGNIIWSDDPSELSVQVTNSSHFRICTPKKISTFEDSKQRAWQWKKAIEDLQRCQKY

SEQ ID NO: 18627 - protein, 505 aa, Panicum virgatum
MAVAGDDDDSMDRDFAARLRLAHSPSPAPPAAAAASSSPTATGGIAFRAPQEQFTAADFELGKIYGVGSYSKVVRAKKKDTGNVYALKVMDKKFITKENKISYVKMERIVLDQLDHPGVIRLFFTFQDSYSLYMALESCEGGELFDQIVRKGRLSEEEAQFYAAEIVDILEYLHSVGLIHRDLKPENLLLTSDGHIKIADFGSVKPTRDTPIKVLPNSTNERACTFVGTAAYVPPEVLNSAPATFGNDLWALGCTLYQMLSGSSPFKDATEWLIFQRIIARDIKFPEYFSDEAKDLIDKLLDVDPSKRPGAGPDGYSSLKKHPFFRGIDWKNLRKTRPPKLAIDPNANEDEDSQDSNWLSHMGSTTVNQQSNTVNNNGAASSEVRSHISKLASIDSFDSKWQEFLDPGESVVLISKLKKINKLANKKVQLILTDKPQLIYVDPSKMVAKGNIIWSDDPSELSVQVTNSSHFRICTPKKISTFEDSKQRAWQWKKAIEDLQRCQKY

SEQ ID NO: 18628 - protein, 475 aa, Echinochloa colona
AAAASSSPTAAGGIAFRAPQEQFTAADFDLGKIYGVGSYSKVVRARKKDTGNVYALKIMDKKFITKENKISYVKMERIVLDQLDHPGVIRLFFTFQDTYSLYMALESCEGGELFDQIVRKGRLCEDDARFYAAEIVDILEYLHSVGLIHRDVKPENLLLTSDGHIKIADFGSVKPTRDTPIKVLPNSTNERACTFVGTAAYVPPEVLNSAPATFGNDLWALGCTLYQMLSGSSPFKDASEWLIFQRIIARDIKFPEYFSDEARDLIDKLLDVDPSKRPGAGPDGYSSLKKHPFFRGIDWKNLRKTRPPKLAIDTNANEGEDSQDSNWLSHMGSTTVNQQSNTVSNNVAASSSEARSHISKLASIDSFDSKWQEFLDPGESVVLISKLKKINKLANKKVQLILTDKPQLICVDPSKMVAKGNIIWSDDPTELSVQVSNSSHFRICTPKKVSTFEDAKQRAWQWKKAIEDLQRCQKK

SEQ ID NO: 18629 - protein, 498 aa, Oryza sativa
MAVGGDDDMERDFAARLRLAPSPASPTAAAGGGGGGIAFRAPQEQFTVGDFELGKIYGVGSYSKVVRAKKKDTGNVYALKIMDKKFITKENKISYVKMERIVLDQLDHPGVIRLFFTFQDTYSLYMALESCEGGELFDQIVRKGRLSEDEARFYAAEIVDILEYLHSLGLIHRDVKPENLLLTSDGHIKIADFGSVKPTKDTPIKVLPNSTNERACTFVGTAAYVPPEVLNSAPPTFGNDLWALGCTLYQMLSGSSPFKDASEWLIFQRIIARDLKIPEYFSDDARDLIDKLLDVDPSKRPGAGPDGYVSLKKHPFFRGIDWKNIRSTRAPKLAMEANANEDEDSQDSSWLSHMGSAPVNQHVSPVGNDGASSSSEVRSHISRLASIDSFDSRWQDFLEPGESVVLISKLKKINKLTNKKVQLILTDKPQLICVDPGKMVTKGNIMWSDDPSELNVQVSNSSHFRICTPKKVSSFEDAKQRAWQWKKAIEDLQRCQKN

SEQ ID NO: 18630 - protein, 498 aa, Oryza sativa
MAVGGDDDMERDFAARLRLAPSPASPNAAAGGGGGGIAFRAPQEQFTVGDFELGKIYGVGSYSKVVRAKKKDTGNVYALKIMDKKFITKENKISYVKMERIVLDQLDHPGVIRLFFTFQDTYSLYMALESCEGGELFDQIVRKGRLSEDEARFYAAEIVDILEYLHSLGLIHRDVKPENLLLTSDGHIKIADFGSVKPTKDTPIKVLPNSTNERACTFVGTAAYVPPEVLNSAPPTFGNDLWALGCTLYQLLSGSSPFKDASEWLIFQRIIARDLKIPEYFSDDARDLIDKLLDVDPSKRPGAGPDGYVSLKKHPFFRGIDWKNIRSTRAPKLAMEANANEDEDSQDSSWLSHMGSAPVNQHVSPVGNDGASSSSEVRSHISRLASIDSFDSRWQDFLEPGESVVLISKLKKINKLTNKKVQLILTDKPQLICVDPGKMVTKGNIMWSDDPSELNVQVSNSSHFRICTPKKVSSFEDAKQRAWQWKKAIEDLQRCQKN

SEQ ID NO: 18631 - protein, 501 aa, Hordeum vulgare
MAVGGDDDMERDFAARLRLAPSHPSAPASASPAAAAAAGGIAFRAPQEQFTAADFELGKIYGVGSYSKVVRARKKDTGNVYALKIMDKKFITKENKISYVKMERIVLDQLDHPGVIRLFFTFQDSYSLYMALESCEGGELFDQIVRKGRLSEDEARFYAAEIVDILEYLHSVGLIHRDVKPENLLLTSDGHIKIADFGSVKPTVDTPIKVLPNSTNERACTFVGTAAYVPPEVLNSAPATFGNDLWALGCTLFQMLSGSSPFKDASEWLIFQRIIARDLRFPEFFSDEARDLIDKLLDVDPTKRPGAGPDGYASLKKHPFFRGIDWKNIRKMRAPKPAVETNANEDEDNQDSDWLSHMGSAHANQNVPVGNNGAASSSEVRSHVSKLASIDSFDSRWQDFLEPGESVVLISKLKKINKLSNKKVQVILTNKPQLICVDPAKMVTKGNISWSDDPSELNVQVADSSHFRISTPKKVFIFEDAKQRAWQWKNAIEDLQHCQKS

SEQ ID NO: 18632 - protein, 499 aa, Secale cereale
MAVGGDDDMERDFAARLRLAPSNPSASASASPTAGGGGIAFRAPQEQFTAADFELGKIYGVGSYSKVVRARKKDTGNVYALKIMDKKFITKENKISYVKMERIVLDQLDHPGVIRLFFTFQDTYSLYMALESCEGGELFDQIIRKGRLPEDEARFYAAEIVDILEYLHSVGLIHRDVKPENLLLTSDGHIKIADFGSVKPTVDTPIKVLPNSTNERACTFVGTAAYVPPEVLNSAPATFANDLWALGCTLFQMLSGSSPFKDASEWLIFQRIIARDLRFPEFFSDEARDLIDKLLDVDPTKRPGAGPDGYASLKKHPFFRDIDWKNIRKTRAPKPAVEANANEDEDSQDSDWLSHMGSAHANQNVPVGNNGAASSSEVRSHVSKLASIDSFDSRWQDFLEPGESVVLISKLKKINKLSNKKVQLILTNKPQLICVDPAKMVTKGNISWSADPSELNVQVANSSHFRISTPKKVFVFEDAKQRAWQWKNAIEDLQNCQKN

SEQ ID NO: 18633 - protein, 465 aa, Pennisetum glaucum
AGGIAFRAPQEQFTAADFELGKIYGVGSYSKVVRAKKKDTGNVYALKIMDKKFITKENKISYVKMERIVLDQLDHPGVIRLFFTFQDTYSLYMALESCEGGELFDQIVRKGRLSEDEARFYAAEIVDILEYLHSVGLIHRDVKPENLLLTSDGHIKIADFGSVKPTRDTPIKVLPNSTNERACTFVGTAAYVPPEVLNSAPATFGNDLWALGCTLYQMLSGSSPFKDASEWLIFQRIIARDVKFPEYFSDEARDLIDKLLDVDPIKRPGGGPDGYSSLKKHPFFRGIDWKNLRKTRPPKLVMDPNANEDEDSQDSNWLSHMGGTTVNQQSNTVSNNGVASSSEVRSHISKLASIDSFDSKWQEFLEPGESVVLISKLKKINKLANKKVQLILTDKPQLICVDPSKMVAKGNIIWSDDPSELNVQVTNSSHFRICTPKKVSTFEDTKQRAWQWKKAIEDLQRCQKY

SEQ ID NO: 18634 - protein, 499 aa, Avena sativa
MAVGGDGDDDMERDFAARLRLAPSASSTASPKAAAAAAAAGGGGIAFRAPQEQFTADDFDLGKIYGVGSYSKVVRAKKKDTGNVYALKIMDKKFITKENKISYVKMERIVLDQLDHPGVIRLFFTFQDTYSLYMALESCEGGELFDQIARKGRLPEDEARFYAAEIVDILEYLHSVGLIHRDVKPENLLLTSDGHIKIADFGSVKPTMDTPIKVLPNSTNERACTFVGTAAYVPPEVLNSAPATFGNDLWALGCTLFQMLSGSSPFKDASEWLIFQRIIARDLRIPEYFSDEARDLIDKLLDVDPIKRPGAGPDGYASLKKHPFFRGIDWKNIRKTHAPDLAAEANANEDEDTQDSDWLSHMGSAPFNPPVGNNGAVSSSEVRSHVSKLASIDSFDSRWQDFLEPGESVVLISKLKKINKLSNKKVQLILTNKPQLICVDPAKMETKGNISWSDDSSELNVQVANSSHFRIYTPKKVFVFEDSKQRAWQWKNAIEDLQH

SEQ ID NO: 18635 - protein, 495 aa, Brachypodium distachyon
MERDFAARLRLAPSPSSASASASPTAAAAGGGSGIAFRAPQEQFTVDEFELGRIYGVGSYSKVVRAKKKDTGNVYALKIMDKKFITKENKISYVKMERIVLDQLDHPGVIRLFFTFQDTYSLYMALESCEGGELFDQIIRKGRLSEDEARFYAAEIVDILEYLHSVGLIHRDVKPENLLLTSDGHIKIADFGSVKPTRDTPIKVLPNSTTERACTFVGTAAYVPPEVLNSAPATFGNDLWALGCTLFQMLSGSSPFKDASEWLIFQRITARDLRFPQYFSDEARDLVDKLLDMDPIKRPGAGPDGYASLKKHPFFRGIDWKNIRKTRAPKLAVEENANEDDDTQDSDWLSHMGSAPVNQHVPVGNNGAASSSEVRSHVSKLASIDSFDSRWQEFLEPGESVVLISKLKKINKLSNKKVQLILTNKPQLICVDPAKMETKGNIIWSDDPSELNVQVTNSSHFRICTPKKVFIFEDAKQRAWQWKNAIEDLQHCQKN

SEQ ID NO: 18636 - protein, 208 aa, Brachypodium distachyon
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKAKDLGVMFIETSAKAGFNIKALFRKIAAALPGMETLSSAKQEDMVDVNLKSGNANSSQSQAQAGGCSC

SEQ ID NO: 18637 - protein, 208 aa, Echinochloa colona
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKAKDLGVMFIETSAKAGFNIKALFRKIAAALPGMETLSSAKQEDMVDVNLRSGNANSSQAQAQAGGCSC

SEQ ID NO: 18638 - protein, 208 aa, Zea mays
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIDEVRTERGSDVIIVLVGNKTDLVDKRQVSIEEGEGKAKDLGVMFIETSAKAGFNIKALFRKIAAALPGMETLSSAKQEDMVDVNLRSGNANSSQSQAQAGGCSC

SEQ ID NO: 18639 - protein, 208 aa, Panicum virgatum
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKANDLGVMFIETSAKAGFNIKALFRKIAAALPGMETLSSAKQEDMVDVNLRSGNANSSQSQAQAGGCSC

SEQ ID NO: 18640 - protein, 208 aa, Oryza sativa
  Sequence also found in Organisms: Hordeum vulgare, Leymus cinereus x Leymus triticoides, Secale cereale, Triticum aestivum
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKAKDLGVMFIETSAKAGFNIKALFRKIAAALPGMETLSSAKQEDMVDVNLKSSNANSSQSQAQAGGCSC

SEQ ID NO: 18641 - protein, 208 aa, Lolium multiflorum
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKAKDLGVMFIETSAKAGFNIKALFRKIAAALPGMETLSSAKQEDMVDVNLKSGNANSSQSQAQAGGCSC

SEQ ID NO: 18642 - protein, 208 aa, Avena sativa
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKAKDLGVMFIETSAKAGFNIKALFRKIAAALPGMETLSSAKQEDMVDVNLKSGSANSSQSQAQAGGCSC

SEQ ID NO: 18643 - protein, 213 aa, Hordeum vulgare
MAPVSALAKYKLVFLGDQSVGKTSIITRFMYDKFDNTYQARLLPATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKAKDLGVMFIETSAKAGFNIKALFRKIAAALPGMETLSSAKQEDMVDVNLKSSNANSSQSQAQAGGCSC

SEQ ID NO: 18644 - protein, 208 aa, Aquilegia formosa
  Sequence also found in Organisms: Thalictrum flavum
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARDLNVMFIETSAKAGFNIKALFRKIAAALPGMETLSSTKQEDMVDVNLKSSNANSSQSQPQGGGCSC

SEQ ID NO: 18645 - protein, 208 aa, Cyclamen graecum
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARDLNVMFIETSAKAGFNIKALFRKIAAALPGMETLSSAKQEDMVDVNLRSSNPNASQSQQQSGGCSC

SEQ ID NO: 18646 - protein, 208 aa, Tropaeolum majus
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKARELNVMFIETSAKAGFNIKALFRKIAAALPGMETLSSTKQEDMVDVNLKSSNANSSQSQPQAGGCAC

SEQ ID NO: 18647 - protein, 208 aa, Malus domestica
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLNVMFIETSAKAGFNIKALFRKIAAALPGMETLSSTKQEDMVDVNLKSSNANSSQSQAQSGGCAC

SEQ ID NO: 18648 - protein, 208 aa, Eschscholzia californica
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARDLNVMFIETSAKAGFNIKALFRKIAAALPGMETLSSTKQEDMVDVNLKSTNANASQSQPQGGGCSC

SEQ ID NO: 18649 - protein, 208 aa, Musa acuminata
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVPIEEGEAKAQELGVMFIETSAKAGFNIKALFRKIAAALPGMENLSSAKQEDMVDVNLRSSNANSSQSQSQSGGCRC

SEQ ID NO: 18650 - protein, 208 aa, Eschscholzia californica
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEAEAKARDLNVMFIETSAKAGFNIKALFRKIAAALPGMETLSSTKQEDMVDVNLKSTNANSSQSQTQGGGCSC

SEQ ID NO: 18651 - protein, 208 aa, Vitis vinifera
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIEEVRTERGSDVIIVLVGNKTDLVDKRQVSIEEGEAKARDLNVMFIETSAKAGFNIKALFRKIAAALPGMETLSSAKQEDMVDVNLKSSNTNASQSQPQAGGCSC

SEQ ID NO: 18652 - protein, 208 aa, Mimulus guttatus
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARDLNVMFIETSAKAGFNIKALFRKIAAALPGMETLSSTKQEDMVDVNLKSSNANGSQSQQQSGGCAC

SEQ ID NO: 18653 - protein, 208 aa, Primula obconica
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARDLNVMFIETSAKAGFNIKALFRKIAAALPGMETLSSAKQEDMVDVNLKSSNTNASQSQPQSGGCAC

SEQ ID NO: 18654 - protein, 208 aa, Prunus mume
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARELNVMFIETSAKAGFNIKALFRKIAAALPGMETLSSTKQEDMVDVNLKSSNANSSQSQAQSGGCAC

SEQ ID NO: 18655 - protein, 208 aa, Musa acuminata
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKAQELGVMFIETSAKAGFNIKALFRKIAAALPGMENLSSTKQEDMVDVNLRATNANSYQSQSQSGGCSC

SEQ ID NO: 18656 - protein, 208 aa, Theobroma cacao
  Sequence also found in Organisms: Heritiera littoralis
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLNVMFIETSAKAGFNIKALFRKIAAALPGMETLSSTKQEDMVDVNLKSTNANASQSQQQSGGCAC

SEQ ID NO: 18657 - protein, 208 aa, Chelidonium majus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLNVMFIETSAKAGFNIKALFRKIAAALPGMETLSSTKQEDMVDVNLKSTNANASQSQPQGGGCAC

SEQ ID NO: 18658 - protein, 208 aa, Mimulus guttatus
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQTFLNTSKWIEEVRTERGSDVIIVLVGNKTDLVDKRQVSIEEGEAKARDLNVMFIETSAKAGFNIKALFRKIAAALPGMETLSSAKQEDMVDVNLKSSNTNASQSQQQSGGCAC

SEQ ID NO: 18659 - protein, 208 aa, Petunia hybrida
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARELNVMFIETSAKAGFNIKPLFRKIAAALPGMETLSSAKQEDMVDVNLKSSNTNASQSQAQSGGCAC

SEQ ID NO: 18660 - protein, 208 aa, Lippia dulcis
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARDLNVMFIETSAKAGFNIKPLFRKIAAALPGMETLSTAKQEDMVDVNLKSSNANASQSQQQSGGCAC

SEQ ID NO: 18661 - protein, 208 aa, Populus trichocarpa
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRSERGSDVIIVLVGNKTDLVDKRQVSIEEGEAKARDLNVMFIETSAKAGFNIKALFRKIAAALPGMETLSSSKQEDMVDVNLKSSNANASQSQQQSGGCAC

SEQ ID NO: 18662 - protein, 208 aa, Prunus persica
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARELNVMFIETSAKAGFNIKALFRKIAAALPGMETLSSTKQEDMVDVNLKSSNANSSESQAQSGGCAC

SEQ ID NO: 18663 - protein, 208 aa, Tripterygium wilfordii
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARELNVMFIETSAKAGFNIKALFRKIAAALPGMETLSSTKQEDMVDVNLRSSNTNASQSQTQSGGCAC

SEQ ID NO: 18664 - protein, 208 aa, Amborella trichopoda
MATVSPLAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLGVMFIETSAKAGFNIKALFRKIAAALPGMETLSSTKQEDMVDVNLKATNANTSQGQQQAGGCSC

SEQ ID NO: 18665 - protein, 208 aa, Amorphophallus konjac
MAPVSALAKYKLVFLGDQSVGKTSIITRFMYDKFDTTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLGVMFIETSAKAGFNIKALFRKIAAALPGMETLSSTKQEDMVDVNLKSTNTSTSQSQPQSGGCSC

SEQ ID NO: 18666 - protein, 208 aa, Amsonia hubrichtii
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLNVMFIETSAKAGFNIKALFRKIAAALPGMETLSSAKQEDMVDVNLKSSNTNASQTQQQSGGCAC

SEQ ID NO: 18667 - protein, 208 aa, Ricinus communis
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLNVMFIETSAKAGFNIKALFRKIAAALPGMETLSSTKQEDMVDVNLKSSNTNASQSQPQSGGCAC

SEQ ID NO: 18668 - protein, 208 aa, Catharanthus roseus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLNVMFIETSAKAGFNIKALFRKIAAALPGMETLSSAKQEDMVDVNLKSSNTNASQAQQQSGGCAC

SEQ ID NO: 18669 - protein, 208 aa, Eucalyptus grandis
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARELNVMFIETSAKAGFNIKALFRKIAAALPGMETLSSTKQEDMVDVNLKSTNPNASQSQQQSGGCAC

SEQ ID NO: 18670 - protein, 208 aa, Nicotiana benthamiana
  Sequence also found in Organisms: Nicotiana tabacum
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARELNVMFIETSAKAGFNIKPLFRKIAAALPGMETLSSAKQEDMVDVNLKSSNPNASQSQPQSGGCAC

SEQ ID NO: 18671 - protein, 207 aa, Allium cepa
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIDEVRTERGGDVIIVLVGNKTDLVDKRQVSIEEGEAKAQELGVMFIETSAKAGFNIKALFRKIAAALPGMETLSSTKQEDMVDVNLRSTNTNSSNSQPQSGCSC

SEQ ID NO: 18672 - protein, 207 aa, Carica papaya
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARELNVMFIETSAKAGFNIKALFRKIAAALPGMETLSSTKQEDMVDVNLKSSNNSSQSQPQSGGCAC

SEQ ID NO: 18673 - protein, 208 aa, Plantago ovata
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARDLNVMFIETSAKAGFNIKALFRKIAAALPGMETLSSAKQEDMVDVNLRSSNTTGGQAQQQSGGCAC

SEQ ID NO: 18674 - protein, 208 aa, Rosa hybrid cultivar
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLNVMFIETSAKAGFNIKALFRKIAAALPGMETLSSTKQEDMVDVNLKSSNPNASQSQGQSGGCAC

SEQ ID NO: 18675 - protein, 208 aa, Sarracenia psittacina
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARDLNVMFIETSAKAGFNIKALFRKIAAALPGMETLSSTKQEDMVDVNLKSSNTTASQSQPQSGGCAC

SEQ ID NO: 18676 - protein, 208 aa, Fagus grandifolia
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVEKRQVSIEEGEAKARDLNVMFIETSAKAGFNIKALFRKIAAALPGMETLSSTKQEDMVDVNLKSSNAAAMQSQQQSGGCAC

SEQ ID NO: 18677 - protein, 207 aa, Manihot esculenta
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLNVMFIETSAKAGFNIKALFRKIAAALPGMETLSSTKQEEMVDVNLKSNTNASQSQPQSGGCAC

SEQ ID NO: 18678 - protein, 208 aa, Gossypium hirsutum
  Sequence also found in Organisms: Gossypium raimondii
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFQNTSKWIEEVRTERGSDVIIVLVGNKTDLVDKRQVSIEEAEAKARDLHVMFIETSAKAGFNIKALFRKIAAALPGMETLSSTKQEDMVDVNLKSTNANASQSQQQSGGCAC

SEQ ID NO: 18679 - protein, 207 aa, Panax ginseng
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEAEAKARDLNVMFIETSAKAGFNIKALFRKIAAALPGMETLSSAKQEDMVDVNLKSTTSSSQSQPQSGGCAC

SEQ ID NO: 18680 - protein, 208 aa, Actinidia deliciosa
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTAKWIEEVRTERGSDVIIVLVGNKTDLVDKRQVSIEEGEAKARDLNVMFIETSAKAGFNIKALFRKIASALPGMETLSSAKQEDMVDVNLKSTNPGASQSQPQSGGCAC

SEQ ID NO: 18681 - protein, 208 aa, Nicotiana benthamiana
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKARELNVMFIETSAKAGFNIKPLFRKIAAALPGMETLSSAKQEDMVDVNLKSSNPNASQAQPQSGGCAC

SEQ ID NO: 18682 - protein, 208 aa, Elaeis guineensis
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEAEAKARDLGVMFIETSAKAGFNIKALFRKIAAALPGMETLSSTKQEDMVDVNLKATNVNSSQSQGSSGGCNC

SEQ ID NO: 18683 - protein, 207 aa, Orobanche aegyptiaca
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIVVLVGNKTDLVDKRQVSIEEGETKARELNVMFIETSAKAGFNIKALFRKIAAALPGMETLSSAKQEDMVDVNLKPTNANASQSQQQSGCAC

SEQ ID NO: 18684 - protein, 207 aa, Plantago ovata
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTAKWIEEVRTERGSDVIIVLVGNKTDLVDKRQVSIEEGEAKARDLNVMFIETSAKAGFNIKALFRKIAAALPGMETLSSAKHEDMVDVNLKSSNANTANSQQSGGCAC

SEQ ID NO: 18685 - protein, 208 aa, Tabernaemontana elegans
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLNVMFIETSAKAGFNIKALFRKIAAALPGMETLSSAKQEDMVDVNLKSSNTSASQTQQQSGGCAC

SEQ ID NO: 18686 - protein, 208 aa, Solanum lycopersicum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVEKRQVSIEEGEAKARELNVMFIETSAKAGFNIKPLFRKIAAALPGMETLSSAKQEDMVDVNLKSSNSNASQSQAQSGGCAC

SEQ ID NO: 18687 - protein, 208 aa, Zostera marina
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRLSFLNTLKWIEEVRTERGSDVIIVLVGNKTDLVDKRQVSIEEGEGKARELGVMFIETSAKAGFNIKALFRKIAGALPGMETLSSTKQEDMVDVNLKTTNSNSSQTQASAGGCSC

SEQ ID NO: 18688 - protein, 208 aa, Musa acuminata
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVVVGNKTDLVDKRQVSIEEGEAKAQELGVMFIETSAKAGFNIKALFRKIAAALPGMENLSSTRQEDMVDVNLKATNANSYQSQQQSGGCSC

SEQ ID NO: 18689 - protein, 208 aa, Ricinus communis
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQTFLNTSKWIEEVRTERGSDVIIVLVGNKTDLVEKRQVSIEEGEAKARDLNVMFIETSAKAGFNIKALFRKIAAALPGMETLSSTKQEDMVDVNLKSTSKTASQSQAQSGGCAC

SEQ ID NO: 18690 - protein, 208 aa, Cocos nucifera
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLGVMFIETSAKAGFNIKALFRKIAAALPGMETLSTTKQEGMVDVNLKATNVNSSQSQGPSGGCNC

SEQ ID NO: 18691 - protein, 208 aa, Gossypium hirsutum
  Sequence also found in Organisms: Gossypium raimondii
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFQNTTKWIEEVRTERGSDVIIVLVGNKTDLVDKRQVSVEEAEAKARDLNVMFIETSAKAGFNIKALFRKIAAALPGMETLSSTKQEDMVDVNLKSTNANSSQSQQEAGGCAC

SEQ ID NO: 18692 - protein, 208 aa, Solanum melongena
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVEKRQVSIEEGEAKARELNVMFIETSAKAGFNIKPLFRKIAAALPGMETLSSAKQEDMVDVNLKSSNTNAAQSQAQSGGCAC

SEQ ID NO: 18693 - protein, 207 aa, Fagopyrum esculentum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTQKWIEEVRTERGSDVIIVLVGNKTDLVDKRQVSIEEGEGKARDLNVMFIETSAKAGFNIKPLFRKIAAALPGMETLSSTKQEDMVDVNLKPDPNSSQSQPQSGGCAC

SEQ ID NO: 18694 - protein, 208 aa, Vitis vinifera
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVEKRQVSIEEGEAKARELNVMFIETSAKAGFNIKALFRKIAAALPGMETLSSAKQEDMVDVNLKSSSGSASQSQTQARGCSC

SEQ ID NO: 18695 - protein, 208 aa, Olea europaea
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVVVGNKTDLVEKRQVSIEEGEAKARDLNVMFIETSAKAGFNIKALFRKIAAALPGMETLSSAKQEDMVDVNLKSSNTNASVSQQQSGGCAC

SEQ ID NO: 18696 - protein, 208 aa, Phalaenopsis aphrodite
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIDEVRTERGSDVIIVLVGNKTDLVDKRQVSIEEGEAKAQELGVMFIETSAKAGFNIKALFRKIAAALPGMENLSSTKQEDMVEVNLKSSNASSSQSQPQSGGCSC

SEQ ID NO: 18697 - protein, 207 aa, Cajanus cajan
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQTFLNTSKWIEEVRTERGSDVIIVLVGNKTDLVEKRQVSIEEGEAKARELNVMFIETSAKAGFNIKALFRKIAAALPGMETLSSAKQEDMVDVNLKSTSGSSQSQPQSSGCSC

SEQ ID NO: 18698 - protein, 208 aa, Solanum tuberosum
  Sequence also found in Organisms: Solanum phureja
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVEKRQVSIEEGEAKARELNVMFIETSAKAGFNIKPLFRKIAAALPGMETLSSAKQEDMVDVNLKSSNSSASQSQAQSGGCAC

SEQ ID NO: 18699 - protein, 208 aa, Fragaria vesca
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKAREMNVMFIETSAKAGFNIKALFRKIAAALPGMETLSSTKQEDMVDVNLKSSNPNASQSQGQSGGCAC

SEQ ID NO: 18700 - protein, 208 aa, Nicotiana tabacum
MAPVSALAKYKLVFLGDQSVGKTSIITRFMYDKFDNTYQATIGIDFLSKTMYLEDRTVALQLWDTAGQERFRSLIPSYIRDSSVAVIVYDVASRQSFLNTSKWIEEVRTERGSDVIIVLVGNKTDLVEKRQVSIEEAEAKARELNVMFIETSAKAGFNIKPLFRKIAAALPGMETLSSAKQEDMVDVNLKSSNANASQSQAQSGGCAC

SEQ ID NO: 18701 - protein, 208 aa, Triphysaria pusilla
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTTKWIEEVRTERGSDVIIVVVGNKTDLVDKRQVSIEEGEAKSRDLNVMFIETSAKAGFNIKPLFRKIAAALPGMETLSSAKQEDMVDVNLKSSNANGSQSQQNAGGCAC

SEQ ID NO: 18702 - protein, 208 aa, Vinca minor
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRHSFLNTSKWIEEVRTERGSDVIIVLVGNKTDLVDKRQVSIEEAEAKARDLNVMFIETSAKAGFNIKALFRKIAAALPGMETLSSAKQEDMVDVNLKSSNTNASQAQQQSGGCAC

SEQ ID NO: 18703 - protein, 208 aa, Vinca minor
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEAEAKARDLNVMFIETSAKAGFNIKALFRKIAAALPGMETLSSAKQEDMVDVNLKSSNTNASQAQQQSSGCAC

SEQ ID NO: 18704 - protein, 208 aa, Rosmarinus officinalis
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTTKWIEEVRTERGSDVIIVLVGNKTDLVDKRQVSIEEAEAKARDLNVMFIETSAKAGFNIKPLFRKIAAALPGMETLSTAKQEDMVDVNLKSGYNNASQSQEQSGGCAC

SEQ ID NO: 18705 - protein, 208 aa, Arnica chamissonis
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTVKWIEEVRTERGSDVIIVLVGNKTDLVDKRQVSIEEGEAKARDFNVMFIETSAKAGFNIKALFRKIASALPGMETLSSTKQEDMVDVNLKSSNASGSQQQPQSGGCAC

SEQ ID NO: 18706 - protein, 208 aa, Chrysanthemum coronarium
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFMNTAKWIEEVRTERGSDVIIVLVGNKTDLVDKRQVSIEEGEAKARDFNVMFIETSAKAGFNIKALFRKIASALPGMETLSSTKQEDMVDVNLKSSNASGSQQQAQSGGCAC

SEQ ID NO: 18707 - protein, 208 aa, Cleome spinosa
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRSERGSDVIVVLVGNKTDLVDKRQVSIEEGEAKARELNVMFIETSAKAGFNIKALFRKIAGALPGMETLSSTKQEDMVDVNLKSSNANASQAHQQPGGCSC

SEQ ID NO: 18708 - protein, 208 aa, Taraxacum officinale
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTAKWIEEVRTERGSDVIIVLVGNKTDLVDKRQVSIEEGEAKAREFNVMFIETSAKAGFNIKALFRKIASALPGMETLSSAKQEDMVDVNLKSSNASGSQQQPQSGGCAC

SEQ ID NO: 18709 - protein, 208 aa, Euonymus alatus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVVVGNKTDLVEKRQVSIEEGEAKARELNVMFIETSAKAGFNIKALFRKIAAALPGMETLSSTKQEDMVDVNLKSSNTNASQSQPQSGGCAC

SEQ ID NO: 18710 - protein, 207 aa, Euonymus alatus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVVVGNKTDLVDKRQVSIEEGEAKARELNVMFIETSAKAGFNIKALFRKIAAALPGMETLSSTKQEDMVDVNLKSSNTNASQSPQSGGCAC

SEQ ID NO: 18711 - protein, 207 aa, Euphorbia peplus
  Sequence also found in Organisms: Euphorbia esula
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRTERGSDVIIVLVGNKTDLVDKRQVSIEDGEAKAHSMNVMFIETSAKAGFNIKALFRKIAAALPGMETLSSAKQEDMVDVNLKSSNTNASSSQAQSGCSC

SEQ ID NO: 18712 - protein, 207 aa, Fagopyrum esculentum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTQKWIEEVRTERGSDVIIVLVGNKTDLVDKRQVSIEEGEAKARDLNVMFIETSAKAGFNIKPLFRKIAAALPGMETLSSTKQEDMVDVNLKPDPNSSQSQPQSGGCAC

SEQ ID NO: 18713 - protein, 208 aa, Humulus lupulus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIEEVRTERGSDVIIVLVGNKTDLVEKRQVSIEEGEAKSRELNVMFIETSAKAGFNIKALFRKIAAALPGMETLSSTKQEDMVDVNLMSSNANTSQSQQQSGGCAC

SEQ ID NO: 18714 - protein, 207 aa, Olea europaea
MAPVSALAKYKLVFLGDQSVGKTSIITRFMYDKFDNTYQATIGIDFLSKTMYLEDRTVRLQLWDTAGQERFRSLIPSYIRDSSVAVIVYDVANRQSFLNTSKWIEEVRTERGSDVIIVVVGNKTDLVDKRQVSIEEAEAKARELNVMFIETSAKAGFNIKALFRKIAAALPGMETLSAAKQEDMVDVNLKSSNTNASQSQQSGGCSC

SEQ ID NO: 18715 - protein, 207 aa, Olea europaea
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVVVGNKTDLVDKRQVSIEEAEAKARELNVMFIETSAKAGFNIKALFRKIAAALPGMETLSSAKQEDMVDVNLKSSNTNASQSQPSGGCAC

SEQ ID NO: 18716 - protein, 208 aa, Platanus occidentalis
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVVVGNKTDLVDKRQVSIEEGEAKARDLNVMFIETSAKAGFNIKALFRKIAAALPGMETLSSTKQDDMVDVNLKSTTGSASQSQPQSGGCSC

SEQ ID NO: 18717 - protein, 208 aa, Papaver somniferum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARELNVMFIETSAKAGFNIKALFRKIAAALPGMETLSSTKNEDMVDVNLKSTNASNNQSQPQGGGCAC

SEQ ID NO: 18718 - protein, 208 aa, Tripterygium wilfordii
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARELNVMFIETSAKAGFNIKALFRKIAAALPGMETLSSTKQEDMVDVNLKSSNTNASQSNPESGGCAC

SEQ ID NO: 18719 - protein, 208 aa, Rosmarinus officinalis
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIEEVRTERGSDVIIVLVGNKTDLVDKRQVSIEEAEAKARDFNVMFIETSAKAGFNIKALFRKIAAALPGMETLSSTKQDEMVDVNLKSSNANASQSQQQSGGCAC

SEQ ID NO: 18720 - protein, 207 aa, Ambrosia trifida
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTAKWIEEVRTERGSDVIIVLVGNKTDLVDKRQVSIEEGEAKAREFNVMFIETSAKAGFNIKALFRKIASALPGMETLSSTKQEDMVDVNLKSNASGSQQQPQSGGCAC

SEQ ID NO: 18721 - protein, 207 aa, Ambrosia trifida
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTVKWIEEVRTERGSDVIIVLVGNKTDLVDKRQVSIEEGEAKAREFNVMFIETSAKAGFNIKALFRKIASALPGMETLSSTKQEDMVDVNLKSNASGSQQQPQSGGCAC

SEQ ID NO: 18722 - protein, 208 aa, Antirrhinum majus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVEKRQVSIEEAEAKAHELNVMFIETSAKAGFNIKALFRKIAAALPGMETLSSTKQEDMVDVHLKSSNANAAQSQQQSGGCAC

SEQ ID NO: 18723 - protein, 208 aa, Vaccinium corymbosum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIEEVRTERGSDVIIVLVGNKTDLVDKRQVSIEEAEAKARDMNVMFIETSAKAGFNIKALFRKIAAALPGMETLSSTKQEDMVDVNLKASNPNASQSQQQSGGCAC

SEQ ID NO: 18724 - protein, 208 aa, Chrysanthemum coronarium
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFMNTAKWIEEVRTERGSDVIIVLVGNKTDLVDKRQVSIEEGEAKARDFNVMFIETSAKAGFNIKPLFRKIASALPGMETLSSTKQEDMVDVNLKSSNASGSQQQAQSGGCAC

SEQ ID NO: 18725 - protein, 208 aa, Citrus clementina
  Sequence also found in Organisms: Citrus sinensis
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTTKWVEEVRTERGSDVIIVLVGNKTDLVDKRQVSIEEGEAKARELNVMFIETSAKAGFNIKALFRKIAAALPGMETLSSTKQEDLVDVNLKSSNTNTSQSQPQSGGCAC

SEQ ID NO: 18726 - protein, 208 aa, Cleome gynandra
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRLSFLNTSKWIEEVRTERGSDVIVMLVGNKTDLVDKRQVSIEEGEGKARELDVMFIETSAKAGFNIKALFRKIAAALPGMETLSSTKQEDLVDVNLRSSNTNASQAHQQSGGCSC

SEQ ID NO: 18727 - protein, 208 aa, Cleome gynandra
MAPVSALAKYKLVFLGDQSVGKTSIITRFMYDKFDNTYQATIGIDFLSKTMYLEDRTVRLQLWDTAGQERFRSLIPSYVRDSSVAVIVYDVASRQSFLNTSKWIEEVRTERGSDVIVVLVGNKTDLVDKRQVSIEEAEAKARELNVMFIETSAKAGFNIKALFRKIAAALPGMETLSSTKQEDMVDVNLKSSNANASQTQQQSGGCAC

SEQ ID NO: 18728 - protein, 208 aa, Echinacea purpurea
  Sequence also found in Organisms: Helianthus annuus
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTAKWIEEVRTERGSDVIIVLVGNKTDLVDKRQVSIEEGEAKAREFNVMFIETSAKAGFNIKALFRKIASALPGMETLSSTKQEDMVDVNLKSSNASGSQQQPQSGGCAC

SEQ ID NO: 18729 - protein, 207 aa, Euphorbia peplus
  Sequence also found in Organisms: Euphorbia esula
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIIVLVGNKTDLVEKRQVSIEDGEAKAHELKVMFIETSAKAGFNIKALFRKIAAALPGMETLSSAKQEDMVDVNLKSSNTNASSSQAQSGCSC

SEQ ID NO: 18730 - protein, 207 aa, Euphorbia peplus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIIVLVGNKTDLVEKRQVSIEDGETKAHELKVMFIETSAKAGFNIKALFRKIAAALPGMETLSSAKQEDMVDVNLKSSNTNASSSQAQSGCSC

SEQ ID NO: 18731 - protein, 207 aa, Euphorbia peplus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFVNTSKWIEEVRTERGSDVIIVLVGNKTDLVDKRQVSIEDGEAKAHNMNVMFIETSAKAGFNIKALFRKIAAALPGMETLSSAKQEDMVDVNLKSSNTNASSSQAQSGCSC

SEQ ID NO: 18732 - protein, 207 aa, Fagopyrum esculentum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLNVMFIETSAKAGFNIKPLFRKIAAALPGMETLSSTKQEDMVDVSLKSSSTAPQSQPQAGGCAC

SEQ ID NO: 18733 - protein, 208 aa, Panax ginseng
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVEKRQVSIEEAEEKARDLNVMFIETSAKAGFNIKALFRKIAAALPGMENLSSTKQEDMVDVNLRSTNGTASQSQPQSRGCAC

SEQ ID NO: 18734 - protein, 207 aa, Panax ginseng
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTVKWIEEVRTERGSDVIIVLVGNKTDLVDKRQVSIEEAEAKAHDLNVMFIETSAKAGFNIKALFRKIAAALPGMETLSSAKQEDMVDVNLKPTLSSSQSEPQSGGCAC

SEQ ID NO: 18735 - protein, 207 aa, Humulus lupulus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTLKWIEEVRSERGSDVIIVLVGNKTDLVEKRQVSIEEGEAKARDLNVMFIETSAKAGFNIKALFRKIAAALPGMETLSSTKQEDMVDVNLKSMSASTQSQPQSGGCAC

SEQ ID NO: 18736 - protein, 208 aa, Elaeis guineensis
MAPVSALAKYKLVFLGDQSVGKTSIITRFMYDKFDNTYQATIGIDFLSKTMYLEDRTVRLQLWDTAGQERFRSLIPSYIRDSSVAVIVYDVSSRQSFLNTSKWIEEVRTERGSDVIIVLVGNKTDLVDKRQVSIEEGEAKARELGVMFIETSAKAGFNVKALFRKIAAALPGMETLSSTKQEDMVDVNLKATSANSTQSQGPSGGCNC

SEQ ID NO: 18737 - protein, 208 aa, Elaeis guineensis
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRTERGGDVIIVLVGNKTDLVDKRQVSIEEGEAKAQDLGVMFIETSAKAGFNVKALFRKIAAALPGMENLSSAKQEDMVDVNLKTTTTSASQSQQQSGGCSC

SEQ ID NO: 18738 - protein, 207 aa, Petroselinum crispum
MAPVSALAKYKLVFLGDQSVGKTSIITRFMYDKFDNTYQATIGIDFLSKTMYLEDRTVRLQLWDTAGQERFRSLIPSYIRDSSVAVVVYDVASRQSFLNTVKWIEEVRSERGSDVIIVLVGNKTDLVDKRQVSIEEAEAKAGDQNVMFIETSAKAGFNIKALFRKIAAALPGMETLSSAKQEDMVDVNLKSNANSSQTQSESGGCYC

SEQ ID NO: 18739 - protein, 207 aa, Silene vulgaris
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTIKWIEEVRTERGSDVIIVLVGNKTDLVDKRQVSIEEGEAKAKDLNVMFIETSAKAGFNIKALFRKIAAALPGMETLSSTKQEDMVDVSLKSTSSAPQSGAQSGGCAC

SEQ ID NO: 18740 - protein, 209 aa, Centaurea maculosa
  Sequence also found in Organisms: Cirsium arvense, Carthamus tinctorius
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFMNTAKWIEEVRTERGSDVIIVLVGNKTDLVDKRQVSIEEGEAKAREFNVMFIETSAKAGFNIKALFRKIASALPGMETLSSSTKQEDMVDVNLKSNNSNGSQQQPQSGGCSC

SEQ ID NO: 18741 - protein, 208 aa, Rosmarinus officinalis
MAPVSALAKYKLVFLGDQSVGKTSIITRFMYDKFDNTYQATIGIDFLSKTMYLEERTVRLQRWDTAGQERFRSLIPSYIRDSSVAVIVYDVASRQSFLNTAKWIEEVRTERGSDVIIVLVGNKTDLVDKRQVSIEEAEAKARDFSVMFIETSAKAGFNIKALFRKIAAALPGMETLSSTKQDEMVDVNLKSSNANSSQSQQQSGGCAC

SEQ ID NO: 18742 - protein, 207 aa, Spinacia oleracea
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIEEVRTERGSDVIIVLVGNKTDLVDKRQVSIEEGEVKARDLNVMFIETSAKAGFNIKALFRKIAAALPGMETLSSTKQEDMVDVSLKSTSSAPQSQSQGSGCSC

SEQ ID NO: 18743 - protein, 208 aa, Arabidopsis thaliana
  Sequence also found in Organisms: Brassica napus, Arabidopsis lyrata, Brassica juncea, Brassica oleracea, Raphanus sativus, Eutrema parvulum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTTKWIDEVRTERGSDVIVVLVGNKTDLVDKRQVSIEEAEAKARELNVMFIETSAKAGFNIKALFRKIAAALPGMETLSSTKQEDMVDVNLKSSNANASLAQQQSGGCSC

SEQ ID NO: 18744 - protein, 208 aa, Brassica napus
  Sequence also found in Organisms: Brassica oleracea, Brassica rapa, Raphanus sativus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIDEVRTERGSDVIVVLVGNKTDLVDKRQVSIEEAEAKARELNVMFIETSAKAGFNIKALFRKIAAALPGMETLSSTKQEDMVDVNLKSSNANASSAQQQSGGCSC

SEQ ID NO: 18745 - protein, 208 aa, Fagus grandifolia
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQTFLNTSKWIEEVRTERGSDVIIVLVGNKTDLVEKRQVSIEEGEAKARELNVMFIETSAKAGFNIKALFRKIAAALPGMETLSSTKQEDMVDVNLKSTTSGATQSQPQSGGCYC

SEQ ID NO: 18746 - protein, 208 aa, Vaccinium corymbosum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTVKWIEEVRTERGSDVIIVVVGNKTDLVDKRQVSIEEGEAKARDLNVMFIETSAKAGFNIKALFRKIAAALPGMETLSSTKQEDMVDVNLKSSNPSASQAPSQSGGCAC

SEQ ID NO: 18747 - protein, 208 aa, Cocos nucifera
MAPVSALAKYKLVFLGDQSVGKTSIITRFMYDKFDNTYQATIGIDFLSKTMYLEDRTVRLQLWDTAGQERFRSLIPSYIRDSSVAVIVYDVSSRQSFLNTSKWIEEVRTERGSDVIIVLVGNKTDLVDKRQVSIEEGEAKARELGVMFIETSAKAGFNVKALFRKIAAALPGMETLSLTKQEDMVDVNLKATSVNSSQSQGPSGGCNC

SEQ ID NO: 18748 - protein, 208 aa, Flaveria ramosissima
MAPVSALAKYKLVFLGDQSVGKTSIITRFMYDKFDNTYQATIGIDFLSKTMYLEDRTVRLQLWDTAGQERFRSLIPSYIRDSSVAVIVFDVTSRQSFLNTAKWIEEVRTERGSDVIIVLVGNKTDLVDKRQVSIEEGEAKARDFNVMFIETSAKAGFNIKALFRKIASALPGMETLSSTKPEDMVDVNLKSSNASGSQQQPQSGGCAC

SEQ ID NO: 18749 - protein, 207 aa, Panax ginseng
MAPVSALAKYKLVFLGDQSVGKTSIITRFMYDKFDNTYQATIGIDFLSKTMYLEDRTVRLQLWDTAGQERFRSLIPSYIRDSSVAIIVYDVASRQSFLNTSKWIDEVRSERGSDVIIVLVGNKTDLVDKRQVSIEEAEAKARDLNVMFIETSAKAGFNIKALFRKIAAALPGMETLSSAKQEDMVDVNLKSTTSASQSQPQSGGCAC

SEQ ID NO: 18750 - protein, 208 aa, Quercus alba
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRTERGSDVIIVLVGNKTDLVEKRQVSIEEGEAKARELNVMFIETSAKAGFNIKALFRKIAAALPGMETLSSTKQEDMVDVNLKSTSGGATQSQPQSGGCSC

SEQ ID NO: 18751 - protein, 208 aa, Raphanus sativus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIDEVRTERGSDVIVVLVGNKTDLVDKRQVSIEEAEAKARELNVMFIETSAKAGFNIKALFRKIAAALPGMETLSSTKQEDMVDVNLKSSNANASSGQQQSGGCSC

SEQ ID NO: 18752 - protein, 208 aa, Eutrema halophilum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTTKWIDEVRTERGSDVIVVLVGNKTDLVDKRQVSIEEAEAKARELNVMFIETSAKAGFNIKALFRKIAAALPGMETLSSTKQEDMVDVNLKSSNANASSAQQQSGGCSC

SEQ ID NO: 18753 - protein, 207 aa, Utricularia gibba
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTLKWIEEVRTERGSDVIIVLVGNKTDLVEKRQVSIEEGEAKARDLNVMFIETSAKAGFNVKALFRKIAAALPGMETLSTSKQEDMVDVNLKSSNPNAQSQQQSGGCAC

SEQ ID NO: 18754 - protein, 207 aa, Glycine max
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTAKWIEEVRTERGSDVIIVLVGNKTDLVEKRQVSIEEGEAKARELNVMFIETSAKAGFNIKALFRKIAAALPGMETLSSAKQEDMVDVNLKSTTGSAQSQPQPSGCAC

SEQ ID NO: 18755 - protein, 207 aa, Glycine max
MASVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTAKWIEEVRTERGSDVIIVLVGNKTDLVEKRQVSIEEGEAKARELNVMFIETSAKAGFNIKALFRKIAAALPGMETLSSAKQEDMVDVNLKSTNGSAQSQPQSSGCAC

SEQ ID NO: 18756 - protein, 208 aa, Brassica rapa
MAPVSALAKYKLLFLGDQSVGKTSIITRFMYDKFDNTYQATIGIDFLSKTMYLEDRTVRLQLWDTAGQERFRSLIPSYIRDSSVAVIVYDVASRQSFLNTTKWIDEVRTERGSDVIVVLVGNKTDLVDKRQVSIEEAEAKARELSVMFIETSAKAGFNIKALFRKIAAALPGMETLSSTKQEDMVDVNLKSSNANASLAQQQSGGCSC

SEQ ID NO: 18757 - protein, 207 aa, Bupleurum chinense
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTVKWIEEVRSERGNDVIIVLVGNKTDLVDKRQVSIEEAESKAGDLNVMFIETSAKAGFNIKALFRKIAAALPGMETLSSTKQEDMVDVNLKSTTSSSQSQSESGGCAC

SEQ ID NO: 18758 - protein, 208 aa, Cannabis sativa
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWVEEVRTERGSDVIIVLVGNKTDLVEKRQVSIEEGEAKSSELNVMFIETSAKAGFNIKALFRKIAAALPGMETLSSTKQEDMVDVNLKPSNANTLQSQQQSGGCAC

SEQ ID NO: 18759 - protein, 208 aa, Brassica napus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIDEVRTERGSDVIVVLVGNKTDLVDKRQVSIEEAEAKARELNVIFIETSAKAGFNIKALFRKIAAALPGMETLSSTKQEDMVDVNLKSSNANASSAQQQSGGCSC

SEQ ID NO: 18760 - protein, 207 aa, Daucus carota
MAPVSALAKYKLVFLGDQSVGKTSIITRFMYDKFDNTYQATIGIDFLSKTMYLEDRTVRLQLWDTAGQERFRSLIPSYIRDSSVAVVVYDVASRQSFLNTAKWIEEVRSERGSDVIIVLVGNKTDLVDKRQVSIEEAEAKAGDQNVMFIETSAKAGFNIKALFRKIAAALPGMETLSSAKQEDMVDVNLKSTVSSSQSQGESGGCFC

SEQ ID NO: 18761 - protein, 207 aa, Vigna unguiculata
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTAKWIEEVRTERGSDVIIVLVGNKTDLVEKRQVSIEEGEAKARELNVMFIETSAKAGFNIKALFRKIAAALPGMETLSSAKQEDMVDVNLKSTTGNAQSQPQSSGCAC

SEQ ID NO: 18762 - protein, 208 aa, Cucurbita pepo
MAPTSALAKYKLVFLGDQSVGKTSIITRFMYDKFDNTYQATIGIDFLSKTMYLEDRTVRLQLWDTAGQERFRSLIPSYIRDSSVAVIVFDVASRQTFVNTSKWIEEVRTERGSDVIIVLVGNKTDLVEKRQVSIEEGEAKARELNVMFIETSAKAGFNIKALFRKIAAALPGMETLSSAKQEDMVDVNLKSSGSGAAQSQQQSGGCAC

SEQ ID NO: 18763 - protein, 208 aa, Panax ginseng
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVEKRQVSIEEAEEKARDLNVMFIETSAKVGFNIKALFRKIAAALPGMENLSSTKQEDMVDVNLRSTSGTASQSQPQSRGCAC

SEQ ID NO: 18764 - protein, 207 aa, Glycyrrhiza uralensis
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTTKWIEEVRTERGSDVIIVLVGNKTDLVEKRQVSIEEGEAKAREVNVMFIETSAKAGFNIKALFRKIAAALPGMETLSSAKQEDMVDVNLKSSTGSAQSQPQSSGCSC

SEQ ID NO: 18765 - protein, 208 aa, Momordica charantia
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRTERGSDVIIVLVGNKTDLVEKRQVSIEEGEAKARELNVMFIETSAKAGFNIKALFRKIAAALPGMETLSSTKQEDMVDVNLKSSGSGAAQSQPQSGGCAC

SEQ ID NO: 18766 - protein, 208 aa, Orobanche aegyptiaca
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWVEEVRTERGTDVIIVLVGNKTDLVDKRQVSIDEGEAKSRDLNVLFIETSAKAGFNIKPLFRKIAAALPGMETLSSAKQEDMVDVNIKSTNANESSSQQQSGGCAC

SEQ ID NO: 18767 - protein, 207 aa, Arachis hypogaea
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTAKWIEEVRTERGSDVIIVLVGNKTDLVEKRQVSIEEGEAKARELNVMFIETSAKAGFNIKALFRKIAAALPGMETLSAAKQEDMVDVNLKSSTANPQSQPQSSGCAC

SEQ ID NO: 18768 - protein, 208 aa, Populus trichocarpa
MAPVSALAKYKLVFLGDQSVGKTSIITRFMYDKFDNTYQATIGIDFLSKTMYLEDRTIRLQLWDTAGQERFRSLIPSYIRDSSVAVIVFDVASRQSFLNTSKWIEEVRTERGSDVIIVLVGNKTDLVEKRQVSIEEGEAKARELNVMFIETSAKAGFNIKPLFRKIAAALPGMEALSSTKQEDMVDVNLKSTGGSASQNQAQSGGCAC

SEQ ID NO: 18769 - protein, 207 aa, Prunus persica
  Sequence also found in Organisms: Prunus mume
MAPVSALAKYKLVFLGDQSVGKTSIITRFMYDKFDNTYQATIGIDFLSKTMYLEDRTIRLQLWDTAGQERFRSLIPSYIRDSSVAVIVYDVASRQTFLNTSKWIDEVRTERGSDVIIVLVGNKTDLVDKRQVSVEEGEAKGRDLNVMFIETSAKAGFNIKALFRKIAAALPGMETLSSTKQEDMVDVNLKSTGGSASQSQAQSGCSC

SEQ ID NO: 18770 - protein, 207 aa, Chenopodium quinoa
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIEEVRTERGSDVIIVLVGNKTDLVDKRQVSIEEGEAKARDLNVMFIETSAKAGFNIKALFRKIAAALPGMETLSSTKQEDMVDVSLKSTSSAPQSQSQGSGCAC

SEQ ID NO: 18771 - protein, 208 aa, Raphanus sativus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTTKWIDEVRTERGSDVIVVLVGNKTDLVDKRQVSIEEAEAKARELNVMFIETSAKAGFNIKALFRKIAAALPGMETLFSTKQEDMVDVNLKSSNANASLAQQQSGGCSC

SEQ ID NO: 18772 - protein, 207 aa, Trigonella foenum-graecum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTTKWIEEVRTERGSDVIIVLVGNKTDLVEKRQVSIEDGEAKARELNVMFIETSAKAGFNIKALFRKIAAALPGMETLSSAKQEDMVDVNLKSSSGNAQSQTQSSGCSC

SEQ ID NO: 18773 - protein, 206 aa, Amaranthus tuberculatus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIEEVRTERGSDVIIVLVGNKTDLVDKRQVSIEEGEAKARDLNVMFIETSAKAGFNIKALFRKIAAALPGMETLSSTKQEDMVDVSLKSTSTAPQQQQSGGCAC

SEQ ID NO: 18774 - protein, 208 aa, Brassica rapa
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTTKWIDEVRTERGSDVIVVLVGNKTDLVDKRQVSIEEAEAKARELNVMFIETSAKAGFNIKALFRNIAASLPGMETLSSTKQEDMVDVNLKSSNANASLAQQQSGGCSC

SEQ ID NO: 18775 - protein, 207 aa, Phaseolus vulgaris
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTAKWIEEVRTERGSDVIIVLVGNKTDLVEKRQVSIEEGEAKARELNVMFIETSAKAGFNIKALFRKIAAALPGMEALSSAKQEDMVDVNLVSTTGNAQSQPQSSGCAC

SEQ ID NO: 18776 - protein, 206 aa, Daucus carota
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFINTVKWIEEVRSERGSDVIIVLVGNKTDLVDKRQVSIEEAEAKAGDQNVMFIETSAKAGFNIKALFRKIAAALPGMETLSSAKQEDMVDVNLKSSVSSSQSSESGGCPC

SEQ ID NO: 18777 - protein, 207 aa, Cichorium intybus
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTAKWIEEVRTERGSDVIIVLVGNKTDLVDKRQVSIEEGEAKAREFNVMFIETSAKAGFNIKALFRKIASALPGMENLSTTKQEDMVDVNLKSNNTSGSQQPQSGGCAC

SEQ ID NO: 18778 - protein, 208 aa, Citrus clementina
  Sequence also found in Organisms: Citrus sinensis
MAPVSALAKYKLVFLGDQSVGKTSIITRFMYDKFDNTYQATIGIDFLSKTMYLEDRTVRLQLWDTAGQERFRSLIPSYIRDSSVAVVVYDVASRQSFLNTSKWIDEVRTERGSDVIIVLVGNKTDLVEKRQVSIEEGEAKSRELNVMFIETSAKAGFNIKPLFRKIAAALPGMETLSSTKQEEMVDVNLRSTTGNASQSQSQSSGCSC

SEQ ID NO: 18779 - protein, 208 aa, Flaveria ramosissima
MAPVSALAKYKLVFLGDQSVGKTSIITRFMYYKFDNTYQATIGIDFLSKTMYLEDRTVRLQLWDTAGQERFRSLIPSYIRDSSVAVIVFDVTSRQSFMNTAKWIEEVRTERGSDVIIVLVGNKTDLVDKRQVSIEEGEAKARDFNVMFIETSAKAGFNIKALFRKIASALPGMETLSSTKPEDMVDVNLKSSNASGSQQQPQSGGCAC

SEQ ID NO: 18780 - protein, 207 aa, Ipomoea nil
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTAKWIEEVRTERGSDVIIVLVGNKTDLVEKRQVSIEEGEAKSRELNVMFIETSAKAGFNIKPLFRKIAAALPGMETLSSAKQDDMVDVNLKSSSTNPAQSQQSGGCAC

SEQ ID NO: 18781 - protein, 205 aa, Valeriana officinalis
MAPVSALAKFKLVFLGDQSVGKTSIITRFMYDKFDNTYQATIGIDFLSKTMYLEDRTVRLQLWDTAGQERFRSLIPSYIRDSSVAVIVYDVASRQSFLNTMKWIEGVRTERGSDVIIVLVGNKTDLVDKRQVSIEEGESKARELDVMFIETSAKAGFNIKALFRKIAAALPGMETLSSTKKDDMVDVNLNANASQQQSQSGGCAC

SEQ ID NO: 18782 - protein, 208 aa, Juglans hindsii x Juglans regia
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRESFLNSSKWIEEVRTERGEDVIVVLVGNKTDLVEKRQVSTEEAEAKAHDLNVLFIETSAKAGFNIKALFRKIAAALPGMETLSSAKQEDMVDVNLKSSNASASQSQPQSGGCAC

SEQ ID NO: 18783 - protein, 208 aa, Citrullus lanatus
MAPTSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRTERGSDVIIVLVGNKTDLVEKRQVSIEEGEAKARELNVMFIETSAKAGFNIKALFRKIAAALPGMETLSSTKQEDMVDVNLKSTGSGAAQSQPQSGGCAC

SEQ ID NO: 18784 - protein, 208 aa, Rosmarinus officinalis
MAPVSALAKYKLVFRGDQSVGKTSIITRFMYDKFDNTHQATIGIDFPSKTMYHEDRTVRLQPWDTAGQERFRSLIPSYIRDSSVAVIVYDVASRQSFLNTAKWIEEVRTERGSDVIIVLVGNKTDLVDKRQVSIEEAEAKARDFSVMFIETSAKAGFNIKALFRKIAAALPGMETLSSTKQDEMVDVNLKSSNANSSQSQQQSGGCAC

SEQ ID NO: 18785 - protein, 207 aa, Aquilegia formosa
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDAKSRDDGVMFIETSAKAGFNIKPLFRKIAAALPGMETLSSAKQEDMVDVNLKSTVNSSQPEQQGGGCRC

SEQ ID NO: 18786 - protein, 208 aa, Cucumis sativus
  Sequence also found in Organisms: Cucumis melo
MAPTSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRTERGSDVIIVLVGNKTDLVEKRQVSIEEGEAKARELNVMFIETSAKAGFNIKALFRKIAAALPGMETLSSTKQEDMVDVNLKSTGSGAAQSQPQSSGCAC

SEQ ID NO: 18787 - protein, 207 aa, Lupinus angustifolius
MAAVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTTKWIEEVQTERGGDVIIVLVGNKTDLVEKRQVSIEEGEAKAHELNVMFIETSAKAGFNIKALFRKIAAALPGMETLSSAKQEDMVDVNLKSSSGNAQSQPQSGGCAC

SEQ ID NO: 18788 - protein, 207 aa, Pinus pinaster
  Sequence also found in Organisms: Pinus taeda, Pseudotsuga menziesii, Picea glauca
MATVSPLAKYKLVFLGDQSVGKTSIITRFMYDKFDNTYQATIGIDFLSKTMYLEDRTVRLQLWDTAGQERFRSLIPSYIRDSSVAVIVFDVANRQSFLNTARWIEEVRTERGSDVIIVLVGNKTDLVDKRQVSIEEGDAKAREFGVMFIETSAKAGFNIKALFRKIAAALPGMETLSSTKQEDMVDVNLKPTVNSSQAEQKAGGCSC

SEQ ID NO: 18789 - protein, 207 aa, Elaeis guineensis
MAVVSALAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGEAKAREFGVMFIETSAKAGFNIKPLFRKIAAALPGMETLSSTKQEDMVDVNLKPTVSASQSEQQSGGCSC

SEQ ID NO: 18790 - protein, 208 aa, Populus trichocarpa
MAPVSALAKYKLVFLGDQSVGKTSIITRFMYDKFDNTYQATIGMDFLSKTMYLEDRTIHLQLWDTAGQERFKSLIPSYIRDSSVAVIVFDVASRQSFLNTSKWIEEVRTERGSDVIIVLVGNKTNLVEKRQVSIEEGEAKARDLNVMFIETSAKAGFNIKPLFRKIAAALPGMEALSSTKQEDMVDVNLKSSGGASSQTQPQAGGCAC

SEQ ID NO: 18791 - protein, 207 aa, Silene vulgaris
MAPVSALAKYKLVFLGDQSVGKTSIITRFMYDKFDTTYQATIGIDFLSKTMYLEDRTVRLQLWDTAGQERFRSLIPSYIRDSSVAVIVYDVASRQSFLNTIKWIEEVRTERGSDVIIVLVGNKTDLVDKRQVSIEEGEAKGKELNVMFIETSAKAGFNIKALFRKIAAALPGMETLSSTKQEDMVDVSLKSTSSAPQSGAQSDGCAC

SEQ ID NO: 18792 - protein, 193 aa, Rosmarinus officinalis
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLNVMFIETSAKAGFNIKALFRKIAAALPGMETLSSAKQEDMVDVNLKSSN

SEQ ID NO: 18793 - protein, 206 aa, Glycine max
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIVVLVGNKTDLVDKRQVSTEEGEAKSRELNVMFIEASAKAGFNIKALFRKIAAALPGMETLSTTKQEDMVDVNLRSSGSHDSQPQSGGCSC

SEQ ID NO: 18794 - protein, 207 aa, Abies balsamea
  Sequence also found in Organisms: Cedrus atlantica
MATVSPLAKYKLVFLGDQSVGKTSIITRFMYDKFDNTYQATIGIDFLSKTMYLEDRTVRLQLWDTAGQERFRSLIPSYIRDSSVAVIVYDVANRQSFLNTARWIEEVRTERGSDVIIVLVGNKTDLVDKRQVSIEEGDAKAREFGVMFIETSAKAGFNIKALFRKIAAALPGMETLSSTKQEDMVDVNLKPTVNSSQAEQKAGGCSC

SEQ ID NO: 18795 - protein, 206 aa, Cicer arietinum
  Sequence also found in Organisms: Trifolium pratense
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIVVLVGNKTDLVDKRQVSTEEGEAKSRELNVMFIEASAKAGFNIKALFRKIAAALPGMETLSTTKQEDMVDVNLRSSASHDSQPQSGGCSC

SEQ ID NO: 18796 - protein, 207 aa, Cichorium intybus
MSVVSALAKYKLVFLGDQSVGKTSIITRFMYDKFDTTYQATIGIDFLSKTMYLEDRTVRLQLWDTAGQERFRSLIPSYIRDSSVAVIVYDVANRQSFLNTTKWIEEVRTERGTDVIIVLVGNKTDLVDKRQVSIEEGDGKARELGVMFLETSAKAGFNIKPLFRKIAAALPGMETLSSTKQEDMVDVNLKSSNNASQSDKQGGGCAC

SEQ ID NO: 18797 - protein, 208 aa, Cucurbita pepo
MAPTSALAKYKLVFLGDQSVGKTSIITRFMYDKFDNTYQATIGIDFLSKTMYLEDRTVRLQLWDTAGQERFRSLIPSYIRDSSVAVIVYDVASRQTFVNTSKWIEEVRTERGSDVIIVLVGNKTDLVEKRQVSVEEGEAKARELNVMFIETSAKAGFNIKALFRKIAAALPGMETLSSTKQEDMVDVNLKSSGSGAAQSQPQSGGCAC

SEQ ID NO: 18798 - protein, 207 aa, Euonymus alatus
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGGDVIIVLVGNKTDLVDKRQVSIEEGESKARDSGVMFIETSAKAGFNIKPLFRKIAAALPGMETLSSTKQEDMVDVNLKPSVNSSQTEQQGGGCAC

SEQ ID NO: 18799 - protein, 207 aa, Carica papaya
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDNKAREFGVMFIETSAKAGFNIKPLFRKIAAALPGMETLSSTKQEDMVDVNLKPTVNSSQSEQQGGGCAC

SEQ ID NO: 18800 - protein, 206 aa, Arachis hypogaea
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIIVLVGNKTDLVDKRQVSTEEGEAKSRELNVMFIEASAKAGFNIKALFRKIAAALPGMETLSSSKQEDMVDVNLKSGGGADSQTQEGGCAC

SEQ ID NO: 18801 - protein, 206 aa, Trigonella foenum-graecum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIVVLVGNKTDLVDKRQVSTEEGEAKSRELNVMFIEASAKAGFNIKALFRKIAAALPGMETLSTTKQEDMVDVNLRSSTSHDSQPQSGGCSC

SEQ ID NO: 18802 - protein, 207 aa, Rosmarinus officinalis
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVEKRQVSIEEGDAKAREVGVMFIETSAKAGFNIKPLFRKIAAALPGMETLSSTKQEDMVDVNLKPTTNSSQSEQQGGGCAC

SEQ ID NO: 18803 - protein, 206 aa, Glycine max
MASVSALAKYKLVFLGDQSVGKTSIITRFMYDKFDNTYQATIGIDFLSKTMYLEDRTVRLQLWDTAGQERFRSLIPSYIRDSSVAVIAYDVASRQTFLNTSKWIEEVRSERGSDVIIVLVGNKTDLVDKRQVSTEEGEAKSRELNVMFIEASAKAGFNIKALFRKIAAALPGMETLSSTKQEDMVDVNLRSSGGYQSQPQSGGCAC

SEQ ID NO: 18804 - protein, 207 aa, Arabidopsis lyrata
MASVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEDVRTERGSDVIIVLVGNKTDLVDKRQVSIEEGDNKARDYGVIFIETSAKAGFNIKPLFRKIAAALPGMETLSSTKQEDMVDVNLKTSTNSSQGEQQRGGCSC

SEQ ID NO: 18805 - protein, 206 aa, Phaseolus vulgaris
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIVVLVGNKTDLVDKRQVSTEEGEAKSRELNVMFIEASAKAGFNIKALFRKIAAALPGMETLSATKQEDMVDVNLRSSGNHDSQSQSGGCAC

SEQ ID NO: 18806 - protein, 207 aa, Manihot esculenta
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFVNTSKWIEEVRTERGSDVIIVLVGNKTDLVDKRQVSIEEGDNKAKEVGVMFIETSAKAGFNIKPLFRKIASALPGMETLSSTKQEDMVDVNLKPTVNSSQSEQQGGGCAC

SEQ ID NO: 18807 - protein, 207 aa, Centaurea maculosa
  Sequence also found in Organisms: Cirsium arvense
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGSDVIIVLVGNKTDLVDKRQVSIEEGDGKARELGVMFIETSAKAGFNIKPLFRKIAAALPGMDNLSSTKQEDMVDVNLKSSSNTSQSDKQGGGCAC

SEQ ID NO: 18808 - protein, 207 aa, Chrysanthemum coronarium
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDAKAREYGVMFIETSAKAGFNIKPLFRKIAAALPGMEQLSSTKQEDMVDVNLKSAANTNQSDQQSGGCAC

SEQ ID NO: 18809 - protein, 207 aa, Cirsium arvense
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGSDVIIVLVGNKTDLVDKRQVSIEEGDGKARELGVMFIETSAKAGFNIKPLFRKIAAALPGMDNLSSTKQEDMVDVNLKSSGNTSQSDQQGGGCAC

SEQ ID NO: 18810 - protein, 207 aa, Cirsium arvense
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDGKAREFGVMFIETSAKAGFNIKPLFRKIAAALPGMETLSSTKQEDMVDVNLKSSGNASQSEQQGGGCAC

SEQ ID NO: 18811 - protein, 207 aa, Centaurea maculosa
  Sequence also found in Organisms: Cirsium arvense
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDGKAREFGVMFVETSAKAGFNIKPLFRKIAAALPGMETLSSTKQEDMVDVNLKSSSNPNQSDKQGGGCAC

SEQ ID NO: 18812 - protein, 207 aa, Citrus clementina
  Sequence also found in Organisms: Citrus sinensis
MASVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSRWIEEVRTERGGDVIIVLVGNKTDLVDKRQVSIEEGDGKAKEFGVMFIETSAKAGFNIKPLFRKIAAALPGMETLSSTKQEDMVDVNLKPTVNSSQTEQQGGGCAC

SEQ ID NO: 18813 - protein, 206 aa, Trifolium pratense
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSRWIEEVRSERGSDVIVVLVGNKTDLVDKRQVSTEEGEAKSRELNVMFIEASAKAGFNIKALFRKIAAALPGMETLSTTKQEDMVDVNLRSSASHDSQPQSGGCSC

SEQ ID NO: 18814 - protein, 207 aa, Cynara scolymus
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDGKAREFGVMFVETSAKAGFNIKPLFRKIAAALPGMETLSSTKQEDMVDVNLKSSSNTNQSDQQGGGCAC

SEQ ID NO: 18815 - protein, 207 aa, Cynara scolymus
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDGKAREFGVMFIETSAKAGFNIKPLFRKIAAALPGMETLSSTKQEDMVDVNLKSSGNTSQSEQQGGGCAC

SEQ ID NO: 18816 - protein, 207 aa, Echinacea purpurea
MAGVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDGKAREHGVMFVETSAKAGFNIKPLFRKIAAALPGMETLSSTKQEDMVDVNLKSSSNTNQSNQQGGGCAC

SEQ ID NO: 18817 - protein, 200 aa, Heritiera littoralis
KYKLVFLGDQSVGKTSIITRFMYDKFDNTYRATIGIDFLSKTMYLEDRTVRLQLWDTAGQERFRSLIPSYIRDSSVAVIVYDVASRQSFLNTSKWIEEVRTERGSDVIIVLVGNKTDLVDKRQVSIEEGEAKARDLSVMFIETSAKAGFNIKPLFRKIAAALPGMETLSSTKQEDMVDVNLKSTNTNASQSQQQSGGCAC

SEQ ID NO: 18818 - protein, 206 aa, Lupinus angustifolius
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIVVLVGNKTDLVDKRQVSTEEGEAKSRELNVMFIEASAKAGFNIKALFRKIAAALPGMETLSSTKQEDMVDVNLRSSAGHDSQPQSGGCAC

SEQ ID NO: 18819 - protein, 206 aa, Medicago truncatula
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIVVLVGNKTDLVEKRQVSTEEGEAKSRELNVMFIEASAKAGFNIKALFRKIAAALPGMETLSTTKQEDMVDVNLRSSTSHDSQPQSGGCSC

SEQ ID NO: 18820 - protein, 207 aa, Allium cepa
MAVVSALAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIDEVRTERGGDVIIVLVGNKTDLVDKRQVSIEEGEAKSREHSVMFIETSAKAGFNIKPLFRKIAAALPGMETLSSTKQEDMVDVNLKPTASSSQGQQQSGGCSC

SEQ ID NO: 18821 - protein, 206 aa, Cajanus cajan
MAPVSALAKYKLVFLGDQSVGKTSIITRFMYDKFDNTYQATIGIDFLSKTMYLEDRTVRLQLWDTAGQERFRSLIPSYIRDSSVAVIAYDVASRQTFLNTSKWIEEVRSERGSDVIIVLVGNKTDLVDKRQVSTEEGEAKSRELNVMFIEASAKAGFNIKALFRKIAAALPGMETLSSTKQEDMVDVNLRSSGGHQSQPESGGCAC

SEQ ID NO: 18822 - protein, 205 aa, Raphanus sativus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTTKWIDEVRTERGSDVIVVLVGNKTDLVDKRQVSIEEAEAKARELNVMFIETSAKAGFNIKALFRKIAAALPGMETLSSTKQEDMVDVNLKSSNANASLAQQQSED

SEQ ID NO: 18823 - protein, 207 aa, Carthamus tinctorius
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGSDVIIVLVGNKTDLVDKRQVSIEEGDGKARELGVMFIETSAKAGFNIKPLFRKIAAALPGMDNLSSTKQEDMVDVNLKSSSNTSQSDQQGGGCAC

SEQ ID NO: 18824 - protein, 208 aa, Theobroma cacao
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDNKAREFGVMFIETSAKAGFNIKPLFRKIAAALPGMETLSSTKQEDMVDVNLKPTVNSSQKTEQQGGGCAC

SEQ ID NO: 18825 - protein, 208 aa, Gossypium hirsutum
  Sequence also found in Organisms: Gossypium raimondii
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWVEEVRTERGSDVIIVLVGNKTDLVDKRQVSIEEGDNKAKEFGIMFIETSAKAGFNIKPLFRKIAAALPGMETLSSTKQEDMVDVNLKSSGNSSQNTEQQGGGCAC

SEQ ID NO: 18826 - protein, 208 aa, Echinacea purpurea
MAKPVSALAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDGKAREFGVMFIETSAKAGFNIKPLFRKIAAALPGMETLSSTKQEDMVDVNLKSSGNALHSEQQGGGCAC

SEQ ID NO: 18827 - protein, 206 aa, Cycas rumphii
MATVSPLAKYKLVFLGDQSVGKTSIITRFMYDKFDNTYQATIGIDFLSKTMYLEDRTVRLQLWDTAGQERFRSLIPSYIRDSSVAVIVYDVANRQSFLNTARWIEEVRTERGSDVIIVLVGNKTDLVDKRQVSIEEGDAKSREFGVMFIETSAKAGFNIKALFRKIAAALPGMETLSSTKQEDMVDVNLKPTVNTSQAVQKGGCSC

SEQ ID NO: 18828 - protein, 193 aa, Rosmarinus officinalis
MAPVSALAKYKLVFLGDQSVGKTSIITRFMYDKFDNTYQATIGIDFLSKTMYLEDRTVRLQLWDTAGQERFRSLIPSYIRDSSVAVIVYDVASQQSFLNTLKWIEEVRTERGSDVIIVLVGNKTDLVDKRQVSIEEGEAKARDLNVMFIETSAKAGFNIKALFRKIAAALPGMETLSSAKQEDMVDVNLKSSN

SEQ ID NO: 18829 - protein, 207 aa, Aristolochia fimbriata
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDAKARDFGVMFIETSAKAGFNIKPLFRKIAAALPGMETLSSTKQEEMVDVNLKPTVNASHTEQQSGGCSC

SEQ ID NO: 18830 - protein, 207 aa, Artemisia annua
  Sequence also found in Organisms: Chrysanthemum coronarium
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDAKAREHGVMFVETSAKAGFNIKPLFRKIAAALPGMEQLSSTKQEDMVDVNLKSAANTNQSDQQSGGCAC

SEQ ID NO: 18831 - protein, 206 aa, Phaseolus vulgaris
MAPVSALAKYKLVFLGDQSVGKTSIITRFMYDKFDNTYQATIGIDFLSKTMYLEDRTVRLQLWDTAGQERFRSLIPSYIRDSSVAVIAYDVASRQTFLNTSKWIEEVRSERGSDVIIVLVGNKTDLVDKRQVSTEEGEAKSRELNVMFIEASAKAGFNIKALFRKIAAALPGMETLSSTKQEDMVDVNLRSSAGHDSQPDSGGCAC

SEQ ID NO: 18832 - protein, 207 aa, Cannabis sativa
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGTDVIIVLVGNKTDLVDKRQVSIEEGDAKSREFGVMFIETSAKAGFNIKPLFRKIAAALPGMETLSSTKQEDMVDVNLKPTVNSSQMEQQGGGCSC

SEQ ID NO: 18833 - protein, 207 aa, Chrysanthemum coronarium
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDAKAREFGVMFIETSAKAGFNIKPLFRKIAAALPGMETLSSTKQEDMVDVNLKSSGNASQSEQQGGGCAC

SEQ ID NO: 18834 - protein, 207 aa, Cichorium intybus
MSVVSALAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDGKAREFGVIFIETSAKAGFNIKPLFRKIAAALPGMETLSSTKQEDMVDVNLKSSGNASQSNQQGGGCAC

SEQ ID NO: 18835 - protein, 207 aa, Cichorium intybus
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDGKAREFGVIFIETSAKAGFNIKPLFRKIAAALPGMETLSSTKQEDMVDVNLKSSGNASQSNQQGGGCAC

SEQ ID NO: 18836 - protein, 207 aa, Cirsium arvense
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDGKAREFGVMFVETSAKAGFNIKPLFRKIAAALPGMETLSSTKNEDMVDVNLKSSSNTNQSDQQGGGCAC

SEQ ID NO: 18837 - protein, 206 aa, Trifolium pratense
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSRWIEEVRSERGSDVIVVLVGNKTDLVDKRQVSTEEGEAKSRELNVMFIEASAKAGFNIKALFRKIAAALPGMETLSSTKQEDMVDVNLRSSAGHDSQPQSGGCAC

SEQ ID NO: 18838 - protein, 205 aa, Trifolium pratense
MAPVSALAKYKLVFLGDQSVGKTSIITRFMYDKFDNTYQATIGIDFLSKTMYLEDRTVRLQLWDTAGQERFRSLIPSYIRDSSVAVVVYDVASRQTFLNTTNWIEEVRTERGSDVIIVLVGNKTDLVEKRQVSIEEGEAKARELNVMYIETSAKAGFNIKALFRKIAAALPGMETVSSAKQEGMVDVNLKSSSGNAQAQSSGCSC

SEQ ID NO: 18839 - protein, 207 aa, Gossypium hirsutum
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWMEEVRTERGSDVIIVLVGNKTDLVDKRQVSIEEGDSKARELGVMFIETSAKAGFNIKPLFRKIAAALPGMERLSSTKQDDMVDVNLKSTVNSSQIEQQGGGCAC

SEQ ID NO: 18840 - protein, 208 aa, Gossypium hirsutum
  Sequence also found in Organisms: Gossypium raimondii
MAPISALAKYKLVFLGDQSVGKTSIISRFMYDKFDNNYQATIGIDFLSKTMYLEDRTVRLQLWDTAGQERFRSLIPSYIRDSSVAVIVYDVASRQSFLNTSNWIEEVRAERGSDVIIMLVGNKTDLVDKRQVSVEEGEAKARDINVMFIEASAKAGFNIKALFRKIAAALPGMETLSSTKHEDMVDVNLKSSNSNGSQSQQESGGCAC

SEQ ID NO: 18841 - protein, 207 aa, Euphorbia peplus
  Sequence also found in Organisms: Euphorbia esula
MSTVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDNKAKEFGVMFIETSAKAGFNIKPLFRKIASALPGMETLSSTKQEDMVDVNLKPTVNSSQNEQQGGGCAC

SEQ ID NO: 18842 - protein, 207 aa, Flaveria ramosissima
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDGKAREFGVMFIETSAKAGFNIKPLFRKIAGALPGMETLSSTKQEDMVDVNLKSSGNASQSEQQGGGCAC

SEQ ID NO: 18843 - protein, 207 aa, Humulus lupulus
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGTDVIIVLVGNKTDLVDKRQVSIEEGDAKSREFGVMFIETSAKAGFNIKPLFRKIAAALPGMETLSSTKQEDMVDVNLKPTVNSSQTEQQGGGCSC

SEQ ID NO: 18844 - protein, 206 aa, Mimulus guttatus
MAVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDGKAREFGVMFIETSAKAGFNIKPLFRKIAAALPGMETLSSTNKEDMVDVNLKPTSNSSQMEQQGGGCAC

SEQ ID NO: 18845 - protein, 206 aa, Cajanus cajan
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIVVLVGNKTDLVDKRQVSTEEGEAKSRELNVMFIEASAKAGFNIKALFRKIAAALPGMETLSTSKQEDMVDVNLRSSGGHDSQPQEGGCAC

SEQ ID NO: 18846 - protein, 207 aa, Helianthus annuus
MAGVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDGKAREFGVMFIETSAKAGFNIKPLFRKIAGALPGMETLSSTKQEDMVDVNLKSSGNTSQSEQQGGGCAC

SEQ ID NO: 18847 - protein, 207 aa, Helianthus annuus
MAGVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDGKAREFGVMFIETSAKAGFNIKPLFRKIAAALPGMETISSTKQEDMVDVNLKSSGNASQSEQQGGGCAC

SEQ ID NO: 18848 - protein, 207 aa, Tabernaemontana elegans
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDAKAREVGVMFIETSAKAGFNIKPLFRKIAAALPGMETLSSTKQEDMVDVNLKPTTHSSQTEQQGGGCAC

SEQ ID NO: 18849 - protein, 207 aa, Arabidopsis thaliana
MASVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEDVRTERGSDVIIVLVGNKTDLVDKRQVSIEEGDNKARDYGVIFIETSAKAGFNIKPLFRKIAAALPGMETLSSTKQEDMVDVNLKTSSNSAQGEQQRGGCAC

SEQ ID NO: 18850 - protein, 206 aa, Cicer arietinum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIVVLVGNKTDLVEKRQVSTEEGEAKSRELNVMFIEASAKAGFNIKALFRKIAAALPGMETLSSTKQEDLVDVNLKSSGGHDSQTQSGGCSC

SEQ ID NO: 18851 - protein, 207 aa, Chrysanthemum coronarium
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDAKAREFGVMFIETSAKAGFNIKPLFRKIAAALPGMETLSSTKQEDMVDVNLKSSGNASQLEQQGGGCAC

SEQ ID NO: 18852 - protein, 207 aa, Trifolium pratense
MATVSPLAKYKLVFLGDQSVGKTSIITRFMYDKFDNTYQATIGIDFLSKTMYLEDRTVRLQLWDTAGQERFRSLIPSYIRDSSVAVIVYDVANRQSFLNTNKWVEEVRTERGSDVIIVLVGNKTDLVEKRQVSIEEGEAKSRETGIMFIETSAKAGFNIKPLFRKIAGALPGMETLSSTKNEDMVDVNLKSTVNSSQSDQQGGGCSC

SEQ ID NO: 18853 - protein, 207 aa, Eucalyptus grandis
MANVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEDGDAKAREFGVMFIETSAKAGFNIKPLFRKIAAALPGMETLNSTKQEDMVDVNLKPTVNSSQNENQGGGCPC

SEQ ID NO: 18854 - protein, 207 aa, Gnetum gnemon
MATVSPLAKYKLVFLGDQSVGKTSIITRFMYDKFDNTYQATIGIDFLSKTMYLEDRTVRLQLWDTAGQERFRSLIPSYIRDSSVAVIVYDVANRQSFLNTARWIEEVRTERGSDVIIVLVGNKTDLVDKRQVSIEEGDAKSREYGVMFIETSAKAGFNIKALFRKIAAALPGMETLSSTKQEDMVDVNLKPAANASQGEQKTGGCYC

SEQ ID NO: 18855 - protein, 207 aa, Gossypium raimondii
MATVSPLAKYKLVFLGDQSIGKTSIITRFMYDKFDTTYQATIGIDFLSKTMYLEDRTVRLQLWDTAGQERFRSLIPSYIRDSSVAVIVYDVANRQSFLNTSKWMEEVRTERGSDVIIVLVGNKTDLVDKRQVSIEEGDSKARELGVMFIETSAKAGFNIKPLFRKIAAALPGMERLSSTKQDDMVDVNLKSTVNSSQIEQQGGGCAC

SEQ ID NO: 18856 - protein, 207 aa, Guizotia abyssinica
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDGKAREFGVMFIETSAKAGFNIKPLFRKIAAALPGMETLSSHKTEDMVDVELKSSGNASQSEQQGGGCAC

SEQ ID NO: 18857 - protein, 207 aa, Tropaeolum majus
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWVEEVRTERGSDVIIVLVGNKTDLVEKRQVSIEEGDNRARESGVMFIETSAKAGFNIKPLFRKIAAALPGMETLSSTKQEDMVDVNLKPTVNSSQSEQQGGGCAC

SEQ ID NO: 18858 - protein, 207 aa, Podocarpus macrophillus
MASISPLAKYKLVFLGDQSVGKTSIITRFMYDKFDNTYQATIGIDFLSKTMYLEDRTVRLQLWDTAGQERFRSLIPSYIRDSSVAVIVYDVANRQSFINTSRWIEEVRTERGSDVIIVLVGNKTDLVDKRQVSIEEGDAKGREFGVMFIETSAKAGFNIKALFRKIAAALPGMETLSSTKQEDMVDVNLKPAANASQAEQKAGACSC

SEQ ID NO: 18859 - protein, 207 aa, Populus trichocarpa
MATVSPLAKYKLVFLGDQSVGKTSIITRFMYDKFDTTYQATIGIDFLSKTMYLEDRTIRLQLWDTAGQERFRSLIPSYIRDSSVAVIVYDVANRQSFLNTSKWIEEVRTERGGDVIVVLVGNKTDLVDKRQVSIEEGDGKAREFGVMFIETSAKAGFNIKPLFRKIAAALPGMETLSSTKQEDMVDVNLKPTVNSSQAEQQGGGCAC

SEQ ID NO: 18860 - protein, 207 aa, Rhizophora mangle
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIDEGDNKAREFGVMFIETSAKAGFNVKPLFRKIAAALPGMERLSSAKQEDMVDVNLKPTASSSQTEQQRGGCAC

SEQ ID NO: 18861 - protein, 209 aa, Panicum virgatum
MAPVVSALAKYKLVFLGDQSVGKTSIITRFMYDKFDNTYQATIGIDFLSKTMYLEDRTVRLQLWDTAGQERFRSLIPSYIRDSSVAVVVYDVANRQSFLNTSKWIDEVRTERGGDVIVVLVGNKTDLVDKRQVSTEEGESKSKELNVMFIETSAKAGFNIKPLFRKIAAALPGMETLSAAKQEDMVDVNLKPTSGQSNSQQQAGSGCAC

SEQ ID NO: 18862 - protein, 207 aa, Glycine max
  Sequence also found in Organisms: Phaseolus vulgaris, Lotus japonicus, Cajanus cajan
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNKWVEEVRTERGSDVIIVLVGNKTDLVDKRQVSIEEGDAKSREFGIMFIETSAKAGFNIKPLFRKIAAALPGMETLSSTKQEDMVDVNLKPTVNSSQTEQQGGGCSC

SEQ ID NO: 18863 - protein, 207 aa, Amborella trichopoda
MVTVSPLAKYKLVFLGDQSVGKTSIITRFMYDKFDNTYQATIGIDFLSKTMYLEDRTVRLQLWDTAGQERFRSLIPSYIRDSSVAVIAYDVANRQSFLNTPKWIEEVRTERGSDVIIVLVGNKTDLVDKRQVSVEEGDAKAHDLGVMFIETSAKAGLNIKPLFRKIAAALPGMETLSSTKQEDMVDVNLKTTINASQMEQQPGGCNC

SEQ ID NO: 18864 - protein, 205 aa, Trifolium pratense
MAPVSALAKYKLVFLGDQSVGKTSIITRFMYDKFDNTYQATIGIDFLSKTMYLEDRTIRLQLWDTAGQERFRSLIPSYIRDSTVAVVVYDVASRQTFLNTTNWIEEVRTERGSDVIIVLVGNKTDLVEKRQVSIEEGEAKARELNVMYIETSAKAGFNIKALFRKIAAALPGMETVSSAKQEGMVDVNLKSSSGNAQAQSSGCSC

SEQ ID NO: 18865 - protein, 206 aa, Vigna unguiculata
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTPKWIEEVRSERGSDVIVVLVGNKTDLVDKRQVSTEEGEAKSRELNVMFIEASAKAGFNIKALFRKIAAALPGMETLSTTKQEDMVDVNLRSSGNHDSQSESDGCAC

SEQ ID NO: 18866 - protein, 206 aa, Fagopyrum esculentum
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTQKWIEEVRTERGSDVIIVLVGNKTDLVDKRQVSIEEGEAKARDLNVMFIETSAKAGFNIKPLFRRLLLHYPEWNTSSTKQEDMVDVNLKPDPNSSQSQPQSGGCAC

SEQ ID NO: 18867 - protein, 207 aa, Flaveria ramosissima
MAVVSPLAKYKLVFLGDQSVGKTSIITRFMYDKFDTTYQATIGIDFLSKTMYLEDRTVRLQLWDTAGQERFRSLIPSYVRDSSVAVIVYDVANRQSFLNTAKWIEEVRTERGTDVIIVLVGNKTDLVDKRQVSIEEGDGKAREFGVMFIETSAKAGFNIKPLFRKIAGALPGMETLSSTKQEDMVDVNLKSSGNASQSEQKGGGCAC

SEQ ID NO: 18868 - protein, 207 aa, Panax ginseng
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWVEEVRTERGSDVIIVLVGNKTDLVDKRQVSIEEGDAKARESGIMFIETSAKAGFNIKPLFRKIAAALPGMETLSSTRQEDMVDVNLKPTINSSQTEQQGGGCAC

SEQ ID NO: 18869 - protein, 206 aa, Lotus japonicus
MAPVSALAKYKQVFLGDQSVGKTSIITRFMYDKFDNTYQATIGIDFLSKTMYLEDRTVRLQLWDTAGQERFRSLIPSYIRDSSVAVIVYDIASRQTFLNTSKWIEEVRSERGSDVIIVLVGNKTDLVEKRQVSTEEAEAKARELNVMFIEASAKAGFNIKALFRKIAAALPGMETLSTTKQEDMVDVNLRSSGSNESNPQSGGCAC

SEQ ID NO: 18870 - protein, 204 aa, Lupinus angustifolius
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTLKWIEEVRSERGSDVIVVLVGNKTDLVDKRQVSTEEGETKARELNVMFIEASAKAGFNIKALFRKIAAALPGMETLSSTKQEELVDVNLSSAGRDSQSSGGCAC

SEQ ID NO: 18871 - protein, 207 aa, Nicotiana benthamiana
MAAVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGETKAREFNVMFIETSAKAGFNIKPLFRKIAAALPGMEALSSTKQEDMVDVNLKPTSSSSHTEQQGGGCAC

SEQ ID NO: 18872 - protein, 207 aa, Nicotiana benthamiana
MAAVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGETKAREFNVMFIETSAKAGFNIKPLFRKIAAALPGMEALSSTKQEDMVDVNLKPTSSSSHTEQQGGGCTC

SEQ ID NO: 18873 - protein, 207 aa, Phalaenopsis aphrodite
MAVVSALAKYKLVFLGDQSVGKTSIITRFMYDKFDTTYQATIGIDFLSKTMYLEDRTIRLQLWDTAGQERFRSLIPSYIRDSSVAVIVYDVANRQSFLNTSKWIEEVRTERGGDVIIVLVGNKTDLVDQRQVSIEEGEGKSRELGVMFIETSAKAGFNIKPLFRKIAAALPGMENLSSTKQEDMVDVNLKPTVSSSHTEQQSGGCAC

SEQ ID NO: 18874 - protein, 207 aa, Triphysaria pusilla
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDAKAREFGVMFIETSAKAGFNIKPLFRKIAAALPGMETLSSTKNEDMVDVNLKPSSNASHMEQQGGGCAC

SEQ ID NO: 18875 - protein, 209 aa, Setaria italica
MAPVVSALAKYKLVFLGDQSVGKTSIITRFMYDKFDTTYQATIGIDFLSKTMYLEDRTVRLQLWDTAGQERFRSLIPSYIRDSSVAVVVYDVSNRQSFLNTSKWIDEVRTERGGDVIVVLVGNKTDLVDKRQVSTEEGESKSKELNVMFIETSAKAGFNIKPLFRKIAAALPGMETLSSAKQEDMVDVNLKPTSSQSNSQQQAGSGCAC

SEQ ID NO: 18876 - protein, 206 aa, Lactuca sativa
MSVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDGKAREFGVMFIETSAKAGFNIKPLFRKIAAALPGMDTMSSTKQEDMVDVNLKSSGNASHSDQGGGCAC

SEQ ID NO: 18877 - protein, 207 aa, Spinacia oleracea
MAVVSPLAKYKLVFLGDQSVGKTSIITRFMYDKFDTTYQATIGIDFLSKTMYLEDRTVRLQLWDTAGQERFRSLIPSYIRDSSVAVIVYDVSNRQSFLSTSKWIEEVRTERGGDVIIVLVGNKTDLVDKRQVSIEEGDSKARDAGVIFLETSAKAGFNIKPLFRKIASSLPGMETLSSARQEDMVDVNLKPHNNSSQSEQQGGGCAC

SEQ ID NO: 18878 - protein, 206 aa, Artemisia annua
MPPVSALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVLVGNKTDLVDKRQVSVEEGEAKANELKVMFIETSAKAGFNIKALFRKIAAALPGMETLSSTKHEEMVDVNLKSSSASSSQPESGGCAC

SEQ ID NO: 18879 - protein, 207 aa, Brassica juncea
MAAVTPLAKYKLVFLGDQSVGKTSIITRFMYDKFDTTYQATIGIDFLSKTMYLEDRTLRLQLWDTAGQERFRSLIPSYIRDSSVAVIVYDVANRQSFLNTSKWIEDVRTERGNDVIIVLVGNKTDLVDKRQVSIEEGDNKARDFGVIFIETSAKAGFNIKPLFRKISAALPGMDTLSSAKQGDMVDVNLKSSNHSSQAEQQSGGCSC

SEQ ID NO: 18880 - protein, 206 aa, Centaurea maculosa
MAPVSALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVLVGNKTDLVDKRQVSVEEGEAKAGELKVMFIETSAKAGFNIKALFRKIAAALPGMETLSSTKHEEMVDVNLKSSSVTSSQPASGGCAC

SEQ ID NO: 18881 - protein, 206 aa, Centaurea maculosa
  Sequence also found in Organisms: Cirsium arvense
MAPVSALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVLVGNKTDLVDKRQVSVEEGEAKAVELKVMFIETSAKAGFNIKALFRKIAAALPGMETLSSTKHEEMVDVNLKSSSVTSSQPASGGCAC

SEQ ID NO: 18882 - protein, 207 aa, Cephalotaxus harringtonia
  Sequence also found in Organisms: Sequoia sempervirens
MATVSPLAKYKLVFLGDQSVGKTSIITRFMYDKFDNTYQATIGIDFLSKTMYLEDRTVRLQLWDTAGQERFRSLIPSYIRDSSVAVIVYDVSNRQSFLNTARWIEEVRTERGSDVIIVLVGNKTDLVDKRQVSIEEGDAKSREFGVMFIETSAKAGFNIKALFRKIAAALPGMEALSSTKQEDMVDVNLKPTVSASQAEKKAGGCSC

SEQ ID NO: 18883 - protein, 206 aa, Chrysanthemum coronarium
MPPVSALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVLVGNKTDLVDKRQVSVEEGEAKATELKVMFIETSAKAGFNIKALFRKIAAALPGMETLSSTKHEEMVDVNLKSSSASSSQPASGGCAC

SEQ ID NO: 18884 - protein, 206 aa, Chrysanthemum coronarium
MPPVSALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVLVGNKTDLVDKRQVSVEEGEAKATELKVMFIETSAKAGFNIKALFRKIAAALPGMETLSSTKHEEMVDVNLKSSSASSSQPESGGCAC

SEQ ID NO: 18885 - protein, 206 aa, Chrysanthemum coronarium
MPPVSALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVLVGNKTDLVDKRQVSVEEGEAKATELKVMFIETSAKAGFNIKALFRKIAAALPGMETLSSTKHEEMVDVNLKSSSAGSSQPESGGCAC

SEQ ID NO: 18886 - protein, 207 aa, Vitis vinifera
MAVVSPLAKYKLVFLGDQSVGKTSIITRFMYDKFDATYQATIGIDFLSKTMYLEDRTIRLQLWDTAGQERFRSLIPSYIRDSSVAVIVYDVGNRQSFLNTSKWIEEVRTERGTDVIIVLVGNKTDLVDKRQVSIEEGDTKSRDFGVMFIETSAKAGFNIKPLFRKIASALPGMETLSSTKQEDMVDVNLKPSVNSSQTEQQGGGCAC

SEQ ID NO: 18887 - protein, 207 aa, Lupinus angustifolius
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWVEEVRQERGSDVIIVLVGNKTDLVDKRQVSIEEGDAKSREFGIMFIETSAKAGFNIKPLFRKIAAALPGMETLSSTKQEDMVDVNLKPTVNSSNSEQQGGGCAC

SEQ ID NO: 18888 - protein, 207 aa, Ananas comosus
MAVVSALAKYKLVFLGDQSVGKTSIITRFMYDKFDTTYQATIGIDFLSKTMYLEDRTVRLQLWDTAGQERFRSLIPSYIRDSSVAVIVYDVSNRQSFLNTTNWIEEVRTERGGDVIIVLVGNKTDLVDKRQVSTEEGEAKAREFGVMFIETSAKAGLNIKPLFRKIAAALPGMETLSSAKQEDMVDVNLKPTVSSSQTVQQSGGCAC

SEQ ID NO: 18889 - protein, 206 aa, Pteridium aquilinum
MATVSPLAKYKLVFLGDQSVGKTSIITRFMYDKFDNTYQATIGIDFLSKTMYLEDRTVRLQLWDTAGQERFRSLIPSYIRDSSVAVIVYDVANRQSFLNTARWVEEVRTERGSDVIIVLVGNKTDLVDKRQVSIEEGDAKSREFGVMFIETSAKAGFNIKALFRKIAAALPGMEALSTKQDDMVDVNLKSTTATSQSAQKAGGCAC

SEQ ID NO: 18890 - protein, 206 aa, Carthamus tinctorius
MAPVSALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVLVGNKTDLVDKRQVSVEEGEAKAGELKVMFIETSAKAGFNIKALFRKIAAALPGMETLSSTKHEEMVDVNLKSSSVTSSQPESGGCAC

SEQ ID NO: 18891 - protein, 207 aa, Solanum phureja
MAAVSPLAKYKLVFLGDQSVGKTSIITRFMYDKFDTTYQATIGIDFLSKTMYLEDRTVRLQLWDTAGQERFRSLIPSYIRDSSVAVIVFDVANRQSFLNTSKWIEEVRTERGTDVIIVLVGNKTDLVEKRQVSIEEGETKAREFNVMFIETSAKAGFNIKPLFRKIAAALPGMEALSSTKQEDMVDVNLKPTTSSSNAEQQGGGCAC

SEQ ID NO: 18892 - protein, 207 aa, Taxus baccata
MATVSPLAKYKLVFLGDQSVGKTSIITRFMYDKFDNTYQATIGIDFLSKTMYLEDRTVRLQLWDTAGQERFRSLIPSYIRDSSVAVIVYDVSNRQSFLNTARWIEEVRTERGSDVIIVLVGNKTDLVDKRQVSIEEGDAKSREFGVMFIETSAKAGFNIKALFRKIAAALPGMEALSSTKQEDMVDVNLKPTVSASQADKKAGGCSC

SEQ ID NO: 18893 - protein, 207 aa, Solanum lycopersicum
MAAVSPLAKYKLVFLGDQSVGKTSIITRFMYDKFDTTYQATIGIDFLSKTMYLEDRTVRLQLWDTAGQERFRSLIPSYIRDSSVAVIVFDVANRQSFLNTSKWIEEVRTERGTDVIIVLVGNKTDLVEKRQVSIEEGESKAREFNVMFIETSAKAGFNIKPLFRKIAAALPGMEALSSTKQEDMVDVNLKPTTSSSNAEQQGGGCAC

SEQ ID NO: 18894 - protein, 211 aa, Cynara scolymus
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFMNTAKWIEEVRTERGSDVIIVLVGNKTDLVDKRQVSIEEGEAKARDFNVMFIETSAKAGFNIKALFRKIASALPGMEALSSSTKQEDMVDVNLKSSNFSGSQQHPSLEDAHADG

SEQ ID NO: 18895 - protein, 213 aa, Flaveria ramosissima
MAPVSALAKYKLVFLGDQSVGKTSIITRFMYDKFDNTYQATIGIDFLSKTMYLEDRTVRLQLWDTAGQERFRSLIPSYIRDSSVAVIVFDVTSRQSFMNTAKWIEEVRTERGSDVIIVLVGNKTDLVDKRQVSIEEGEAKAHEFNVMFIETSAKAGFNIKALFRKIASALPGMETLSSTKPEDMVDVNLKSSNASGSQQQPQSEGVHADVSDS

SEQ ID NO: 18896 - protein, 209 aa, Sorghum bicolor
MAPAVVSALAKYKLVFLGDQSVGKTSIITRFMYDKFDTTYQATIGIDFLSKTMYLEDRTVRLQLWDTAGQERFRSLIPSYIRDSSVAVVVYDVSNRQSFLNTSKWIDEVRTERGGDVIIVLVGNKTDLVDKRQVSTEEGESKAKELNVMFIETSAKAGFNIKPLFRKIAAALPGMETLSAKSEDMVDVNLKPTSSQSNSQQQAGSGCAC

SEQ ID NO: 18897 - protein, 208 aa, Gossypium hirsutum
  Sequence also found in Organisms: Gossypium raimondii
MATVSPLAKYKLVFLGDQSVGKTSIITRFMYDKFDTTYQATIGIDFLSKTMYLEDRTVRLQLWDTAGQERFRSLIPSYIRDSSVAVIAYDVANRQSFLNTSKWIEEVRTERGTDVIIVLVGNKTDLVDKRQVSIEEGDSKARELGVMFIETSAKAGFNIKPLFRKIAAALPGMGSLSSTKQDDMVDVNLKSSGNSYQNPDQQGGGCAC

SEQ ID NO: 18898 - protein, 207 aa, Conyza canadensis
MAVISPLAKYKLGFLGDQSVGKTSIITRFMYDKFDTTYQATIGIDFLSKTMYLEDRTVRLQLWDTAGQERFRSLIPSYIRDSSVAVIVYDVANRQSFLNTSKWVEEVRTERGSDVIIVLVGNKTDLVDKRQVSIEEGDAKAREHGVMFVETSAKAGFNIKPLFRKIAAALPGMETLSSTKQEDMVDVNLKPSSNTNQSDQQGGGCAC

SEQ ID NO: 18899 - protein, 207 aa, Rosmarinus officinalis
MAVVSPLAKYKLVFLGDQSVGKTSIITRFMYDKFDTTYQATIGIDFLSKTMYLEDRTVRLQLWDTAGQERFRSLIPSYIRDSSVAVIAYDVANRQSFLNTSKWIEEVRTERGGDVIIVLVGNKTDLVDKRQVSIEEGDIKAREFGVMFVETSAKAGFNIKPLFRKIAAALPGMEALSSAKHEDMVDVNLKPTANGGQNEQQGGGCAC

SEQ ID NO: 18900 - protein, 207 aa, Glycine max
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNKWVEEVRTERGSDVIIVLVGNKTDLVEKRQVSIEEGDAKSREFGIMFIETSAKAGFNIKPLFRKIAAALPGMESLSSTKQEDMVDVNLKPTVNSSQTEQQGGGCSC

SEQ ID NO: 18901 - protein, 207 aa, Glycine max
MATVSPLAKYKLVFLGDQSVGKTSIITRFMYDKFDINYQATIGIDFLSKTMYLEDRTVRLQLWDTAGQERFRSLIPSYIRDSSVAVVVYDVANRQSFLNTNKWIEEVRTERGSDVIIVLVGNKTDLVEKRQVSIEEGDAKSRESGIMFIETSAKAGFNIKPLFRKIAAALPGMETLSSTKQEDMVDVNLKPTVNSSQAEQQGGGCSC

SEQ ID NO: 18902 - protein, 207 aa, Ambrosia trifida
MAAVSPLAKYKLVFLGDQSVGKTSIITRFMYDKFDTTYQATIGIDFLSKTMYLEDRTVRLQLWDTAGQERFRSLIPSYIRDSSVAVVVYDVANRQSFLNTAKWIEEVRTERGTDVIIVLVGNKTDLVDKRQVSIEEGDGKAREFGVMFIETSAKAGFNIKPLFRKIAGALPGMETFTSTKQEDMVDVNLKSSGSTSQSEQQGGGCPC

SEQ ID NO: 18903 - protein, 207 aa, Musa acuminata
MAVVSALAKYKLVFLGDQSVGKTSIITRFMYDKFDTTYQATIGIDFLSKTMYLEDRTVRLQLWDTAGQERFRSLIPSYIRDSSVAVIVYDVSNRQSFLSTSKWIEEVHTERGGDVIIVLVGNKTDLVDKRQVSTEEGEAKAREFGVMFIETSAKAGFNIKPLFRKIAASLPGMETLASAKQEDMVDVNLKPTVSSPETQQQSGGCSC

SEQ ID NO: 18904 - protein, 207 aa, Cicer arietinum
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNRWVEEVRTERGSDVVIVLVGNKTDLVEKRQVSIEEGDAKSRESGIMFIETSAKAGFNIKPLFRKIAAALPGMETLSSTKQEDMVDVNLKSTTNSSQTEQQGGGCSC

SEQ ID NO: 18905 - protein, 207 aa, Cicer arietinum
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNKWVEEVRQERGSDVIIVLVGNKTDLVDKRQVSIEEGDAKSREFGIMFIETSAKAGFNIKPLFRKIASALPGMETLSSTKQEDMVDVNLKPTVNSSQTEQQGGGCSC

SEQ ID NO: 18906 - protein, 206 aa, Chrysanthemum coronarium
MPPVSALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVLVGNKTDLVDKRQVSVEEGEAKATELKVMFIETSAKAGFNIKALFRKIAAALPGVETLSSTKHEEMVDVNLKSSSASSSQPESGGCAC

SEQ ID NO: 18907 - protein, 207 aa, Trifolium pratense
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNKWVEEVRTERGSDVIIVLVGNKTDLVEKRQVSIEEGEAKSRETGIMFIETSAKAGFNIKPLFRKIAGALPGMETLSSTKNDDMVDVNLKSTVNSSQADQQGGGCSC

SEQ ID NO: 18908 - protein, 207 aa, Trifolium pratense
MATVSPLAKYKLVFLGDQSVGKTSIITRFMYDKFDNTYQATIGIDFLSKTMYLEDRTVRLQLWDTAGQERFRSLIPSYIRDSSVAVIVYDVANRQSFLNTNKWVEEVRTERGSDVIIVLVGNKTDLVEKRQVSIEEGDAKSRETGIMFIETSAKAGFNIKPLFRKIAGALPGMETLSSTKNDDMVDVNLKSTVNSSQADQQGGGCSC

SEQ ID NO: 18909 - protein, 206 aa, Cynara scolymus
MAPVSALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVLVGNKTDLVDKRQVSVEEGETRASELKVMFIETSAKAGFNIKALFRKIAVALPGMETLSSTKHEEMVDVNLKSSNMTSSQPESGGCAC

SEQ ID NO: 18910 - protein, 207 aa, Nicotiana benthamiana
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIDEVRTERGSDVIIVLVGNKTDLVDKRQVSTEEGDAKAREFGVMYIETSAKAGFNIKPLFRKIAAALPGMETLSSTKGEDMVDVNLKPTTNTSQNEQQGGGCAC

SEQ ID NO: 18911 - protein, 207 aa, Capsicum annuum
MAAVSPLAKYKLVFLGDQSVGKTSIITRFMYDKFDTTYQATIGIDFLSKTMYLEDRTVRLQLWDTAGQERFRSLIPSYIRDSSVAVIVFDVVNRQSFLNTSKWIEEVRTERGTDVIIVLVGNKTDLVEKRQVSIEEGETKAREFNVMFIETSAKAGFNIKPLFRKIAAALPGMESLSSTKQEDMVDVNLKPTSSSSHAEQQGGGCAC

SEQ ID NO: 18912 - protein, 207 aa, Cajanus cajan
MATVSPLAKYKLVFLGDQSVGKTSIITRFMYDKFDTTYQATIGIDFLSKTMYLEDRTVRLQLWDTAGQERFRSLIPSYIRDSSVAIVVYDVANRQSFLNTNKWIEEVRTERGSDVIIVLVGNKTDLVEKRQVSIEEGDAKSRESGIMFIETSAKAGFNIKPLFRKIAAALPGMETLSSSKQEDMVDVNLKPTVNSSQTEQQGGGCSC

SEQ ID NO: 18913 - protein, 206 aa, Prunus mume
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNKWIEEVRTERGTDVIIVLVGNKTDLVDKRQVSIEEGDSKSREFGVMFIETSAKAGFNIKPLFRKIAAALPGMEALSSTKQEDMVDVNLKPTINSSHTEQQGGCAC

SEQ ID NO: 18914 - protein, 206 aa, Prunus persica
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNKWIEEVRTERGTDVIIVLVGNKTDLVDKRQVSIEEGDSKSREFGVMFIETSAKAGFNIKPLFRKIAAALPGMEALSSTKQEDMVDVNLKPTTNSSHTEQQGGCAC

SEQ ID NO: 18915 - protein, 207 aa, Sciadopitys verticillata
MATVSPLAKYKLVFLGDQSVGKTSIITRFMYDKFDNTYQATIGIDFLSKTMYLEDRTVRLQLWDTAGQERFRSLIPSYIRDSSVAVIVYDVSNRQSFLNTARWIEEVRTERGSDVIIVLVGNKTDLVDKRQVSIEEGDAKSREFGVMFIETSAKAGFNIKALFRKIAAALPGMEALSSTKQEDMVDVNLKPAVSVSQQENKAGGCAC

SEQ ID NO: 18916 - protein, 206 aa, Senecio madagascariensis
MPPVSALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVLVGNKTDLVDKRQVSVEEGEAKASELKVMFIETSAKAGFNIKALFRKIAAALPGMETLSATKHEEMVDVNLKSSNMTSSQPESGGCAC

SEQ ID NO: 18917 - protein, 207 aa, Ambrosia trifida
MAKPVSALAKYKLVFLGDQSVGKTSIITRFMYDKFDTSYQATIGIDFLSKTMYLEDRTVRLQLWDTAGQERFRSLIPSYIRDSSVAVIIYDVASRQTFLNTIKWIEEVRAERGSDVIIVLVGNKTDLVEKRQVSVEEGEAKANELNVMFIETSAKAGFNIKALFRKIAAALPGMETLSSTKHEELVDVNLKSSSVTSSQPESGGCSC

SEQ ID NO: 18918 - protein, 204 aa, Artemisia annua
MSPLAKYKLVFLGDQSVGKTSIITRFMYDKFDTTYQATIGIDFLSKTMYLEDTTVRLQLWDTAGQERFRSLIPSYIRDSSVAVIVYDVANRQSFLNTAKWVEEVRTERGTDVIIVLVGNKTDLVDKRQVSIEEGDAKAREFGVMFIETSAKAGFNIKPLFRKIAAALPGMETLSSTKQEDMVDVNLKSSGNASQSEQQGGGCAC

SEQ ID NO: 18919 - protein, 207 aa, Brassica napus
  Sequence also found in Organisms: Brassica oleracea, Brassica rapa
MAAVTPLAKFKLVFLGDQSVGKTSIITRFMYDKFDTTYQATIGIDFLSKTMYLEDRTLRLQLWDTAGQERFRSLIPSYIRDSSVAVIVYDVANRQSFLNTSKWVEDVRTERGNDVIIVLVGNKTDLVDKRQVSIEEGDNKARDFGVIFIETSAKAGFNIKPLFRKISAALPGMDTLSSAKQGDMVDVNLKSSNHSSQAEQQSGGCSC

SEQ ID NO: 18920 - protein, 207 aa, Musa acuminata
MAVVSALAKYKLVFLGDQSVGKTSIITRFMYDKFDTTYQATIGIDFLSKTMYLEDRTVRLQLWDTAGQERFRSLIPSYIRDSSVAVIAYDVSNRQSFLNTSKWIEEVRTERGGDVIIVLVGNKTDLVEKRQVSTEDGETKSREFGVMFIETSAKAGFNIKPLFRKIAASLPGMETLASTKQEDMVDVNLKSTVSSTQTQQQSGGCSC

SEQ ID NO: 18921 - protein, 207 aa, Cedrus atlantica
MATVSPLAKYKLVFLGDQSVGKTSIITRFMYDKFDNTYQATIGIDFLSKTMYLEDRTVRLQLWDTAGQERFRSLIPSYIRDSSVAVIVYDVANRQSFLNTARWIEEVRTERGSDVIIVLVGNKTDLVDKRQVSIEEGDAKSRELGVMFIETSAKAGFNIKALFRKIAAALPGMEALSSTNKEDMVDVNLKTTVPAIQAEKKAGGCYC

SEQ ID NO: 18922 - protein, 207 aa, Centaurea maculosa
MAVVSPLAKFKLVFLGDQSVGKTSIITRFMYDKFDTTYQATIGIDFLSKTMYLEDRTVRLQLWDTAGQERFKSLIPSYIRDSSVAVVVYDVANRQSFLNTAKWIEEVRTERGTDVIIVLGGNKTDLVDKRQVSIEEGDGKAREFGVMFIETSAKAGFNIKSLFRKIAAALPGMETLSSTKQEDMVDVNLKSSGNASKSEKQGGVCAC

SEQ ID NO: 18923 - protein, 207 aa, Cucumis sativus
MATVSPLAKYKLVFLGDQSVGKTSIITRFMYDKFDTTYQATIGIDFLSKTMYLEDRTIRLQLWDTAGQERFRSLIPSYIRDSSVAVVVYDVSNRQSFLNTTKWIEEVRTERGSDVIIVLVGNKTDLVEKRQVSIEEGDAKSREFGVMFIETSAKAGFNIKPLFRKIAAALPGMETLSSTRQEDMVDVNLKPAVNSSQSEQQGGGCAC

SEQ ID NO: 18924 - protein, 207 aa, Distylium racemosum
MATVSPLAKYKLVFLGDQSVGKTSIITRFMYDKFDNTYQATIGIDFLSKTMYLEDRTVRLQLWDTAGQERFRSLIPSYIRDSSVAVIVYDVSNRQSFLNTARWIEEVRTERGSDVIIVLVGNKTDLVDKRQVSIEEGDAKSREFGVMFIETSAKAGFNIKALFRKIAAALPGMEALSSTKQEDMVDVNLKPSVTVSQADNKSGGCAC

SEQ ID NO: 18925 - protein, 206 aa, Flaveria ramosissima
MAPVSALAKYKLVFLGDQSVGKTSIITRFMYDKFDTSYQATIGIDFLSKTMYLEDRTVRLQLWDTAGQERFRSLIPSYIRDSSVAVIIYDVASRQTFLNTIKWIEEVRAERGSDVIIVLVGNKTDLVEKRQVSVEEGEAKAAELNVMFIETSAKAGFNIKALFRKIAAALPGMETLSSTKHEELVDVNLKSSSVTSSQPESGGCAC

SEQ ID NO: 18926 - protein, 206 aa, Quercus alba
MAAVSPLAKYKLVFLGDQSVGKTSIITRFMYDKFDATYQATIGIDFLSKTMYLEDRTVRLQLWDTAGQERFRSLIPSYIRDSSVAVIVYDVANRQSFLNINRWVEEVRTERGSDVIIVLVGNKTDLVDKRQVSIEEGDAKSREFGIMFIETSAKAGFNIKPLFRKIAAALPGMETLSSTKQEDMVDINLKPTANSSHQEQQGGCWC

SEQ ID NO: 18927 - protein, 207 aa, Allium cepa
MAVVSALAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWVDEVRTERGGDVIIVLVGNKTDLVDKRQVSIEEGEAKSREHSVMFIETSAKAGFNIKPLFRKIASALPGMETLTSTKQEDMVDVNLKPTVSSSNAQQQSGGCAC

SEQ ID NO: 18928 - protein, 207 aa, Pseudotsuga menziesii
MATVSPLAKYKLVFLGDQSVGKTSIITRFMYDKFDNTYQATIGIDFLSKTMYLEDRTVRLQLWDTAGQERFRSLIPSYIRDSSVAVIVYDVANRQSFLNTARWIEEVRTERGSDVIIVLVGNKTDLVDKRQVSIEEGDAKSRELGVMFIETSAKAGFNIKALFRKIAAALPGMEALSSTHKEDMVDVNLKSTVPATEAEKKAGGCYC

SEQ ID NO: 18929 - protein, 207 aa, Solanum lycopersicum
  Sequence also found in Organisms: Solanum phureja
MSVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVEKRQVSTEEGDAKSREFGVMYVETSAKAGFNIKPLFRKIAAALPGMETLSSTKQEDMVDVNLKPTTNTSQSEQQGGGCAC

SEQ ID NO: 18930 - protein, 207 aa, Fragaria vesca
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNKWIEEVRTERGTDVIIVLVGNKTDLVDKRQVSIEEGDSKSREFGVMFIETSAKAGFNIKPLFRKIASSLPGMETLSSTKQEDMVDVNLKPTVNSSNADQQGGGCAC

SEQ ID NO: 18931 - protein, 207 aa, Eutrema halophilum
MASVSPLAKYKLVFLGDQSVGKTSIITRFMYDKFDTTYQATIGIDFLSKTMYLEDRTLRLQLWDTAGQERFRSLIPSYIRDSSVAVIVYDVANRQSFLNTSKWIEDVRTERGSDVIIVLVGNKTDLVDKRQVSIEEGDNKARDFGVIFMETSAKAGFNIKPLFRKISASLPGMESLSSTKQDDMVDVNLKPSTNSSQAEQQRGGCSC

SEQ ID NO: 18932 - protein, 207 aa, Trigonella foenum-graecum
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNKWVEEVRQERGSDVIIVLVGNKTDLVEKRQVSIEEGDAKSKEFGIMFIETSAKAGFNIKPLFRKIASALPGMETLSSTKQEDMVDVNLKPTVNSSNTEQQGGGCSC

SEQ ID NO: 18933 - protein, 207 aa, Citrullus lanatus
MATVSPLAKYKLVFLGDQSVGKTSIITRFMYDKFDTTYQATIGIDFLSKTMYLEDRTIRLQLWDTAGQERFRSLIPSYIRDSSVAVVVYDVSNRQSFLNTTKWIEEVRTERGSDVIIVLVGNKTDLVEKRQVSIEEGDGKSREFGVMFIETSAKAGFNIKPLFRKIAAALPGMETLSSTRQEDMVDVNLKPAVNSSQTEQQGGGCAC

SEQ ID NO: 18934 - protein, 211 aa, Cycas rumphii
MSTAMATVSPLAKYKLVFLGDQSVGKTSIITRFMYDKFDNTYQATIGIDFLSKTMYLEDRTVRLQLWDTAGQERFRSLIPSYIRDSSVAVIVYDVANRQSFLNTARWVEEVRTERGSDVIIVLVGNKTDLVDKRQVSIEEGDAKSREFGVMFIETSAKAGFNIKALFRKIAAALPGMEALSSTKQEDMVDVNLKPTVNASQAEQKAGGCSC

SEQ ID NO: 18935 - protein, 211 aa, Valeriana officinalis
MAPVSALAKYKLVFLGDQSVGKTSIITRFMYDKFDNTYQATIGIDFLSKTMYLEDRTVRLQLWDTAGQERFRSLIPSYIRDSSVAVICYDVASRQSFLNTSKWIEEVRTERGSDVIIVLVGNKTDLVDKRQVSIEEAEAKARELNVMFIETSAKAGFNIKPLFRKIAAALPGMETLSSAKSEDMVDVNLKSTMPVRLSRNNLVVALAKFIV

SEQ ID NO: 18936 - protein, 206 aa, Brassica napus
  Sequence also found in Organisms: Brassica oleracea, Brassica rapa
MAAVTPLAKYKLVFLGDQSVGKTSIITRFMYDKFDTTYQATIGIDFLSKTMYMEDRTLRLQLWDTAGQERFRSLIPSYIRDSSVAVIVYDVANRQSFLNTSKWIEDVRTERGSDVIIVLVGNKTDLVDKRQVSIEEGDNKARDFGVIFIETSAKAGFNIKPLFRKISAALPGMDTLSTRQGDMVDVNLRSSTNASQGEQQGGGCSC

SEQ ID NO: 18937 - protein, 206 aa, Cichorium intybus
MAPASALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVMVGNKTDLVDKRQVSVEEGEAKATELNVMFIETSAKAGFNIKALFRKIAAALPGMETLSATKHEEMVDVNLKSTSMTSSQPESGGCAC

SEQ ID NO: 18938 - protein, 206 aa, Cichorium intybus
MAPASALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVMVGNKTDLVDKRQVSVEEGEAKATELNVMFIETSAKAGFNIKALFRKIAAALPGMETLSATKHEEMVDVNLKSTSMSSSQPESGGCAC

SEQ ID NO: 18939 - protein, 200 aa, Cirsium arvense
MAPVSALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVLVGNKTDLVDKRQVSVEEGEAKASELKVMFIETSAKAGFNIKALFRKIAAALPGMETLSSTKHEEMVDVNLKSSNMTSSQPE

SEQ ID NO: 18940 - protein, 207 aa, Echinacea purpurea
MAKPVSALAKYKLVFLGDQSVGKTSIITRFMYDKFDTSYQATIGIDFLSKTMYLEDRTVRLQLWDTAGQERFRSLIPSYIRDSSVAVIIYDVASRQTFLNTIKWIEEVRAERGSDVIIVLVGNKTDLVEKRQVSVEEGEAKAAELNVMFIETSAKAGFNIKALFRKIAAALPGMETLSSTKHEELVDVNLKSSSVSSSQPESGGCAC

SEQ ID NO: 18941 - protein, 207 aa, Cucumis melo
MATVSPLAKYKLVFLGDQSVGKTSIITRFMYDKFDTTYQATIGIDFLSKTMYLEDRTIRLQLWDTAGQERFRSLIPSYIRDSSVAVVVYDVSNRQSFLNTTKWIEEVRTERGSDVIIILVGNKTDLVEKRQVSIEEGDAKSREFGVMFIETSAKAGFNIKPLFRKIAAALPGMETLSSTRQEDMVDVNLKPAVNSSQSEQQGGGCAC

SEQ ID NO: 18942 - protein, 200 aa, Pennisetum glaucum
MAPVVSALAKYKLVFLGDQSVGKTSIITRFMYDKFDTTYQATIGIDFLSKTMYLEDRTVRLQLWDTAGQERFRSLIPSYIRDSSVAVVVYDVSNRQSFLNTSKWIDEVRTERGGDVIVVLVGNKTDLVDKRQVSTEEGESKSKELNVMFIETSAKAGFNIKPLFRKIAAALPGMETLSSAKQEDMVDVNLKPTSSQSNSQ

SEQ ID NO: 18943 - protein, 207 aa, Raphanus sativus
MAAVTPLAKFKLVFLGDQSVGKTSIITRFMYDKFDTTYQATIGIDFLSKTMYLEDRTLRLQLWDTAGQERFRSLIPSYIRDSSVAVIVYDVANRQSFLNTSKWVEDVRTERGNDVIIVLVGNKTDLVDKRQVSIEEGDNKARDFGVIFIETSAKAGFNIKPLFRKISAALPGMDTLSSAKQGDMVDVNLKSSNHSSNAEQQSGGCSC

SEQ ID NO: 18944 - protein, 207 aa, Picea glauca
MASVSPLAKYKLVFLGDQSVGKTSIITRFMYDKFDNTYQATIGIDFLSKTMYLEDRTVRLQLWDTAGQERFRSLIPSYIRDSSVAVIVYDVAIRQSFLNTARWIEEVRTERGSDVIIVLVGNKTDLVDKRQVSIEEGDAKSREFGVIFIETSAKAGFNIKALFRKIAAALPGMEALSSTHKEDMVDVNLKSTAPATEAENKAGGCYC

SEQ ID NO: 18945 - protein, 207 aa, Helianthus annuus
MAKPVSALAKYKLVFLGDQSVGKTSIITRFMYDKFDTSYQATIGIDFLSKTMYLEDRTVRLQLWDTAGQERFRSLIPSYIRDSSVAVIIYDVASRQTFLNTIKWIEEVRAERGSDVIIVLVGNKTDLVEKRQVSVEEGEAKATELNVMFIETSAKAGFNIKALFRKIAAALPGMETLSSTKHEELVDVNLKSSSVSSSQPESGGCAC

SEQ ID NO: 18946 - protein, 206 aa, Tragopogon dubius
MAPASALAKYKLVFLGDQSVGKTSIITRFMYDKFDTSYQATIGIDFLSKTMYLEDRTVRLQLWDTAGQERFRSLIPSYIRDSSVAVITYDVASRQTFLNTIKWIEEVRAERGSDVIIVMVGNKTDLVDKRQVSVEEGEAKASELKVMFIETSAKAGFNIKALFRKIAAALPGMETLSATKHEEMVDVNLKSSSVTSSQPASGGCAC

SEQ ID NO: 18947 - protein, 207 aa, Abies balsamea
MATVSPLAKYKLVFLGDQSVGKTSIITRFMYDKFDNTYQATIGIDFLSKTMYLEDRTVRLQLWDTAGQERFRSLIPSYIRDSSVAVIVYDVANRQSFMNTARWIEEVRTERGSDVIIVIVGNKTDLVDKRQVSIEEGDATSRELGVMFIETSAKAGFNIKALFRKIAAALPGMEALSSTNKEDMVDVNLKSTVPATQAEKKAGGCYC

SEQ ID NO: 18948 - protein, 207 aa, Ambrosia trifida
MAKPVSALAKYKLVFLGDQSVGKTSIITRFMYDKFDTSYQATIGIDFLSKTMYLEDRTVRLQLWDTAGQERFRSLIPSYIRDSSVAVIIYDVASRQTFLNTIKWIEEVRAERGSDVIIVLVGNKTDLVEKRQVSVEEGEAKANELNVMFIETSAKAGFNIKALFRKIAAALPGMETLSSTKHEELVDVNLKSSSVTSSRPESGGCAC

SEQ ID NO: 18949 - protein, 206 aa, Brassica napus
MAAVTPLAKYKLVFLGDQSVGKTSIITRFMYDKFDTTYQATIGIDFLSKTMYMEDRTLRLQLWDTAGQERFRSLIPSYIRDSSVAVIVYDVANRQSLLNTSKWIEDVRTERGSDVIIVLVGNKTDLVDKRQVSIEEGDNKARDFGVIFIETSAKAGFNIKPLFRKISAALPGMDTLSTKQGDMVDVNLKSSTNASQAEQQGGGCSC

SEQ ID NO: 18950 - protein, 206 aa, Castanea mollissima
MAAVSPLAKYKLVFLGDQSVGKTSIITRFMYDKFDATYQATIGIDFLSKTMYLEDRTVRLQLWDTAGQERFRSLIPSYIRDSSVAVIVYDVANRQSFLNINRWVEEVRTERGSDVIIVLVGNKTDLVDKRQVSIEEGDAKSREFGIMFIETSAKAGFNIKPLFRKIAAALPGMETLSSTKQEEMVDINLKPTVNSSHQEQQGGCRC

SEQ ID NO: 18951 - protein, 195 aa, Castanea mollissima
FLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRTERGSDVIIVLVGNKTDLVEKRQVSIEEGEAKARELNVMFIETSAKAGFNIKALFRKIAAALPGMETLSSTKQEDMVDVNLKSTSGGATQSQPQSGGCSC

SEQ ID NO: 18952 - protein, 206 aa, Echinacea purpurea
MAVVSPLAKYKLVFLGDQSVGKTSIITRFMYDKFDTSYQATIGIDFLSKTMYLEDRTVRLQLWDTAGQERFRSLIPSYIRDSSVAVIIYDVASRQTFLNTIKWIEEVRAERGSDVIIVLVGNKTDLVEKRQVSVEEGEAKAAELNVMFIETSAKAGFNIKALFRKIAAALPGMETLSSTKHEELVDVNLKSSSVSSSQPESGGCAC

SEQ ID NO: 18953 - protein, 206 aa, Lactuca sativa
MARASALAKYKLVFLGDQSVGKTSIITRFMYDKFDTSYQATIGIDFLSKTMYLEDRTVRLQLWDTAGQERFRSLIPSYIRDSSVAVITYDVSSRQTFLNTIKWIEEVRAERGSDVIIVMVGNKTDLVDKRQVSVEEGEAKATELNVMFIETSAKAGFNIKALFRKIAAALPGMETLSSTKHEEMVDVNLKSTSMSSSQPESGGCAC

SEQ ID NO: 18954 - protein, 194 aa, Sesamum indicum
MAVVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIIVLVGNKTDLVDKRQVSIEEGDGKAREFGVMFIETSAKAGFNIKPLFRKIAAALPGMETLSSTKQEDMVDVNLKPTSN

SEQ ID NO: 18955 - protein, 213 aa, Tropaeolum majus
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVHTERGSDVIIVLVGNKTDLVEKRQVSIEEGDNKARESGVMFIETSAKAGFNIKPLFRKIASALPGMETLSSAKQEDMVDVNLKSTVNSSQTQEQGGVVHVKEMYLT

SEQ ID NO: 18956 - protein, 207 aa, Arabidopsis lyrata
MASVSPLAKYKLVFLGDQSVGKTSIITRFMYDKFDTTYQATIGIDFLSKTMYLEDRTVRLQLWDTAGQERFRSLIPSYIRDSSVAVVVYDVANRLSFLNTSKWIEEVRTERAGDVIIVLVGNKTDLVEKRQVSIEEGDSKGREYGVMFIETSAKAGFNIKPLFRKIAAALPGMESYSNTKNEDMVDVNLKPTSNSSQGDQQGGGCSC

SEQ ID NO: 18957 - protein, 204 aa, Brassica juncea
AVTPLAKYKLVFLGDQSVGKTSIITRFMYDKFDTTYQATIGIDFLSKTMYMEDRTLRLQLWDTAGQERFRSLIPSYIRDSSVAVIVYDVANRQSFLNTSKWIEDVRTERGSDVIIVLVGNKTDLVDKRQVSIEEGDSKARDFGVIFIETSAKAGFNIKPLFRKISAALPGMDTLSTRQGDMVDVNLRSSTNASQGEQQGGGCSC

SEQ ID NO: 18958 - protein, 207 aa, Lupinus angustifolius
MATVSPLAKYKLVFLGDQSVGKTSIITRFMYDKFDTTYQATIGIDFLSKTMYLEDRTIRLQLWDTAGQERFRSLIPSYIRDSSVAVIVYDVANRQSFLNTNKWIDEVRTERGSDVIIVLVGNKTDLVDKRQVSIEEGDAKSRESGILFIETSAKAGFNIKPLFRKIASALPGMETLSSAKHEDMVDIKLKTTASSSQTEQQGGGCAC

SEQ ID NO: 18959 - protein, 207 aa, Medicago truncatula
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNKWVEEVRQERGSDVIIVLVGNKTDLVEKRQVSIEEGDAKSKEFGIMFIETSAKAGFNIKPLFRKIASALPGMETLSSTNKEDMVDVNLKPTVHSSNTEQQGGGCSC

SEQ ID NO: 18960 - protein, 207 aa, Pinus taeda
MASVSPLAKYKLVFLGDQSVGKTSIITRFMYDKFDNTYQATIGIDFLSKTMYLEDRTVRLQLWDTAGQERFRSLIPSYIRDSSVAVVVYDVAIRQSFLNTARWIEEVRTERGSDVIIVLVGNKTDLVDKRQVSIEEGDAKSREFGVIFIETSAKAGFNIKALFRKIAAALPGMEALSSTHKEDMVDVNLKSTVTATETEKKAGGCYC

SEQ ID NO: 18961 - protein, 207 aa, Eutrema parvulum
MASVSPLAKYKLVFLGDQSVGKTSIITRFMYDKFDTTYQATIGIDFLSKTMYLEDRTVRLQLWDTAGQERFRSLIPSYIRDSSVAVVVYDVANRLSFLNTSKWIEEVRTERAGDVIIVLVGNKTDLVEKRQVSIEEGDSKGREYGVMFIETSAKAGFNIKPLFRKIAAALPGMESYSNTKTEDMVDVNLKPTSNSSQGDQQGGGCSC

SEQ ID NO: 18962 - protein, 226 aa, Medicago truncatula
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTTKWIEEVRTERGSDVIIVLVGNKTDLVEKRQVSIEDGEAKARELNVMFIETSAKAGFNIKALFRKIAAALPGMETLSSAKQEDLVDVNLKSSSGNAQSQTQSNMVDVNLKSSSCHESQPQSGGCSC

SEQ ID NO: 18963 - protein, 207 aa, Trifolium pratense
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNKWVEEVRQERGSDVIIVLVGNKTDLVEKRQVSIEEGDAKSKEFGIMFIETSAKAGFNIKPLFRKIASALPGMETLSSTNKEDMVDVNLKPTVNNSNTEQQGGGCAC

SEQ ID NO: 18964 - protein, 206 aa, Taraxacum officinale
MTRPSALAKYKLVFLGDQSVGKTSIITRFMYDKFDTSYQATIGIDFLSKTMYLEDRTVRLQLWDTAGQERFRSLIPSYIRDSSVAVITYDVSSRQTFLNTIKWIEEVRAERGSDVIIVMVGNKTDLVDKRQVSVEEGEAKATELNVMFIETSAKAGFNIKALFRKIAAALPGMETLSATKHEEMVDVNLKSTSMSSSQPESGGCAC

SEQ ID NO: 18965 - protein, 190 aa, Eragrostis curvula
MAPVSALAKYKLVFLGDQSVGKTSIITRFMYDKFDNTYQATIGIDFLSKTMYLEDRTVRLQLWDTAGQERFRSFIPSYIRDSSVAVIVFDVASSQSFLNTSKWIEEVRTERGSDVIIVLVGNKTDLVDKSQVSIEEGEAKAKDLGVMFIETSAKAGFNIKALFRKIGAALPGMETLSSAKAGRHGKCELE

SEQ ID NO: 18966 - protein, 206 aa, Medicago truncatula
MVTVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTNKWVEEVRAERGSDVIIVLVGNKTDLVEKRQVSIEEGDAKSRESGIMFIETSAKAGFNIKPLFRKIASALPGMESLSTKQDDMVDVNLKSTAYSSRTEQQGGGCSC

SEQ ID NO: 18967 - protein, 205 aa, Raphanus sativus
MAAVTPLAKYKLVFLGDQSVGKTSIITRFMYDKFDTTYQATIGIDFLSKTMYMEDRTLRLQLWDTAGQERFRSLIPSYIRDSSVAVIVYDVANRQSFLNTSKWIEDVRTERGSDVIIVLVGNKTDLVDKRQVSIEEGDTKGRDFGVIFIETSAKAGFNIKPLFRKISAALPGMDTLSTRQGDMVDVNLKSSTTSQAEQQQGGCSC

SEQ ID NO: 18968 - protein, 207 aa, Eutrema halophilum
MASVSPLAKYKLVFLGDQSVGKTSIITRFMYDKFDTTYQATIGIDFLSKTMYLEDRTVRLQLWDTAGQERFRSLIPSYIRDSSVAVVVYDVANRLSFLNTSKWIEEVRTERAGDVIIVLVGNKTDLVEKRQVSIEEGDSKGREYGVMFIETSAKAGFNIKPLFRKIAAALPGMESYSNTKTEDMVDVNLKPTSNSSQGDQQGVGCSC

SEQ ID NO: 18969 - protein, 206 aa, Arachis hypogaea
MAGLSVSALAKYKLVFLGDQSVGKTSIITRFMYDKFDNTYQATIGIDFLSKTMYLEDRTIRLQLWDTAGQERFRSLIPSYIRDSSVAVIVYDVASRQTFLNTVRWIEEVRSERGNDVILVLVGNKTDLLDKRQVSTEDGEEKARELNVMFIEASAKAGFNIKALFRKIAAALPGMETLSSSKQDDMVDVNLKTSGGNDSQAEGGCC

SEQ ID NO: 18970 - protein, 207 aa, Arabidopsis thaliana
MASVSPLAKYKLVFLGDQSVGKTSIITRFMYDKFDTTYQATIGIDFLSKTMYLEDRTVRLQLWDTAGQERFRSLIPSYIRDSSVAVVVYDVANRLSFLNTSKWIEEVRNERAGDVIIVLVGNKTDLVEKRQVSIEEGDSKGREYGVMFIETSAKAGFNIKPLFRKIAAALPGMESYSNTKNEDMVDVNLKPTSNSSQGDQQGGACSC

SEQ ID NO: 18971 - protein, 207 aa, Brassica napus
  Sequence also found in Organisms: Brassica oleracea, Brassica rapa
MASVSPLAKYKLVFLGDQSVGKTSIITRFMYDKFDTTYQATIGIDFLSKTMYLEDRTVRLQLWDTAGQERFRSLIPSYIRDSSVAVVVYDVSNRLSFLNTSKWIEEVRTERAGDVIIVLVGNKTDLVDKRQVSIEEGDSKGREYGVIFIETSAKAGFNIKPLFRKIAAALPGMDSYSNMKTEDMVDVNLKATSNSSQGDQQGGGCSC

SEQ ID NO: 18972 - protein, 226 aa, Brassica napus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTTKWIDEVRTERGSDVIVVLVGNKTDLVDKRQVSIEEAEAKARELNVIFIETSAKAGFNIKALFRKIAAALPGMETLSSTKQEDMVDVNLKSSNANASLAQQQSGGCSCKFQQSPQIDSEQEKNTQI

SEQ ID NO: 18973 - protein, 209 aa, Selaginella moellendorffii
MGVPTATVSPLAKYKLVFLGDQSVGKTSIITRFMYDKFDNTYQATIGIDFLSKTMYLEDRTVRLQLWDTAGQERFRSLIPSYIRDSSVAVVVYDVANRQSFLNTARWVEEVRTERGSDVIIVLVGNKTDLVDKRQVSIEEGDAKAREFGVMYIETSAKAGFNIKALFRKIAAALPGMEALSSAKQEDLVDVSLKTNPPPSETKAGGCAC

SEQ ID NO: 18974 - protein, 220 aa, Ricinus communis
MATVSPLAKYKLVFLGDQSVGKTSIITRFMYDKFDTTYQATIGIDFLSKTMYLEDRTVRLQLWDTAGQERFRSLIPSYIRDSSVAVIVYDVANRQSFLNTSKWIEEVRTERGSDVIVVLVGNKTDLVDKRFILFNSAVYVFNRQVSIEEGDNKAKEFGVMFIETSAKAGFNIKPLFRKIASALPGMETLSSTKQEDMVDVNLKPSVNSSQNEQQGGGCAC

SEQ ID NO: 18975 - protein, 194 aa, Vicia sativa
VFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIVVLVGNKTDLVDKRQVSTEEGEAKSRELNVMFIEASAKAGFNIKALFRKIAAALPGMETLSTTKQEDMVDVNLRSSASHDSQPQSGGCAC

SEQ ID NO: 18976 - protein, 211 aa, Pinus taeda
MSTAMASVSPLAKYKLVFLGDQSVGKTSIITRFMYDKFDNTYQATIGIDFLSKTMYLEDRTVRLQLWDTAGQERFRSLIPSYIRDSSVAVVVYDVAIRQSFLNTARWIEEVRTERGSDVIIVLVGNKTDLVDKRQVSIEEGDAKSREFGVIFIETSAKAGFNIKALFRKIAAALPGMEALSSTHKEDMVDVNLKSTVTATETEKKAGGCYC

SEQ ID NO: 18977 - protein, 202 aa, Chelidonium majus
LAKYKLVFLGDQSVGKTSIITRFMYDKFDTTYQATIGIDFLSKTMYLEDRTIRLQLWDTAGQERFRSLIPSYIRDSSVAVIVYDVANRQSFLNTSKWIEEVRTERGSDVIIVLVGNKTDLLEKRQVSIEEGDSKSRDDGVMFIETSAKAGFNIKPLFRKTRPAALPGMESFSSTKQEDMVDVNLKPTVNSSNTEQQGGGCAC

SEQ ID NO: 18978 - protein, 208 aa, Physcomitrella patens
MGQPATVSPLAKYKLVFLGDQSVGKTSIITRFMYDKFDNTYQATIGIDFLSKTMYLEDRTVRLQLWDTAGQERFRSLIPSYIRDSSVAVVVYDVSNRQSFLNTSRWIEEVLTERGSDVIIMLVGNKTDLVDKRQVSIEEGDAKAKEVGVMFIETSSKAGFNIKALFRKIAAALPGMEALSSHKDDLVDVNLKPTTNPQGEGKAGGCAC

SEQ ID NO: 18979 - protein, 211 aa, Ceratodon purpureus
MGSQTATVSPLAKYKLVFLGDQSVGKTSIITRFMYDKFDNTYQATIGIDFLSKTMYLEDRTVRLQLWDTAGQERFRSLIPSYIRDSSVAVVVYDVSNRQSFLNTARWVEEVRTERGSDVIIMLVGNKTDLVDKRQVSIEEGDAKAKDFGVMFIETSSKAGFNIKALFRKIAAALPGMEALSSHKDKDDLVDVNLKPTQNSQAEGKAGGCAC

SEQ ID NO: 18980 - protein, 206 aa, Festuca arundinacea
TKPPPPPPPPPPPPPPPPPPPPPPGRSMYDQVRQHYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEAKAKDLGVMFIETSAKAGFNIKALFRKIAAALPGMETLSSAKQEDMVDVNLKSGNANSSQSQAQAGGCSC

SEQ ID NO: 18981 - protein, 210 aa, Fagopyrum esculentum
MAAVSPLAKYKLVFLGDQSVGKTSIITRFMYDKFDANYQPTIGIDFLSKTMYLEDRTVRLQLWDTAGQERFRSLIPSYIRDSSVAIIVYDISNRQSFLSTTKWMEEVRTERGSDVIVVLVANKTDLVDKRQVSIEEGESKARDAGIMFLETSAKAGFNIKPLFRKIASSLPGMEALSSTKQEDMVDVNLKPANNASQNDQQGGSSGGCMC

SEQ ID NO: 18982 - protein, 215 aa, Oryza sativa
MAPVVSALAKYKLVFLGDQAVGKTAIITRFMYDKFDATYQATIGIDFLSKTMYLEDRTVRLQLWDTAGQERFRSLIPSYIRDSSVAVIVYDVTDRQSFLSISKWIEEVNTQRGGDVIIVLVGNKTDLVDKRQISTDEGEAKAQEHGAMFMETSAKAGFNIKPLFRKIAASLPGMEALSSAKQEDMVDINLRPAASGQIPSGAEAQEEQKAGGCSC

SEQ ID NO: 18983 - protein, 190 aa, Chrysanthemum coronarium
QSVGKTSIITRFMYDKFDTTYQATIGIDFLSKTMYLEDRTVRLQLWDTAGQERFRSLIPSYIRDSSVAVIVYDVANRQSFLNTAKWIEEVRTERGTDVIIVLVGNKTDLVDKRQVSIEEGDAKAREFGVMFIETSAKAGFNIKPLFRKIAAALPGMETLSSTKQEDMVDVNLKSSGNASQSEQQGGGCAC

SEQ ID NO: 18984 - protein, 209 aa, Ceratodon purpureus
MGGQSTTVSPLAKYKLVFLGDQSVGKTSIITRFMYDKFDNTYQATIGIDFLSKTMYLEDRTVRLQLWDTAGQERFRSLIPSYIRDSSVAVVVYDVSNRQSFLNTARWVEEVRTERGSDVIIMLVGNKTDLVDKRQVSIEEGDAKAKEFGVMFIETSSKAGFNIKALFRKIAAALPGMEALSSHKDDLVDVNLKPTSNAQADGKAGGCAC

SEQ ID NO: 18985 - protein, 208 aa, Mimulus guttatus
MAVVVSPLTKYKLVFLGDQSVGKTSIITRFMYDKFDTTYQATIGIDFLSKTMYLEDRTIRLQLWDTAGQERFRSLIPSYIRDSSVAVIVYDVANRQSFLNTMKWTEEVRTERGRDVIIVLVGNKTDIVDKRQVSSEEGDHKARELGVIFIETSAKAGFNIKPLFRKIAGALPGMEILSPRKQEGMVDVDLKPASNTYSNEQQPGSCAC

SEQ ID NO: 18986 - protein, 214 aa, Panicum virgatum
MAPVVSALAKYKLVFLGDQAVGKTAIITRFMYDKFDNTYQATIGIDFLSKTMYLEDRTVRLQLWDTAGQERFRSLIPSYIRDSSVAVIVYDVTDRQSFLNTSKWIEEVNTQRGGDVLIFLVGNKTDLVDKRKVSTDEGEAKAQEHGAMFIETSAKAGFNIKPLFRKIAGSLPGMDALSSAKQEDMVDINLRPSTGSSASGAASHAEQKSGGCSC

SEQ ID NO: 18987 - protein, 210 aa, Physcomitrella patens
MGMGQTTTVSPLAKYKLVFLGDQSVGKTSIITRFMYDKFDNTYQATIGIDFLSKTMYLEDRTVRLQLWDTAGQERFRSLIPSYIRDSSVAVVVYDVSNRQSFLNTARWVEEVRTERGSDVIIMLVGNKTDLVDKRQVSIEEGDAKAKEFGVMFIETSSKAGFNIKALFRKIAAALPGMEALSSHKDDLVDVNLKPTTNPQAEGKAGGCAC

SEQ ID NO: 18988 - protein, 185 aa, Tragopogon dubius
MAVVSPLAKYKLVFLGDQSVGKTSIITRFMYDKFDTTYQATIGTDFLSKTMYLEDRTVRLQLWDTAGQERFRSLIPSYIRDSSVAVIVYDVANRQSFLNTAKWIEEVRTERGQDVIIVLVGNKTDLVGKRQVSIEEGDGKAREFGVMFIETSAKAGFNIKPLFRKIAAALPGMETLSSTKQEDMA

SEQ ID NO: 18989 - protein, 209 aa, Physcomitrella patens
MSGQSTTVSPLAKYKLVFLGDQSVGKTSVITRFMYDKFDNTYQATIGIDFLSKTMYLEDRTVRLQLWDTAGQERFRSLIPSYIRDSSVAVVVYDVSNRQSFLNTARWVEEVRTERGSDVIIMLVGNKTDLLDKRQVSIEEGDAKAKEFGVMFIETSSKAGFNIKALFRKIAAALPGMEALSSSKDDLVDVNLKSTSNAQADSKAGACSC

SEQ ID NO: 18990 - protein, 211 aa, Physcomitrella patens
MGAGSQTATVSPLAKYKLVFLGDQSVGKTSIITRFMYDKFDNTYQATIGIDFLSKTMYLEDRTVRLQLWDTAGQERFRSLIPSYIRDSSVAVVVYDVSNRQSFMNTARWVEEVRTERGSDVIIMLVGNKTDLVDKRQVSIEEGDAKAKEFGVMFIETSSKAGFNIKALFRKIAAALPGMETMSSHKDDLVDVNLKPTLNTQTEGKPGGCAC

SEQ ID NO: 18991 - protein, 213 aa, Eutrema halophilum
MAAVSALAKFKLVFLGDQSVGKTSIITRFMYDKFDTTYQPTIGIDFLSKTMYLEDRTVRLQLWDTAGQERFRSLIPSYIRDSSVAIVVYDVANRQTFLNISKWIDDVHRERGSGDVIIVLVGNKTDLVEKRQVSISEGEDKGKEHGVMFIETSAKENFNIKALFRKIAAALPGMDSYSSATKSEDMVDVNLKTTSNSSQGEQQGGGGGGGCSC

SEQ ID NO: 18992 - protein, 214 aa, Triticum aestivum
MAPAVSALAKYKLVFLGDQAVGKTAIITRFMYDKFDATYQATIGIDFLSKTMYLEDRTVRLQLWDTAGQERFRSLIPSYIRDSSVAVIVYDVTDTQSFLHTSKWIDEVNTARGKDVLIVLVGNKTDLVDQRQVPTDEGEAKAKEHGALFMETSAKAGFNIKALFRTIAASLPGMDALSSAKQEDMVDINLRPASGPAGSGAPGQQEQKAGGCSC

SEQ ID NO: 18993 - protein, 207 aa, Avena sativa
MAPAISALAKYKLVFLGDQSVGKTAIITRFMYDKFDSTYQATIGIDFLSKTMYLEDRTVRLQLWDTAGQERFRSLIPSYIRDSSVAVIVYDVTDRQSFLHTSKWIDEVNTERGGDVLIILVGNKTDLVDQRQVSTDEGEAKAKEHGVMFIETSAKNGFNVKALFRTIATSLPGMEALSSAKQEDMVDINLRPASGPAGSGAGGQQQQ

SEQ ID NO: 18994 - protein, 214 aa, Hordeum vulgare
MAPVVSALAKYKLVFLGDQAVGKTAIITRFMYDKFDATYQATIGIDFLSKTMYLEDRTVRLQLWDTAGQERFRSLIPSYIRDSSVAVIVYDVTDTQSFLHTSKWIDEVNTARGKDVLIVLVGNKTDLVDQRQVPTDEGEAKAKEHGALFMETSAKAGFNIKALFRTIAASLPGMDAVSSAKQEDMVDINLRPASGPAGSGTAGQQEEKAGGCSC

SEQ ID NO: 18995 - protein, 214 aa, Secale cereale
MAPVVSALAKYKLVFLGDQAVGKTAIITRFMYDKFDATYQATIGIDFLSKTMYLEDRTVRLQLWDTAGQERFRSLIPSYIRDSSVAVIVYDVTDTQSFLHTSKWIDEVNTARGKDVLIVLVGNKTDLVDQRQVATDEGEAKAKEHGALFMETSAKAGFNIKALFRTIATSLPGMDALSSAKQEDMVDINLRPASGAAGSGAAAQQEQNAGGCSC

SEQ ID NO: 18996 - protein, 214 aa, Panicum virgatum
MAPVVSALAKYKLVFLGDQAVGKTAIITRFMYDKFDDTYQATIGIDFLSKTMYLEDRTVRLQLWDTAGQERFRSLIPSYIRDSSVAVIVYDVTDTQSFLNTSKWIEEVNTQRGGDVLIFLVGNKTDLVDKRKVSTDEGEAKAQEHGAMFIETSAKAGFNIKPLFRKIAGSLPGMDALSSAKQEDMVDINLRPSTGSSASGSASQAEQKSGGCSC

SEQ ID NO: 18997 - protein, 213 aa, Eutrema parvulum
MAAVSPLAKFKLVFLGDQSVGKTSIITRFMYDKFDTTYQPTIGIDFLSKTMYLEDRTVRLQLWDTAGQERFRSLIPSYIRDSSVAIVVYDVANRQTFLNISKWIDDVHRERGSGDVIIVLVGNKTDLVEKRQVSISEGEDKGKEHGVMFIETSAKENFNIKALFRKIAAALPGMDSYSSATKSEDMVDVNLKTTSNSSQGEQQGGGGGGGCSC

SEQ ID NO: 18998 - protein, 212 aa, Echinochloa colona
MAPVVSALAKYKLVFLGDQAVGKTAIITRFMYDKFDDTYQATIGIDFLSKTMYLEDRTVRLQLWDTAGQERFRSLIPSYIRDSSVAVIVYDVTDRQSFLNTSKWIDEVNTQRGGDVLIFLVGNKTDLVDKRKVSTDEGEAKAQEHGAMFIETSAKAGFNIKPLFRKIAGSLPGLDALSSAKQEDMVDINLRSSTGSSVSGAAAPAVSGGCAC

SEQ ID NO: 18999 - protein, 215 aa, Brachypodium distachyon
MAPVVSALAKYKLVFLGDQAVGKTAIITRFMYDKFDATYQATIGIDFLSKTMYLEDRTIRLQLWDTAGQERFRSLIPSYIRDSSVAVIVYDVTDRQSFLHTSTWIDEVKTERAGTDVLIVLVGNKTDLVDKRQVPTDEGEAKAQEHGVMFIETSAKAGFNVKPLFRKIATSLPGMDALSSAKQEDMVDINLRPASGSKAPGAAAQQEQKAGGCSC

SEQ ID NO: 19000 - protein, 586 aa, Zea mays
MSSASLLCSSSASTSRSATVPRVTRTPLFSKNQYRPALRPLRSSSVVRRSLQQEQEERVGPASSVSVASGERQEEATASHHIGGVDEAKASGHVGEADKGGQGEGDDEEKRSTDEQQEVDWKSDEEFKKFMGNPSIEAAIKLEKKRADRKLRELDREPDANPVAGLFRGLVKDQLAREKQRLELAEQTFKALDLNKLKSCFGYDTFFAVDVRRFGDGGIFIGNLRKPIEEVRPKLEKKISEAAGTEVTLWFMEEKNDDITKQVCMVQPKAEIDVQLEITKLSTPWGYLSAVALAVTTFGTIALMSGFFLKPGATFDDYVSDVLPLFGGFLTILGVSEIATRLTAAKYGVKLSPSFLVPSNWTGCLGVINNYESLLPNKKALFDIPVARTASAYVTSVVLAVSAFIVDGSFNGGENALFVRPEFFYNNPLLSFVQLVIGPYADELGNVLPNAVEGVGVPVDPLAFAGLLGIVVTSLNLLPIGRLEGGRIAQALFGRGTAALLSFGTSVLLGAGAISGSVLCLAWGLFATFIRGGEEIPAQDEITPLGNERLAWGFVLALVCLLTLFPNGGGTYSASFLGDPFFRGGI

SEQ ID NO: 19001 - protein, 591 aa, Panicum virgatum
MASASLASSLLCSSSGSTSRSAAVPRVIRIPLFSKNQYRPPLRPLRSRSVVRRSLQQEQEERTDPASSVAVASGEQQEEETTTASHHVGGEDGAKTSGHAGGAEGGEGEGDGEAKRSTDEQQEVDWKSDEEFKKFMGNPSIEAAIKLEKKRADRKLRELDREPDANPVAGLLRGLAKDQLAREKQRLELAEQTFKALDLNKLKSCFGYDTFFAVDVRRFGDGGIFIGNLRRPVEEVRPKLEKKIAEAAGTEVTLWFMEEKADDITKQVCMVQPKAEIDLQLEVTRLSTTWGYLSAVALAVTTFGTIALMSGFFLKPGATFDDYVSDVLPLFGGFLTILGVSEVATRLTAAKYGVKLSPSFLVPSNWTGCLGVMNNYESLLPNKKALFDIPVARTASAYATSIVLAISAFIADGSFNGGENALFVRPEFFYNNPLLSFVQVVIGPYADELGNVLPNAVEGVGVPVDPLAFAGLLGIVVTSLNLLPIGRLEGGRIAQALFGRGTAALLSFGTSVLLGAGAISGSVLCLAWGLFATFIRGGEEIPAQDEITPLGNDRYAWGFVLAVVCLLTLFPNGGGTYSASFLGDPFFRGGV

SEQ ID NO: 19002 - protein, 591 aa, Setaria italica
MASASLASSVLCSSSGSTSRSAAVPRAIRIPLFPKNQHRPPLRPLRSSSVARRSLQQEQEERADPASSVAVASGERHEEPTASHHVGGEDDGTTASGHAGGAEGGQGDGDGEEKRSTDEQQEVDWKSDEEFKRFMGNPSIEAAIKLEKKRADRKLRELDREPDANPVAGLLRGLAKDQLAREKQRLELAEQTFKALDLNKLKSCFGYDTFFAVDVRRFGDGGIFIGNLRRPVEEVRPKLEKKIAEAAGTEVTLWFMEEKGDGDITKQVCMVQPKAEIDLQLEITRLSTAWGYLSAVALAVTTFGTVALMSGFFLKPGATFDDYVSDVLPLFGGFLTILGVSEIATRLTAAKYGVKLSPSFLVPSNWTGCLGVMNNYESLLPNKKALFDIPVARTASAYITSVVLAVSAFIADGSFNGGENALFVRPEFFYNNPLLSFVQVAIGPYADELGNVLPNAVEGVGVPVDPLAFAGLLGIVVTSLNLLPIGRLEGGRIAQALFGRSTAALLSFGTSVLLGLGAISGSVLCLAWGLFATFIRGGEEIPAQDEITPLGSDRVAWGFVLAVVCLLTLFPNGGGTYSTSFLGDPFFRGGI

SEQ ID NO: 19003 - protein, 591 aa, Panicum virgatum
MASASLASSLLCSSGGSTSRSAAVPRVIRIPLFSKNQHRPPLRPLRSRSVVRRSLQQEQEERTDPASSVAVASGEQEEEAATTASHHVGGENVAKTSGHAGGAEGGQGEGDGEAKRSTDEQQEVDWKSDEEFKKFMGNPSIEAAIKLEKKRADRKLRELDREPDANPVAGLLRGLAKDQLAREKQRLELAEQTFKALDLNKLKSCFGYDTFFAVDVRRFGDGGIFIGNLRRPVEEVRPKLEKKIAEAAGTEVTLWFMEEKADDVTKQVCMVQPKAEIDLQLEVTRLSTAWGYLSAVALAVTTFGTVALMSGFFLKPGATLDDYVSDVLPLFGGFLTILGVSEVATRLTAAKYGVKLSPSFLVPSNWTGCLGVMNNYESLLPNKKALFDIPVARTASAYATSIVLAISAFIADGSFNGGENALVVRPEFFYNNPLLSFVQVVIGPYADELGNVLPNAVEGVGVPVDPLAFAGLLGIVVTSLNLLPIGRLEGGRVAQALFGRGTAALLSFATSLLLVAGAIGGSVLCLAWGLFATFVRGGEEIPAQDEITPLGNDRYAWGFVLAVVCLLTLFPNGGGTYSTSFLGDPFFRGGI

SEQ ID NO: 19004 - protein, 579 aa, Triticum aestivum
MASTSLVATIVCSSISSTGGRATLPRSFCKNHHRPPLRPLRRSSLFRCSLREQNQATENRPVSSTAVAPDEQKVEEAKKVSSHHAGGGGGDHQEGGDGEDSEKKSRDEQQEVDWRSDEEFKKFMGNPSIEAAIKLEKKRADRKLRELDREPDASPVGGLLRGFIKGTLEREKQRLEEAEQTFKALDLNKLKSCFGYDTFFAVDVRRFGDGGIFIGNLRKPIEEVRPKLEKKIAEAAGTEVTLWFMEERNDDITKQVCMVQPKAEIELQLEVTKLSTPWGYLSAVALAVTTFGTIALMSGFFLKPGASFDDYVSDVLPLFGGFLSILGVSEIATRLTAARYGVKLSPSFLVPSNWTGCLGVMNNYESLLPSKKALFDIPVARTASAYLTSVVLAVSAFIADGSFNGGENALFIRPEFFYNNPLLSFVQQVIGPYADELGNVLPNAVEGVGVPVDPLAFAGLLGIVVTSLNLLPVGRLEGGRVAQALFGRRTAALLSFGTSLLLGAGAVGGSVLCLAWGLFATFIRGGEEIPAQDEITPLGSERYAWGFVLAVVCLLTLFPNGGGTYSSSFLGEPFFRGGI

SEQ ID NO: 19005 - protein, 582 aa, Hordeum vulgare
MASTSLVASIVCSSSGSSSTGRSAALPRSFCRNHHRLSLRPLRSSSIVRCSLQKQDQAKENRPVSSIAVAPDEQKVEESKKASSHHAGGGGGGDHPEGGDGEDSEKKSRDEQQEVDWRSDEEFKKFMGNPSIEAAIKLEKKRADRKLRELDREPDASPISGLLRGFIKGTLEREKQRLEEAEQTFKALDLNKLKSCFGYDTFFAVDVRRFGDGGIFIGNLRKPIEEVRSKLEKKIAETAGTEVTLWFMEERNEDITKQVCMVQPKAEIELQLEMTKLSTPWGYLSAVALAVTTFGTIALMSGFFLKPGASFDDYVSDVLPLFGGFLSILGVSEIATRLTAARYGVKLSPSFLVPSNWTGCLGVMNNYESLLPNKKALFDIPVARTASAYLTSVALAVSAFIADGSFNGGENALFIRPEFFYNNPLLSFVQQVIGPYTDELGNVLPNAVEGVGVPVDPLAFAGLLGIVVTSLNLLPIGRLEGGRVAQALFGRRTAALLSFGTSLLLGAGAVGGSVLCLAWGLFATFIRGGEEIPAQDEITPLGSERYAWGFVLAVVCLLTLFPNGGGTYSSSFLGEPFFRGGI

SEQ ID NO: 19006 - protein, 586 aa, Oryza sativa
MASSSLVTSLLFSSSSSSNTATSTSSRRSFSLFSKNQYCKPRPLRRSSSRLLVRCSLQQQQEEKAAPAAESHHAGGGQDDAATASHHAVEGENGVADADGGGVKKSKEELEEEEQQEVDWRSDEEFKRFMGNPSIEAAIKLEKKRADRKLRELDREPDANPLAGLLRGLARGQLAREKERLELAENTFKALDLNKLKSCFGYDTFFAVDVRRFGDGGIFIGNLRKPVEEVRPKLEKKIAEAAGTDVTLWFMEEKNDDITKQVCMVQPKAEIDLQLEITKLSTPWGYLSAVALAVTTFGTIAIMSGFFLKPGATFDDYVSDVLPLFAGFLSILGVSEIATRLTAARYGVKLSPSFLVPSNWTGCLGVMNNYESLLPNKKALFDIPVARAASAYLTSVALAVSAFVSDGSLNGGKNALFVRPEFFYNNPLLSFVQAVIGPYADELGNVLPNAVEGVGVPVDPLAFAGLLGIVVTSLNLLPCGRLEGGRIAQALFGRGAAAVLSFATSVALGAGAIIGGSVLCLAWGLFATFVRGGEEIPAQDEITPLGSERYAWGLVLAVVCLLTLFPNGGGTYSSDFLGAPFFRGGI

SEQ ID NO: 19007 - protein, 586 aa, Oryza sativa
MSSSSLVTSLLFSSSSSSNTATSTSSRRSFSLFSKNQYCKPSPLRRSSSLLLVRCSLQQQQEEKAAPAAESHHAGGGQDDAATASHHAVEGENGVADADGGGVKKSKEELEEEEQQEVDWRSDEEFKRFMGNPSIEGAIKLEKKRADRKLRELDREPDANPLAGLLRGLARGQLAREKERLELAENTFKALDLNKLKSCFGYDTFFAVDVRRFGDGGIFIGNLRKPVEEVRPKLEKKIAEAAGTDVTLWFMEEKNDDITKQVCMVQPKAEIDLQLEITKLSTPWGYLSAVALAVTTFGTIAIMSGFFLKPGATFDDYVSDVLPLFAGFLSILGVSEIATRLTAARYGVKLSPSFLVPSNWTGCLGVMNNYESLLPNKKALFDIPVARAASAYLTSVALAVSAFVSDGSLNGGKNALFVRPEFFYNNPLLSFVQAVIGPYADELGNVLPNAVEGVGVPVDPLAFAGLLGIVVTSLNLLPCGRLEGGRIAQALFGRGAAAVLSFATSVALGAGAIIGGSVLCLAWGLFATFVRGGEEIPAQDEITPLGSERYAWGLVLAVVCLLTLFPNGGGTYSSDFLGAPFFRGGI

SEQ ID NO: 19008 - protein, 260 aa, Zea mays
MERPAQAPTQLPPGFRFHPTDEELVVLYLRRKALARPLPAAVIPVVHDVAGLDPWDLPGASEGEGYFFSLRRAPATGRGSRRRRAGSGYWKATGKEEPVFLQCGGGGVGGKRQLLVGGKTALAFHRSEPSPPSSSRTGWVMHEYRLAAASRGVAEQRKKNASHGCCDAEPGEWVVCRVFLKKGARRSRPGRDGNHSRALRHRASAAPPQLREGVGGRQPLLFPAPQSPSSSCVTGVTDLSDEEDEVSSGSITRVAPQREA

SEQ ID NO: 19009 - protein, 569 aa, Zea mays
MVATVRCDEIANEKFGCITSDTEWLDVESAVQSGPVPGFGKKLSNIVEVHLQEYDKEAFYFDEAVRKGKRQHLESRILNLVQPAFQKMLTHLRMKALEKFKAGLNSSLESGKEFAISARDNTECSLKDFEQGCADAIIKQANWDCSKILEKVRRDIEDHALSIRERKLSELTTHAKEKLRKALAEPVESLFDAADQTTWTSIRNIYKRETEAILPEFLKTICGFEMEYAQAEEMVSKLRDYARSVVQSKAKEESSKVLIHMKERFTTVFSHDKDSIPRVWTGKEDVHAIAKEARAAALKLLSVMAAIRWDDEPDRIESIITSTLLEGSVVSKIASAASADPLASTTWEQIPPEHTMITPSQCKLLWKQFKSETEFTITQAVSTQQAHRRGNSKLPPPWAIVAIAILGFNEIMTLLRNPIYVFLLFVGYLMVKALAVQLDVSREFQNGVVPGIISVSAKLLPTIQNLVNKVAAEQQDEHRHHHQQHPQVAEPLQPQMQPPPLLLSPRSPMSELRRLHMPSSPRKVASSSSSSSSSSSSAVSSPRHVGEDQKPRPGAAAPENQSTIADSIV

SEQ ID NO: 19010 - protein, 353 aa, Pseudoroegneria spicata
MTPGGKGEEQQGRRLFGVSLTDRPVWQQFLICSSGFFFGYLVNGICEEYVYNRLQFSYGWYFTFVQGFVYLGLIRLQGFTMKQMVNPWRTYVRLSAALMGSNGLTKGSLAFLNYPAQIMFKSTKVLPVMIMGAFIPGLRRKYPFHEYVSAVMLVIGLILFTLADAQTSPNFSMIGVAMVSSALIMDAFLGNLQEAIFKMNPDTTQMEMLFCSTVVGLPFLAVPMVLTGELTTAWSACSEHLYVYAVLVFEAMATFVGQVSVLSLIALFGAATTAMVTTARKAVTLLLSYLIFTKPMTEQHVTGLLLITMGIVLRLLPEDKEKKGTAERQQAKAQRGEEKRRGDGVEEETSPLV

SEQ ID NO: 19011 - protein, 347 aa, Hordeum vulgare
MTTGGEEQQGRRLFGVSLTDRPVWQQFLICSSGFFFGYLVNGICEEYVYNRLQFSYGWYFTFVQGFVYLGLIRLQGFTTKQMVNPWRTYVRLSAVLMGSNGLTKGSLAFLNYPAQIMFKSTKVLPVMIMGAFIPGLRRKYPFHEYVSAVMLVIGLILFTLADAQTSPNFSMIGVAMVSSALIMDAFLGNLQEAIFKMNPDTTQMEMLFCSTVVGLPFLAVPMVLTGELTTAWSACSQHLYVYAVLVFEAMATFVGQVSVLSLIALFGAATTAMVTTARKAVTLLLSYLIFTKPMTEQHVTGLLLITMGIVLRLLPEDKEKKGTAERQQRGEEKRRGDGVEEEKSPLV

SEQ ID NO: 19012 - protein, 352 aa, Lolium multiflorum
MTGGGEEQGRRLFGVSLTDRPVWQQFLICSSGFFFGYLVNGICEEYVYNRLQFSYGWYFTFVQGFVYLGLIRLQGFTMKQMVNPWRTYVRLSAVLMGSNGLTKGSLAFLNYPAQIMFKSTKVLPVMIMGAFIPGLRRKYPFHEYVSAVMLVIGLILFTLADAQTSPNFSMIGVTMVSAALVMDAFLGNLQEAIFKMNPDTTQMEMLFCSTVVGLPFLAVPMVLTGELTTAWSACSQHLYVYAVLVFEAMATFVGQVSVLSLIALFGAATTAMVTTARKAVTLLLSYLIFTKPMTEQHVSGLLLITMGIVLRLLPEDKEKKNLAERKQAKMVAQLGEDKRRGDGVEEEKSPLV

SEQ ID NO: 19013 - protein, 375 aa, Secale cereale
SRDEREREREGERRGRGREKDGHDHRREREEQQGRRLFGVSLTDRPVWQQFLICSSGFFFGYLVNGICEEYVYNRLQFSYGWYFTFVQGFVYLGLIRLQGFTTKQMVNPWRTYVRLSAVLMGSNGLTKGSLAFLNYPAQIMFKSTKVLPVMIMGAFIPGLRRKYPFHEYVSAVMLVIGLILFTLADAQTSPNFSMIGVAMVSSALIMDAFLGNLQEAIFKMNPDTTQMEMLFCSTVVGLPFLAVPMVLTGELTTAWSACSQHLYVYAVLVFEAMATFVGQVSVLSLIALFGAATTAMVTTARKAVTLLLSYLIFTKPMTEQHVTGLLLITMGIVLRLLPEDKEKKGTAERLQAKAQRGEEKRRGDGVEEETSPLV

SEQ ID NO: 19014 - protein, 349 aa, Setaria italica
MTGAEEQGRTLFGVSLTDRPRWQQFLICASGFFFGYLVNGVCEEYVYNRLQFSYGWYFTFVQGFVYLALIRLQGFTMKQMVNPWRTYVRLSAVLMGSNGLTKGSLAFLNYPAQIMFKSTKVLPVMIMGAFIPGLRRKYPFQEYVSAVMLVIGLILFTLADAQTSPNFSMAGVAMVSGALVMDAFLGNLQEAIFKMNPDTTQMEMLFCSTVVGLPFLAVPMVLTGELMTAWTSCSQHLYVYAVLVFEAMATFVGQVSVLSLIALFGAATTAMVTTARKAVTLLLSYLIFTKPLTEQHVTGLLLITMAIVLKLLPENKEGGPLRRAAKVELSDDDGKPRGRRELEEKTNLV

SEQ ID NO: 19015 - protein, 352 aa, Panicum virgatum
MTGGEEQGRALFGLSLTDRPRWQQFFICASGFFFGYLVNGVCEEYVYNRLQFSYGWYFTFVQGFVYLALIRLQGFTMKQMVNPWRTYVRLSAVLMGSHGLTKGSLAFLNYPAQIMFKSTKVLPVMIMGAFIPGLRRKYPFQEYVSAVMLVIGLILFTLADAQASPNFSMVGVAMVSGALVMDAFLGNLQEAIFKMNPDTTQMEMLFCSTVVGLPFLALPMVLTGELMTAWTSCSQHLYVYAVLVFEAMATFVGQVSVLSLIALFGAATTAMVTTARKAVTLLLSYLIFTKPLTEQHVTGLLLITMGIVLKLVPENKEGGLRRQAKKVERSYDDDDKKRVIRELEEEEETALV

SEQ ID NO: 19016 - protein, 341 aa, Cocos nucifera
MKGEEQGRALFGISLTERPKWQQFLICSSGFFFGYLVNGICEEYVYNRLQFSYGWYFTFVQGFVYLALIRLQGFTMKQMVNPWRTYVKLSAVLMGSHGLTKGSLAFLNYPAQLMFKSTKVLPVMIMGAFIPGLRRKYPVHEYISAVLLVVGLILFTLADAQTSPNFSVIGVVMVSGALVMDSFLGNLQEVIFTMNPGTTQMEMLFCSTVVGLPFLIPPMVLTGELFKAWNSCYQHLYVYAVLVFEAMATFVGQISVLSLIAIFGAATTAMVTTARKAATLLLSYLIFTKPLTEQHGTGLILISMGILLKLLPENKDPIPRKFEQQQQQGSREREEEKRPLV

SEQ ID NO: 19017 - protein, 379 aa, Secale cereale
MVKAMAGCPAKMGFRMPAEWEPHEQCWMGWPERPDNWREHAEPARKTFERTAIAISKFEPVTICASAKQYPRVHELMEHQPNIRVVEMSMNDSWFRDTGPTFITREGGSDTGLAEQTIAGIDWEFNAWGGLGGGCFDDWSLDRSIAKKIVEIERIPRFAHTMVLEGGSIHVDGEGTCITTEECLLNPNRNPHMTKLEIENELKDFLGVTKIIWIPLGLHGDEDTNGHVDNLCCFIKPGVILLSWTDDENDPQYEVSVKALSALTQAVDAKGRQIEVVKIHVPGPLYITKEEGEGVLATGHAVPRVPGKRLAASYVNFYPANGGIIAPAFGDKKRDEEARQVLQKAFPDHEVVMVEGAREIVLGGGNIHCITQQQPVRPS

SEQ ID NO: 19018 - protein, 379 aa, Brachypodium distachyon
MVKTMAGCPAKMGFRMPAEWEPHEQCWMGWPERPDNWRENAGPARKTFARTAIAISKFEPVTICASAEQYPYVHKLMQHQPNIRVVEMSMNDSWFRDTGPTFITRKGGSDIGLTDQTIAGIDWEFNAWGGVGGGCYDDWSLDRNIAKKIIDMERIPRFPHRMVLEGGSIHVDGEGTCITTEECLLNPNRNPNMTKLEIENELKDFLGVTKIIWIPRGLYGDEDTNGHVDNLCCFIKPGVILLSWTDDENDPQYERSVEALATLSQAVDAKGRHIEVVKINIPRPLYITKEEGDGVDATGHAVPRVPGDRLAASYVNFYAANGGIIAPAFGDKQRDDEAREVLQKAFPDHEIVMVEGAREIVLGGGNIHCITQQQPVRPS

SEQ ID NO: 19019 - protein, 379 aa, Avena sativa
MVKAMAGCPAKMGFRMPAEWEPHEQCWMGWPERPDNWRENAGPARVTFARTAIAISKFEPVTICASAEQYPHVHELMQHQPNIRVVEMSMNDSWFRDTGPTFVIRKGGSDIGLAEQTIAGIDWEFNAWGGVDDGCYDDWSLDKNVAKKIVEIERIPRFPHTMVLEGGSIHVDGEGTCITTEECLLNPNRNPNMTREDIENELKDFLGVTKIIWIPQGLYGDEDTNGHVDNLCCFVKPGVILLSWTDDENDPQYEISVKALSVLTQATDAEGRQIEVIKIHVPGPLYITKEEGEGVDATGHAVPRERGKRLAASYVNFYLANGGIIAPAFGDKQRDDEAREVLQKAFPDYEVVMVEGAREIVLGGGNIHCITQQQPAHPS

SEQ ID NO: 19020 - protein, 379 aa, Avena sativa
MVKAMAGCPAKMGFRMPAEWEPHEQCWMGWPERPDNWRENAGPARITFARTAIAISKFEPVTICASAEQYPHVHELMQHQPNIRVVEMSMNDSWFRDTGPTFVIRKGGSDIGLAEQTIAGIDWEFNAWGGVDDGCYDDWSLDKNVAKKIVEIERIPRFPHTMVLEGGSIHVDGEGTCITTEECLLNPNRNPNMTREDIENELKDFLGVTKIIWIPQGLYGDEDTNGHVDNLCCFVKPGVILLSWTDDENDPQYEISVKALSVLTQATDAEGRQIEVIKIHVPGPLYITKEEGEGVDATGHAVPRERGKRLAASYVNFYLANGGIIAPAFGDKQRDDEAREVLQKAFPDYEVVMVGGAREIVLGGGNIHCITQQQPARPS

SEQ ID NO: 19021 - protein, 379 aa, Avena sativa
MVKPMAGCPAKMGFRMPAEWEPHEQCWMGWPERPDNWRENAGPARVTFARTAIAISKFEPVAICASAEQYPHVHELMQHQPNIRVVEMSMNDSWFRDTGPTFVIRKGGSDIGLAEQTIAGIDWEFNAWGGVDDGCYDDWSLDKNVAKKIVEIERIPRFPHTMVLEGGSIHVDGEGTCITTEECLLNPNRNPNMTREDIENELKDFLGVTKIIWIPQGLYGDEDTNGHVDNLCCFVKPGVILLSWTDDENDPQYEISVKALSVLTQATDAEGRQIEVIKIHVPGPLYITKEEGEGVDATGHAVPRERGKRLAASYVNFYLANGGIIAPAFGDKQRDDDAREVLQKAFPDYEVVMVEGAREIVLGGGNIHCITQQQPARPS

SEQ ID NO: 19022 - protein, 378 aa, Avena sativa
VKAMAGCPAKMGFRMPAEWEPHEQCWMGWPERPDNWRENAGPARITFARTAIAIAKFEPVTICASAEQYPHVHELMQHQPNIRVVEMSMNDSWFRDTGPTFVIRKGGSDIGLAEQTIAGIDWEFNAWGGVDDGCYDDWSLDKNVAKKIVEIERIPRFPHTMVLEGGSIHVDGEGTCITTEECLLNPNRNPNMTREDIENELKDFLGVTKIIWIPQGLYGDEDTNGHVDNLCCFVKPGVILLSWTDDENDPQYEISVKALSVLTQATDAEGRQIEVIKIHVPGPLYITKEEGEGVDATGHAVPRERGKRLAASYVNFYLANGGIIAPAFGDKQRDDDAREVLQKAFPDYEVVMVEGAREIVLGGGNIHCITQQQPARPS

SEQ ID NO: 19023 - protein, 379 aa, Avena sativa
MVKAMAGCPAKMGFRMPAEWEPHEQCWMGWPERPDNWRENAGPARVTFARTAIAISKFEPVTICASAEQYPHVHELMQHQPNIRVVEMSMNDSWFRDTGPTFIIRKGGSETGPTEQTTAGIDWEFNAWGGVDDGCYDDWSLDKNVAKKIVEIERIPRFPHTMVLEGGSIHVDGEGTCITTEECLLNPNRNPNMTREDIENELKDFLGVTKIIWIPQGLYGDEDTNGHVDNLCCFVKPGVILLSWTDDENDPQYEISVKALSVLTQATDAEGRQIEVIKIHVPGPLYITKEEGEGVDATGHAVPRERGKRLAASYVNFYLANGGIIAPAFGDKQRDDEAREVLQKAFPDYEVVMVEGAREIVLGGGNIHCITQQQPARPS

SEQ ID NO: 19024 - protein, 379 aa, Avena sativa
MVKPMAGCPAKMGFRMPAEWEPHEQCWMGWPERPDNWRENAGPARVTFARTAIAISKFEPVAICASAEQYPHVHELMQHQPNIRVVEMSMNDSWFRDTGPTFIIRKGGSETGPTEQTIAGIDWEFNAWGGVDDGCYDDWSLDRDVAKKIVEIERIPRFPHTMVLEGGSIHVDGEGTCITTEECLLNPNRNPNMTREDIENELKDFLGVTKIIWIPQGLYGDEDTNGHVDNLCCFVKPGVILLSWTDDENDPQYEISVKALSVLTQATDAEGRQIEVIKIHVPGPLYITKEEGEGVDATGHAVPRERGKRLAASYVNFYLANGGIIAPAFGDKQRDDDAREVLQKAFPDYEVVMVEGAREIVLGGGNIHCITQQQPARPS

SEQ ID NO: 19025 - protein, 348 aa, Hordeum vulgare
ERPDNWREHAGPARKTFERTAIAISKFEPVTICASTKQYPYVHELMQHQPNIRVVEMSMNDSWFRDTGPTFITREGGSDIGLSEQTIAGIDWEFNAWGGLGGGCFDDWSLDRSIARKIVEIERIPWFAHTMVLEGGSIHVDGEGTCITTEECLLNPNRNPHMTKLEIENELKDFLGVTKIIWIPLGLHGDEDTNGHVDNLCCFIKPGVILLSWTDDENDPQYEISVKALSALTQSVDAKGRQIEVVKIHVPGPLYITKEEGDGVLATGHAVPRVPGKRLAASYVNLYQANGGIIAPAFGDKKRDDAAREVLQKAFPDHEVVMVEGAREIVLGGGNIHCITQQQPVRPS

SEQ ID NO: 19026 - protein, 330 aa, Pseudoroegneria spicata
RTAIAISKFEPVTICASAKQYPHVHELMQHQPNIRVVEMSMNDSWFRDTGPTFITREGGSDVGLAEQTIAGIDWEFNAWGGLGGGCFDDWSLDRSIAKKIIEIERVPRFAHSMVLEGGSIHVDGEGTCITTEECLLNPNRNPHMTKLEIENELKDFLGVTKIIWIPLGLHGDEDTNGHVDNLCCFIKPGVILLSWTDDENDPQYEISVKALSALTQAVDAKGRQIEVVKIHVPGPLYITKEEGDGVLATGHAVPRVPGKRLAASYVNFYPANGGIIAPAFGDKKRDEEAREVLQKAFPDREVVMVEGAREIVLGGGNIHCITQQQPVRPS

SEQ ID NO: 19027 - protein, 380 aa, Oryza sativa
MAKATTMEGRPAKMGFRMPAEWEPHEQCWMGWPERRDNWRELAGPARKVFARTAIAISKFESVTICASAKQYPYVHELMLHQPNIRVVEMSMNDCWFRDIGPTFIVRKGAPGLGITEKNIAGIDWEFNAWGGATDGCYVDWSLDSYVAKKIVEIERIPRFPHTMVLEGGSIHVDGEGTCITTEECLLNPNRNPNMTKLEIENELKDFLGVAKVIWIPHGLYGDDDTNGHVDNLCCFIKPGVVLLSWTDDENDPQYQRSVDALSTLSKSVDAKGRQIEVVKIHVPGPLYMTKEESEGVVKTEHAIPREPGTRLAASYVNFYIANGGIVAPAFGDKWDEEACAVLQKAFPDHEVVMVEGAREIVLAGGNIHCITQQQPVRPS

SEQ ID NO: 19028 - protein, 373 aa, Saccharum officinarum
MLKVLEGLPAKMGFRMPAEWEPHEQCWMGWPERPDNWRENAGPAQEVFARAAIAISKFEHVTLCASAKQYPKVHELMEHQTNIRVVEMSMNDSWFRDMGPTFITRKGDSRNGEQTIAGIDWQFNAWGGIYDDWSLDSDVAKKIVEIERIPRFPQKMILEGGSIHVDGEGTCITTEECLLNPNRNPNMTKLEIENELKDFLGVSKVIWVPRGLYGDEDTNGHVDNMCCFIKPGVILLSWTDDEKDPQYERSVEALSVLSQSVDAKGRQLEVVKIHVPGPLYMTKEEAEGVVSTGHAVPREPGTRLAASYVNFYIANGGIIAPSFGDNKWDKEAHAVLQKAFPDHEVVMVEGAREIVLGGGNIHCITQQQPVRPS

SEQ ID NO: 19029 - protein, 375 aa, Sorghum bicolor
MLKVLEGRRPAKMGFRMPAEWEPHEQCWMGWPERPDNWRENAGPAQEVFARTAIAISKFENVTLCASAKQYPKVHELMEHQTNIRVVEMSMNDSWFRDMGPTFITRKGDSGNAEKTIAGIDWQFNAWGGIYDDWSLDSDVAKKIVEIERIPRFLHKMILEGGSIHVDGEGTCITTEECLLNPNRNPNMTKLEIENELKDFLGVSKVIWIPHGLYGDEDTNGHVDNMCCFIKPGVILLSWTDDEKDPQYERSVEALSVLSQSIDAKGRQLEVVKIHVPGPLYMTKEEAEGVVSTGHAVPREPGTRLAASYVNFYIANGGIVAPSFGDNKWDKEAYAVLQKAFPDHEVVMVEGAREIVLGGGNIHCITQQQPVRPSS

SEQ ID NO: 19030 - protein, 369 aa, Echinochloa colona
MVKALEGRPAKLGFRMPAEWEPHEQCWMGWPERPDNWRENAGPAQETFARTAIAISKFESVTLCASAKQYPYVHNLMEHQKNIRVVEMSMNDSWFRDMGPTFITRKGESGIAIAGIDWQFNAWGGIYDDWSLDSDVAKKIIEIERIPRFPHKMILEGGSIHVDGEGTCITTEECLLNPNRNPNMTKLEIENELKDYLGVSKVIWIPRGLYGDEDTNGHVDNLCCFAKPGVILLSWTDDEKDPQYERSVEALSVLSKSVDAKGRQLEVVKIHVPGPLYMTKEEADGVLTTEHAVPREPGTRLAASYVNFYIANGGIVAPAFGDKWDKEACEVLQKAFPDHEVVMVEGAREIVLGGGNVHCITQQQPLLPS

SEQ ID NO: 19031 - protein, 372 aa, Setaria italica
MAKVMEGRPAKMGFRMPAEWEPHEQCWMGWPERPDNWRDNAGPAQQTFARAAIAISKFEPVTICASTKQYPYVHKLMEHHTNIRVIEINMNDSWFRDMGPTFITHKVESGITKQTIAGIDWQFNAWGGIYDDWSLDNDIAKKIVEIERIPRFSHKMVLEGGSIHVDGEGTCITTEECLLDPNRNPNMTKLEIENELKDFLGVTKVIWIPRGLYGDEDTNGHVDNLCCFIKPGVILLSWTDDEKDPQYERSAEALSVLTQSVDAKGRQIEVVKIHVPGPLYMTKEEADGVLSTGHAVAREPGTRLAASYVNFYIANGGIVAPSFGDKWDEEAYKVLQKAFPDREVVMVEGGREIALGGGNVHCITQQQPVRPS

SEQ ID NO: 19032 - protein, 373 aa, Pennisetum glaucum
MAKVMEGRPAKMGFRMPAEWEPHEQCWMGWPERPDNWRDNAGPAQQTFARAAIAISKFEPVTICASTKQYPYVHKLMEHHTNIRVVEINMNDSWFRDMGPTFITRKVESGITKQTIAGIDWQFNAWGGIYDDWSLDSDIAKKIVEIERIPRFSHKMVLEGGSIHVDGEGTCITTEECLLDRNRNPNMTKLDIENELKDFLGVTKVIWIPRGLYGDEDTNGHVDNLCCFIKPGVVLLSWTDDEKDPQYERSAEALSVLTQSVDAKGRQIEVVKIHVPGPLYMTKEEANGVLSTGHAVEREPGTRLAASYVNFYIANGGIVVPSFGDNYWDEEAYKVLQKAFPDHEVVMVEGAREIVLGGGNIHCITQQQPLRPS

SEQ ID NO: 19033 - protein, 372 aa, Zea mays
MVKVIQGRPAEMGFRMPAEWEPHEQCWMGWPERPDNWRENAGPAQEVFARTAIAISKFEPVTLCASAKQYPKVHELMEHQTNIRVVEMSMNDSWFRDMGPTFVTCKGDSGIAEQTIAGIDWQFNAWGGIYDDWSLDSDVAKKIVEIERIPRFPQKIILEGGSIHVDGEGTCITTEECLLNPNRNPNMTKLEIENELKDFLGVSKVIWIPRGLYGDEDTNGHVDNMCCFIKPGVILLSWTDDEKDYQYERSVEALSVLSQSVDAKGRQLQVVKIHVPGPLYMTEEEAQGVVSSGHSVPRPAGTRLAASYVNFYIANGGIIAPSFGDRWDEEAYAVLQKAFPDHEVVMVEGGREIALGGGNIHCITQQQPVRPS

SEQ ID NO: 19034 - protein, 216 aa, Hordeum vulgare
MSADELRMDLEELRRLEGLATRPRVVSLLSNEIRSVDAKLASRAAPVPTPAPQALAAAAAPAGPSYVTLGSFSWDQDNEKIRVYVFLENVDQEKVETTFKPMSVDIKFHDVKGKNYRCAIPKLNKEIVPEKCKIVVKPTKIVITLWKASSGNWLDLHYKEDKFKPSMGKEKDPMSGIMDLMKGMYEEGDEDMKRTIAKAWSDARSGKTADPMKGLP

SEQ ID NO: 19035 - protein, 203 aa, Pseudoroegneria spicata
LRRLEGLATRPRVISLLSNEIRSVDAKLASRAAPVATPAPQAVAAVAPAGLSYVTLGSFSWDQDNEKIRVYVFLENVDQEKVETTFKPMSVDIKFHDVKGKNYRCAIPKLNKEIVPEKCKVVVKPTKIIITLWKASSGNWLDLHYKEDKFKPSMDKEKDPMSGIMDLMKGMYEEGDEDMKRTIAKAWSDARSGKTADPMRGLP

SEQ ID NO: 19036 - protein, 213 aa, Avena sativa
MSADELRLDLEELRRLEGLATRPRVLSLLANEIRSVDAKLAPRIAPVPAPQAVAAAAPAAVSYVTLGSFSWDQDNEKIRVYVFLENVDQEKVETIFKPMSVDIKFHDVKGKNYRCAIPKLNKKIVPEKCKVVVKPTKIVITLWKASTGTWFDLHYKEDKFKPSTDKDKDPMSGIMDLMKDMYAEGDDNMKRTIAQAMIDARSGKTADPMRGLR

SEQ ID NO: 19037 - protein, 213 aa, Avena sativa
MSADELRLDLEELRRLEGLATRPRVLSLLANEIRSVDAKLAPRTAPVPAPQAVAAAAPAGVSYVTLGSFSWDQDNEKIRVYIFLENVDQEKVETIFKPMSVDIKFHDVKGKNYRCAIPKLNKNIVPEKCKVVVKPTKIVITLWKASTGTWFDLHYKEDKFKPGTDKDKDPMSGIMDLMKDMYAEGDDNMKRTIAQAMIDARSGKTADPMRGLR

SEQ ID NO: 19038 - protein, 208 aa, Festuca arundinacea
MSAEELRLDLEELRRLEGLATRPRVLSFLANEIRSVDAMLAAAPVPAVAAAARAGVSYVTLGTFSWDQDNEKIRVYVFLENVDQEKVETTFKPMSVDIKFHDVKGKNYRCAIPKLNKEIVPEKCKVVVKPTKIVITLWKASTGSWLDLHYKEDKFKPSTGKDKDPMSGIMDLMKDLYEEGDDNMRRTIGQTLMDARTGKTADPMRRLP

SEQ ID NO: 19039 - protein, 209 aa, Lolium multiflorum
MSAEELRLDLEELRRLEGLATRPRVLSLLANEIRTVDAKLAAAPVPAVAAAPARAGVSYVTLGTFSWDQDNDKIRVYVFLENVDQEKVETTFKPMSVDIKFHDVKGKNYRCAIPKLNKEIVPEKCKVVVKPTKIVITLWKASTGSWLDLHYKEDKFKPSAGKDKDPMSGLMDLMKDLYEEGDDNMRRTIGQSLMDARTGKTADPMRRLP

SEQ ID NO: 19040 - protein, 216 aa, Echinochloa colona
MSAEELQLELDELRQLEGLAKRPRVQSLLANEIRNVEAKLAKATAPAPAPEPQAVTPAPARPGLSYVTLGSFSWDQDSEKIRIYVFLEGVEQEKVETNFKPMSVDIKFHDVKGKNYRCTIPKLNKEIVPEKCKVVVKPTKVVVTLCKASKGNWLDLHFKEDKFKPSMDKEKDPMSGIMDLMKNMYEEGDEDMKRTIAKAWSDARSGKTTDSLSGLR

SEQ ID NO: 19041 - protein, 226 aa, Oryza sativa
MSADELRLDLEELRRLEGLAKRPRVLSALANEIRAVDAKLAKATEPQAPQAVAAGSPPVVAAAAAPAPAAAAGVSYVTLGSFSWDQDAEKIKIYVFLEGVEQDKVETTFKPMSVDIKFHDVKGKNYRCAIPKLHKEIVPEKCKVLVKPTKIIVTLYKASKGNWLDLHFKEDKFKPSMAKEKDPMSGIMDLMKNMYEEGDEDMKRTIAKAWSDARSGKTADSVRGLP

SEQ ID NO: 19042 - protein, 214 aa, Setaria italica
MSAEELRLELDELRQLEGLAKRPRVQSLLANEIRIVEAKLAKATAPAPEPQAALSAPARPGLNYVTLGSFSWDQDNEKIRIYVFLEGVEQEKVETVFKPMSVDIKFHDVKGKNYRCAIPKLNKEIVPEKCKVVVKPTKVVVTLCKASKGNWLDLYFKEDKFKPSMDKEKDPMSGIMDLMKNMYEEGDEDMKRTIAKAWTDARSGKTTDSLSGLH

SEQ ID NO: 19043 - protein, 226 aa, Oryza sativa
MSADELRLDLEELRRLEGLAKRPRVLSALANEIRAVDAKLAKATEPQAPQAVAAGSPPVVAAAAAPAPAAAAGVSYVTLGSFSWDQDAEKIKIYVFLEGVEQDKVETTFKPMSVDTKFHDVKGKNYRCAIPKLHKEIVPEKCKVLVKPTKIIVTLYKASKGNWLDLHFKEDKFKPSMAKEKDPMSGIMDLMKNMYEEGDEDMKRTIAKAWSDARSGKTADSVRGLP

SEQ ID NO: 19044 - protein, 460 aa, Triticum aestivum
MAWRLALPLLLFYSPILVCSSSQEVQDNDPSKLFKSASEMMSLRKYDGALGLLNAVLELDPNHSEAYRQRATVLRHRCRHKEAESDYNKFLELKPGTASVEKELAQLLQAQNALESAYTQSDAGEFSKVLEYVNKIVLVFSPGCLKAKLLKAKALLALKDYSNVISETGFILKEDEDNLDALLLRGRAYYYLADHDVANRHYQKGLRLDPEHSELKKAYFGLKKLLKKTKSAEDNAAKSKFRVAVEDYKAALAMDPDHTLYNVQLHLGLCKTLVKLGRGKEAINTCTEALSIDEELVEALSQRGEAKLLTEDWEGAVEDLKEAAQKSPQDMAIREALMKAERQLKLSKRKDWYKILGISKTASAADIKRAYKRLALQWHPDKNVENREEAENMFREIASAYEVLSDEDKRVRYDRGEDLEEMGMGGGGGGGFDPFGGGGGQQYTFHHGGGFPGGFQFNFG

SEQ ID NO: 19045 - protein, 464 aa, Secale cereale
MAWRLALPLLLFYSPILCSSSVDVQDNNDPSKLFKSASEMMSLRKYDGALGLLNAVLELDPNHSEAYRQRATVLRHRCRHKEAESDYNKYLEMKPGTASVEKELAQLLQAQNALESAYTQSDAGEFSKVLEYVNKIVLVFSPGCLKAKLLKAKALLALKDYSNVISETGFILKEDEDNLDALLLRGRAYYYLADHDVANRHYQKGLRLDPEHSELKKAYFGLKKLLKKTKSAEDNAAKSKFRVAVEDYKAALAMDPDHTLYNVQLHLGLCKTLVKLGRGKEAINTCTEALSIDEELVEALSQRGEAKLLTEDWEGAVEDLKEAAQKSPQDMAIREALMKAERQLKLSKRKDWYKILGISKTASAADIKRAYKRLALQWHPDKNVENREEAENMFREIAAAYEVLSDEDKRVRYDRGEDLEEMGMGGGGGGFDPFGGGGGQQYTFHHGGGFPGGGFPGGFQFNFG

SEQ ID NO: 19046 - protein, 463 aa, Secale cereale
MAWRLALPLLLFYSPILCCSQDVQDNNDPSKLFKSASEMMSLRKYDGALGLLNAVLEIDPNHSEAYRQRATVLRHRCRHKEAESDYNKYLEMKPGTASVEKELAQLLQAQNALESAYIQSDAGEFSKVLEYVNKIVLVFSPGCLKAKLLKAKALLALKDYSNVISETGFILKEDEDNLDALLLRGRAYYYLADHDVANRHYQKGLRLDPEHSELKKAYFGLKKLLKKTKSAEDNAAKSKFRVAVEDYKAALAMDPDHTMYNVQLHLGLCKTLVKLGRGKEAINTCTEALSIDEELVEALSQRGEAKLLTEDWEGAVEDLKEAAQKSPQDMAIREALMKAERQLKLSKRKDWYKILGISKTASAADIKRAYKRLALQWHPDKNVENREEAENMFREIAAAYEVLSDEDKRVRYDRGEDLEEMGMGGGGGGFDPFGGGGGQQYTFHHGGGFPGGGFPGGFQFNFG

SEQ ID NO: 19047 - protein, 464 aa, Secale cereale
MAWRLALPLLLFYSPILCSSSVDVQDNNDPSKLFKSASEMMSLRKYDGALGLLNAVLEIDPNHSEAYRQRATVLRHRCRHKEAESDYNKYLEMKPGTASVEKELAQLLQAQNALESAYTQSDAGEFSKVLEYVNKIVLVFSPGCLKAKLLKAKALLALKDYSNVISETGFILKEDEDNLDALLLRGRAYYYLADHDVANRHYQKGLRLDPEHSELKKAYFGLKKLLKKTKSAEDNAAKSKFRVAVEDYKAALAMDPDHTMYNVQLHLGLCKTLVKLGRGKEAINTCTEALSIDEELVEALSQRGEAKLLTEDWEGAVEDLKEAAQKSPQDMAIREALMKAERQLKLSKRKDWYKILGISKTASAADIKRAYKRLALQWHPDKNVENREEAENMFREIAAAYEVLSDEDKRVRYDRGEDLEEMGMGGGGGGFDPFGGGGGQQYTFHHGGGFPGGGFPGGFQFNFG

SEQ ID NO: 19048 - protein, 464 aa, Triticum aestivum
MAWRLALPLLLFYAPILLCSSSQEVQDNDPSKLFKSASEMMSLRKYDGALGLLNAVLELDPNHSEAYRQRATVLRHRCRHKEAESDYNKFLELKPGTASVEKELAQLLQAQNALESAYSQSDAGEFSKVLEYVNKIVLVFSPGCLKAKLLKAKALLALKDYSNVISETGFILKEDEDNLDALLLRGRAYYYLADHDVANRHYQKGLRLDPEHSELKKAYFGLKKLLKKTKSAEDNAAKSKFRVAVEDYKAALAMDPDHTMYNVQLYLGLCKTLVKLGRGKEAINSCTEALSIDEELVDALAQRGEAKLLTEDWEGAVEDLKEAAQKSPQDMAIREALMKAERQLKLSKRKDWYKILGISKTASAADIKRAYKRLALQWHPDKNVENREEAENMFREIASAYEVLSDEDKRVRYDRGEDLEEMGMGGGGGSFDPFGGGGGQQYTFHHGGGFPGGGFPGGFQFNFG

SEQ ID NO: 19049 - protein, 439 aa, Triticum aestivum
QDNDPSKLFKSASEMMSLRKYDGALGLLNAVLELDPNHSEAYRQRATVLRHRCRHKEAESDYNKLLELKPGTASVEKELAQLLQAQNALESAYSQSDAGEFSKVLEYVNKIVLVFSPGCLKAKLLKAKALLALKDYSNVISETGFILKEDEDNLDALLLRGRAYYYLADHDVANRHYQKGLRLDPEHSELKKAYFGLKKLLKKTKSAEDNAAKSKFRVAVEDYKAALAMDPDHTLYNVQLHLGLCKTLVKLGRGKEAISTCTEALSIDEELVEALSQRGEAKLLTEDWEGAVEDLKEAAQKSPQDMAIREALMKAERQLKLSKRKDWYKILGISKTASAADIKRAYKRLALQWHPDKNVENREEAENMFREIASAYEVLSDEDKRVRYDRGEDLEEMGMGGGGGGFDPFGGGGGQQYTFHHGGGFPGGGFPGGFQFNFG

SEQ ID NO: 19050 - protein, 467 aa, Avena sativa
MARPWRLMLPLLLLYSPIVSSQEAQDNDPSTLFKRASEMMSLRKYDGALGLLNAVLEVDPNHSEAYRQRASVLRQRCRYKEAESDYNKYLELKPGTASVEKELSQLLQAKNALETAYTQADAGDFSKVLEYVNKIVLVFSPSCLKAKLLKAKALLALKDYSSVISETGFILKEDEDNLDALLLRGRAYYYLADHDVANRHYQKGLRLDPEHSELKKAYFGLKKLLKKTKSAEDNAAKSKLRMAAEDYKAALAMDPDHTLYNVNLYLGLCKTLVKLGRGKEAITTCTEALSIDEELVDALAQRGEAKLLTEDWEGAVEDLKEAAQKSPQDMGIREAYMKAEKQLKLSKRKDWYKILGISKTASAADIKRAYKRLALQWHPDKNQENREEAENMFREIAAAYEVLSDEDKRVRYDRGEDLDEMGGGGGGGGFHNPFGGGGGQQYTFHYDGGFPGGGGGGFPGGFQFNFG

SEQ ID NO: 19051 - protein, 467 aa, Brachypodium distachyon
MLRPWRMLLPLLLLYSPIVFSQEVQDNDPSTLFERASEMVSLRKYDGALGLLNAVLEVDPNHSEAYRQRASVLRDRCRYKEAESDYNKYLELKPGTALVEKELSQLLQAQNALESAYGQSDAGDFSKVLEYVKKIVLVFSPGCLKAKLLKAKALLALKDYSSVISETGFILKEDEDNLEALLLRGRAYYYLADHDVANRHYQKGLRLDPEHSELKKAYFGLKKLLKKTKSAEDNAAKSKLRVAAEDYKAALAMDPDHTLYNVHLYLGLCKTLVKLGRGKDAINSCTEALSIDGELVEALAQRGEAKLLSEDWEGAVEDLKEAAQKSPQDMGIRESLMKAERQLKMSKRKDWYKILGISKTASAADIKRAYKKLALQWHPDKNVENREEAENMFREIAAAYEVLSDEDKRVRYDRGEDVDEMNMGGGGGGGFNPFGGGGQQYTFHYDGGFPGGGGGGGFPGGFQFNFG

SEQ ID NO: 19052 - protein, 486 aa, Festuca arundinacea
MARPWRLMLPLLVLYSPIVYSQEAQDNDPSTLFKRASEMMSLRKYDGALGLLNAVLEVDPNHSEAYRQRASVLRQRCRYKEAESDYNKYLELKPGTASVEKELSQLLQAKNALESAYSQSDAGDFSKVLEYVKKIVLVFSPGCLQAKLLKAKALLALKDYSSVISETGFILKEDEDNLDALLLRGRAYYYLADHDVANRHYQKGLRLDPEHTELKKAYFGLKKLLKKTKSAEDNAAKSKLRMAAEDYKAALAMDPDHTLYNVNLYLGLCKTLVKLGRGKEAISSCTEALSIDEELVDALAQRGEAKLLTEDWEGAVEDLKEAAQKSPQDMGIREAYMKAEKQLKLSKRKDWYKILGISKTASAADIKRAYKRLALQWHPDKNQENREEAENMFREIAAAYEVLSDEDKRVRYDRGEDLDEMGGGGGGGGFNPFGGGGGQQYTFHYDGGFPGGGGGGGFPGAFSSTLVKAGQALLMTSSFLVTAMLF

SEQ ID NO: 19053 - protein, 410 aa, Secale cereale
MAWRLALPLLLFYSPILCSSSVDVQDNNDPSKLFKSASEMMSLRKYDGALGLLNAVLELDPNHSEAYRQRATVLRHRCRHKEAESDYNKYLEMKPGTASVEKELAQLLQAQNALESAYTQSDAGEFSKVLEYVNKIVLVFSPGCLKAKLLKAKALLALKDYSNVISETGFILKEDEDNLDALLLRGRAYYYLADHDVANRHYQKGLRLDPEHSELKKAYFGLKKLLKKTKSAEDNAAKSKFRVAVEDYKAALAMDPDHTMYNVQLHLGLCKTLVKLGRGKEAINTCTEALSIDEELVEALSQRGEAKLLTEDWEGAVEDLKEAAQKSPQDMAIREALMKAERQLKLSKRKDWYKILGISKTASAADIKRAYKRLALQWHPDKNVENREEAENMSERSPPHTRCLATRTSV

SEQ ID NO: 19054 - protein, 472 aa, Setaria italica
MVRAWGRAALPPLLILCLLHLQYSPLVVAQEGQEKDPATLFARASEMMNLRKYDGALGLLNAALEVDPNHSEAYRQRASVLRHKCRYKEAESDYNKYLELNPATASVEKELSQLLQAQNSLQSAYGQFDSGDFSKVLEYINKIVLVFSPGCLKAKLLKAKALLALKDYSSVISETGFILKEDEDNLDALLLRGRAYYYLADHDVASRHYQKGLRLDPEHSDLKKAYFGLKNLLKKTKSAEDNAARGKLRVSAEDYKAALAMDPDHTAYNVHLYLGLCKTLVKLGRGKEAISSCTEALNIDSDLVDALTQRGEAKLLSEDWEGAVQDLKEAAQKSPQDMGIREALMRAEKQLKLSKRKDWYKILGISKTASAAEIKRAYKKLALQWHPDKNVDNREEAENMFREIAAAYEVLGDEDKRVRYDRGEDIDEMNMGGGGGGGFNPFGGGGQQYTFHFDGGFPGGGFPGGGGFQFNF

SEQ ID NO: 19055 - protein, 472 aa, Echinochloa colona
MARAWGRAALPPFLILCLLHLQCSPLVFAQEGQEKDPATLFARASEMMSQRKFDGALGLLNAVLEVDPNHSEAYRQRASVLRHRCRYKEAESDYNKYLELNPGTASVEKELSQLLQAQNSLQSAYSQFDSGDFSKVLEYINKIVLVFSPGCLKAKLLKAKALLALKDYSSVISEAGFILKEDEDNLDALLLRGRAYYYLADHDVASRHYQKGLRLDPEHSDLKKAYFGLKNLLKKTKSAEDNAAKGKLRVSAEDYKTALAMDPDHTSYNVHLYLGLCKTLVKLGRGKEAISSCTEALNIDSDLVDALTQRGEAKLLSEDWEGAVHDLKEAAQKSPQDMGIREALMRAEKQLKLSKRKDWYKILGISKTASAAEIKRAYKKLALQWHPDKNVDNREEAENMFREIAAAYEVLGDEDKRVRYDRGEDVDEMNMGGGGGGFNPFGGGGQQYTFHFDGGFPGGGFPGGGGFQFNFG

SEQ ID NO: 19056 - protein, 473 aa, Oryza sativa
MARWPWRVLLPLLLLHSSPVFFVFAQEGQDNDPSTLFKRALEMMNLRKYDGSLGLLNAVLEVEPNHSEAYRQRASVLRHKCRYKEAEGDYSKYLELKPGSSSVEKELSQLLQAQNALESAYGQFESHDFSKVLDYINKIVLVFSPDCLKAKLLKAKALLALKDYSTVISETGFILKEDEDNLDALLLRGRAYYYLADHDVASRHYQKGLRLDPEHSELKKAYFGLKNLVKKTKSAEDNAAKGKLRVSAEDYKASLAMDPDHTSYNVHLYLGLCKVLVKLGRGKEAISSCTEALNIDGELVDALTQRGEAKLLTEDWEGAVQDLKEAAQKSPQDMGIREALMRAEKQLKLSKRKDWYKILGISKTASAAEIKRAYKKLALQWHPDKNVDKREEAENMFREIAAAYEVLGDEDKRVRYDRGEDLDEMNMGGGGGGGFNPFGGGGQQYTFHYDGGFHGGGGFPGGGFPGGFQFNFG

SEQ ID NO: 19057 - protein, 425 aa, Avena sativa
QEIHGALGLLNAVLEVDPNHSEAYRQRASVLRQRCRYKEAESDYNKYLELKPGTASVEKELSQLLQAKNALETAYTQADAGDFSKVLEYVNKTVLVFSPSCLKAKLLKAKALLALKDYSSVISETGFILKEDEDNLDALLLRGRAYYYLADHDVANRHYQKGLRLDPEHSELKKAYFGLKKLLKKTKSAEDNAAKSKLRMAAEDYKAALAMDPDHTLYNVNLYLGLCKTLVKLGRGKEAITTCTEALSIDEELVDALAQRGEAKLLTEDWEGAVEDLKEAAQKSPQDMGIREAYMKAEKQLKLSKRKDWYKILGISKTASAADIKRAYKRLALQWHPDKNQENREEAENMFREIAAAYEVLSDEDKRVRYDRGEDLDEMGGGGGGGGFHNPFGGGGGQQYTFHYDGGFPGGGGGGFPGGFQFNFG

SEQ ID NO: 19058 - protein, 600 aa, Arabidopsis lyrata
MVRIQKVESFYAKLRESATSLSSQNPLLIFPSTSDVDSLCALKVITHILESDSIQYSCFPVSSFLEIHKYAGPAGLCSTSSESPPVTILLINWGCHRDLKLVLKLGPAARVFVVDSHRPIHLHNLSDYNEQVVVLHTDDDERQADLAYDFDVLKLANESFQLHVEEGGESDEEEEEEEDEEEEDEDDDDDDGDGDRPSKRRKMGDGVKVFKKLKRDYYKMGTFHGKPSGCLLFELSHMLRKNTNELLWLACVALTDQFVHERLTDERYQAAVMELEQHINSSGNIDKITSVTLKDGTKVRAPDCSRISYEEEPRLMLLREWTLFDSMLCSSYIATKLKTWSDNGIKKLKLLLARMGFALIECQQKFPYMSHEVKRKMKQEFDRFLPEYGLNDFYYRSFLRLHGYSSRVSAADVVYGITALLESFLGSGGSSASKQFGEAYDALSLNNLDKLRSGMQQAIKVQRAILRQGSAAITKTGCIRSGRKFRWVKIEDSMDAKYLGYPQALTKFCYFLMDALREKGARMKPMLCACASQQPGKLLVVGVCGKPRLGAVRGNAFGNAFRKAAQESRADYFHELFESSWIVLDASAVNSFMIRLTEKL

SEQ ID NO: 19059 - protein, 593 aa, Brassica rapa
MVRIQKVESFYAKLRESATSSDSHNPLLIFPSSSDVDSICALKVITHILESDSIQYSCFPVSSFLEIHKYAGPGLCSSLESPVTILLINWGCHRDLKLVLKLGPKARVFVVDSHRPIHLHNLSDGNERVVVLHTDDDERQADLAYDFDVLKLANESYQMRQESVGVDESEDEDEEEEEEEEESDDGDRPSKRRKMGDDGVKLFKKLKRDYYKMGTFHGKPSGCLLFELSHFLRKNTNELLWLACVSLTDQFVHERLTDERYQAAVMELEQHINSSGNIDKVTSVTLKDGTKVRAPDCSRISYEEEPRLMLLREWNLFDSMLCSSYIATKLKTWSDNGIKKLKLLLARMGFALIECQQKFPYMNNEVKRKMKQEFDRFLPEYGLNDFYYRSFLRLHGYSSRVSAADVVYGITALLESFLGSGGSSASQQFGEAYDALSLNNLDKLRSGMQQAIKVQRAILRQGSAAITKTGCIRSGRKFRWVKVEDSIDAKYLGYPQALTKFCYFLMDALREKGARMKPMLCACASQELGKILVVGVCGKPRLGAVRGNAFGNAFRKAAQESRADYFHELFESSWIVLDASAVNSFMIRLTENL

SEQ ID NO: 19060 - protein, 600 aa, Eutrema parvulum
MVRIQKVESFYAKLRESATSSSSQNPLLIFPSSSDVDSICALKVITHVLESDSIKYSCFPVSSFLEIHKHAGPGLCSSSENPVTILLINWGCHRDLKVVLKLGPAARVFVVDSHRPIHLHNLSDQNEQVVVLHTDDDERQADLAYDFDVSKLANESFQIHKERADAGESDVENESDEEEEEEEEEEEESDDGDGNRPSKRRKLGDGVKVFKKLKRDYYRMGTFHGKPSGCLLFELSHLLRKNTNELLWLACVSLTDQFVHERLTDERYQAAVMELEQHINSSGNIDKITSVTLKDGTKVRAPDCSRISYEEEPRLMLLREWNLFDSMLCSSYIATKLKTWSDNGIKKLKLLLARMGFALIECQQKFPYMNNEVKRKMKQEFDRFLPEYGLNDFYYRSFLRLHGYSSRVSAADVVYGITALLESFLGSGGSSASKQFGEAYDALSLNNLDKLRSGMQQAIKVQRAILRQGSAAITKTGCIRSGRKFRWVKVEDSIDAKYLGYPQALTKFCYFLMDALREKGARMKPMLCACTSQQPGKILVVGVCGKPRLGAVRGNAFGNAFRKAAQESRTDYFHELFESSWIVLDASAVNSFMIRLTEKL

SEQ ID NO: 19061 - protein, 582 aa, Brassica oleracea
MVRIQKVESFYAKLRESATCSSSQNPLLIFPSSSDVDSICALKVITHILESDSVHYSCFPVSSFLEIHKYAGPGLCSSSASPVTILLINWGCHRDLKLVLKLGPAARVFVVDSHRPIHLHNLSDENQQVVVLHTDDDERQADLAYDFDVLKLANESFQIHQESGDESDGEEDESDDDRPSKRRKMGDGVKLFKKLKRDYYKMGTFHGKPSGCLLFELSHLLRKNTNELLWLACVSLTDQFVHERLTDERYQAAVMELEQHINSSGNIDKITSVTLKDGTKVRAPDCSRISYEEEPRLMLLREWNLFDSMLCSSYIATKLKTWSDNGIKKLKLLLARMGFALIECQQKFPYMNNEVKRKMKQEFDRFLPEYGLNDFYYRSFLRLHGYSSRVSAADVVYGITALLESFLGSGGSSASKQFGEAYDALSLNNLDKLRSGMQQAIKVQRAILRQGSAAITKTGCIRSGRKFRWVKVEDSIDAKYLGYPQALTKFCYFLMDALREKGARMKPMLCACASQQPGKILVVGVCGKPRLGAVRGNAFGNAFRKAAQESRADYFHELFESSWIVLDASAVNSFMIRLTEKL

SEQ ID NO: 19062 - protein, 596 aa, Eutrema halophilum
MVRIEKVESFYARLRESATSPSSQNPLMIFPSSSDVDSICALKVITHILESDSIQYSCFPVSSFSDIQKSTNGSLCSSSESPVTILLINWGCHRDLKVVLKLGPAARVFVVDSHRPIHLHNLSEQNEQVIVLHTDDDERQADLAYDFDVLKLANESFQLHVEREESDVESDEEEEDEEEEEDEEEEESDGDRPSKRRKMGDGVKVFKKLKRDYYRMGTFHGKPSGCLLFELSHMLRKNTNELLWLACVSLTDQFVHERLTDERYQAAVMELEQHINSSGNIDKLTSVTLKDGTKVRAPDCSRISYEEEPRLMLLREWTLFDSMLCSSYIAIKLKTWSDNGIKKLKLLLARMGFALIECQQKFPYMSHEVKRKMKQEFDRFLPEYGLNDFYYRSFLRLHGYSSRVSAADVVYGITALLESFLGSGGSSASKQFGEAYDALSLNNLDKLRSGMQQAIKVQRAILRQGSAAITKTGCIRSGRKFRWVKIEDSIDAKYLGYPQALTKFCYFLMDALREKGARMKPMLCACVSQEPGKILVVGVCGKPRLGAVRGNAFGNAFRKAAQESRADYFHELFESSWIVLDASAVNSFMIRLTEKL

SEQ ID NO: 19063 - protein, 592 aa, Brassica oleracea
MVRIQKVESFYAKLRESANSSDSQNPLLIFPSSSDVDSICALKVITHILESDSIQYSCFPVSSFLEIHKYAGPGLCSSSESPVTILLINWGCHRDLRLVLTLGPKARVFVVDSHRPIHLHNLSDGNESVVVLHTDDDERQADLAYDFDVLKLANESYQMHQESADVDESEEEEEEEEEEESDGDSDRPSKRRKMGGDGVKLFKKLKRDYYKMGTFHGKPSGCLLFELSHMLRKNTNELLWLACVSLTDQFVHERLTDERYQAAVMELEQHINSSGNIDKVTSVTLKDGTKVRAPDCSRISYEEEPRLMLLREWNLFDSMLCSSYIATKLKTWSDNGIKKLKLLLARMGFALIECQQKFPYMNNEVKRKMKQEFDRFLPEYGLNDFYYRSFLRLHGYSSRVSAADVVYGITALLESFLGSGGCSASQQFGEAYDALSLNNLDKLRSGMQQAIKVQRAILRQGSAAITKTGCIRSGRKFRWVKVEDSIDAKYLGYPQALTKFCYFLMDALREKGARMKPMLCACASQELGKILVVGVCGKPRLGAVRGNAFGSAFRKAAQESRADYFHELFESSWIVLDASAVNSFMIRLTENL

SEQ ID NO: 19064 - protein, 581 aa, Brassica rapa
MVRMEKVESFYGKLRESATCSSSQNPLLIFPSSSDVDSICALKVITHILESDSVPYSCFPVSSFLEIHNYAPPAEGPVTILLINWGCHRDLKLVLKLAPAARVFVVDSHRPIHLHNLSDENQQVVVLHTDDDERQADLAYDFDVLKLANESFQMHQESGVDESDDEESDDDEEESEDDRPSKRRKMGVKLLKKLKRDYYKMGTFHGKPSGCLLFELSHLLRKNTNELLWLACVSLTDQFVHERLTDERYQAAVMELEQHINSSGNIDKITSVTLKDGTKVRAPDCSRISYEEEPRLMLLREWNLFDSMLCSSYIATKLKTWSDNGIKKLKLLLARMGFALIECQQKFPYMNNEVKRKMKQEFDRFLPEYGLNDFYYRSFLRLHGYSSRVSAADVVYGITALLESFLGSGGSSASKQFGEAYDALSLNNLDKLRSGMQQAIKVQRAILRQGSAAITKTGCIRSGRKFRWVKVEDSIDAKYLGYPQALTKFCYFLMDALREKGARMKPMLCACASQQPGKILVVGVCGKPRLGAVRGNAFGNAFRKAAQESRADYFHELFESSWIVLDASAVNSFMIRLTEKL

SEQ ID NO: 19065 - protein, 348 aa, Zea mays
MASTYAPGGGARALAQGRCRVRGPAGLGFLGPSKAAGLPRPLALARRMSSPVAVGARLRCAASSSPAAARPATAPRFIQHKKEAFWFYRFLSIVYDHVINPGHWTEDMRDDALEPADLFSRHLTVVDVGGGTGFTTLGIVKHVNPENVTLLDQSPHQLDKARQKEALKGVTIMEGDAEDLPFPTDSFDRYISAGSIEYWPDPQRGIKEAYRVLRFGGLACVIGPVYPTFWLSRFFADMWMLFPKEEEYIEWFKKAGFRDVKLKRIGPKWYRGVRRHGLIMGCSVTGVKRERGDSPLELGPKAEDVSKPVNPITFLFRFLVGTICAAYYVLVPIYMWIKDQIVPKGMPI

SEQ ID NO: 19066 - protein, 349 aa, Sorghum bicolor
MAMASTYAPGGGAGALAPGKGRVRGPAGLGFLSPSKVGGLPRPLALAKRSPVAARLRCAASSSSPAAPAARPVTAPRFIQHKKEAFWFYRFLSIVYDHVINPGHWTEDMRDDALEPAELYSRHLKVVDVGGGTGFTTLGIVKHVNPEKVTLLDQSPHQLEKARQKEALKGVTIMEGDAEDLPFPTDSFDRYISAGSIEYWPDPQRGIKEAYRVLRFGGLACVIGPVYPTFWLSRFFADMWMLFPKEEEYIEWFTKAGFKDVKLKRIGPKWYRGVRRHGLIMGCSVTGVKRQSGDSPLELGPKAEDVSKPVNPITFFFRFLVGTICAAYYVLVPIYMWIKDQIVPKGMPI

SEQ ID NO: 19067 - protein, 358 aa, Pennisetum glaucum
MAMASTYAPGGGAAGALAPGRSTRVRGPAGLGGFSLTKAAGARPLSLARRSPAAAAAGPRQLLRCAASSSSSSSAAAAARPVSAPRFIQHKKEAFWFYRFLSIVYDHVINPGHWTEDMRDDALEPADLYSRHLKVVDVGGGTGFTTLGIVKHVNPENVTLLDQSPHQLDKARQKEALKGVTIMEGDAEDLPFPTDTFDRYVSAGSIEYWPDPQRGIKEAYRVLRMGGVACLIGPVYPTFWLSRFFADMWMLFPKEEEYIEWFQKAGFKDVKLKRIGPKWYRGVRRHGLIMGCSVTGVKRERGDSPLQLGPKAEDVSKPVNPITFLFRFLMGTICAAYYVLVPIYMWIKDQIVPKGMPI

SEQ ID NO: 19068 - protein, 348 aa, Oryza sativa
MAMASSAYAPAGGVGTHSAPGRIRPPRGLGFSTTTTKSRPLVLTRRGGGGGNISVARLRCAASSSSAAARPMSQPRFIQHKKEAFWFYRFLSIVYDHVINPGHWTEDMRDDALEPADLYSRKLRVVDVGGGTGFTTLGIVKRVDPENVTLLDQSPHQLEKAREKEALKGVTIMEGDAEDLPFPTDTFDRYVSAGSIEYWPDPQRGIKEAYRVLRLGGVACMIGPVHPTFWLSRFFADMWMLFPKEEEYIEWFKKAGFKDVKLKRIGPKWYRGVRRHGLIMGCSVTGVKREHGDSPLQLGPKVEDVSKPVNPITFLFRFLMGTICAAYYVLVPIYMWIKDQIVPKGMPI

SEQ ID NO: 19069 - protein, 350 aa, Brachypodium distachyon
MAMASTRAPSSAGSLAPGRRTLRPRSPAGLPGFLGLSPSKPTLRRPLALVSGARPCPPLFRCAASSSPAAARPASAPRFIQHKKEAFWFYRFLSIVYDHVINPGHWTEDMRDDALQPADLHSRKLKVVDVGGGTGFTTLGIVKHVEPENVTLLDQSPHQLEKARQKEALNGVTIIEGDAEDLPFPTDTFDRYVSAGSIEYWPDPQRGIKEAYRVLRLGGVACLIGPVHPTFWLSRFFADMWMLFPTEEEYIDWFKKAGFEDVKLKRIGPKWYRGVRRHGLIMGCSVTGVKRERGDSPLQLGPKAEDVSKPVNPITFFFRFLVGTICAAYYVLVPIYMWIKDQIVPKGMPI

SEQ ID NO: 19070 - protein, 348 aa, Leymus cinereus x Leymus triticoides
SAHAPSGAGSLAPGGMLRVRAPAGLGYLGLGPSKSVLRPVTLARRAPSGARSPLLRCAAASSPPAAAAARPASAPRFIQHKKEAFWFYRFLSIVYDHVINPGHWTEDMRDDALEPADLHSRKLKVVDVGGGTGFTTLGIVKHVDPANVTLLDQSPHQLEKARQKDALKGVEIMEGDAEDLPFPTDTFDRYVSAGSIEYWPDPQRGIKEAYRVLRLGGKACLIGPVHPTFWLSRFFADMWMLFPTEEEYIEWFTKAGFKDVQLKRIGPKWYRGVRRHGLIMGCSVTGVKRESGDSPLQLGPKAEDVSKPVNPITFFFRFLMGTICAAYYVLVPIYMWIKDQIVPKGMPI

SEQ ID NO: 19071 - protein, 291 aa, Echinochloa colona
ARLRCAASSAPARPVSAPRFIQHKQEAFWFYRFLSIVYDHVINPGHWTEDMRDDALEPADLYSRHLKVVDVGGGTGFTTLGIVKHVDPQNVTLLDQSPHQLEKARQKDALKGVTIMEGDAEDLPFPTDTFDRYVSAGSIEYWPDPQRGIKEAYRVLRLGGTACLIGPVYPTFWLSRFFADMWMLFPKEEEYIEWFTKAGFKDVKLKRIGPKWYRGVRRHGLIMGCSVTGVKRERGDSPLELGPKAEDVSKPVNPITFLFRFLMGTICAAYYVLVPIYMWIKDQIVPKGMPI

SEQ ID NO: 19072 - protein, 308 aa, Sorghum bicolor
MKFGKSLSGQIVETLPEWRDKFLSYKDLKKRLKLIGAGNGAAERQPKRARRDDAGEPDASAAAAAMTPEEADFMRLLEAELDKFNSFFVEKEEEYIIRQKELQDRVARAAGRESKEELMRVRKEIVDFHGEMVLLENYSALNYTGLVKILKKYDKRTGALIRLPFIQKVLQQPFFTTDLLYKLVKQCEAMLEQLLPVSEASVSSEDVKGDSNDEEKLAKPSSSLVNGGGIPELDEIEYMESMYMKSTVAALRSLKEIRSKSSTVSMFSLPPLQGNNAQDSYQIRAEQTKLDEEPERWSKVTVIEQAAK

SEQ ID NO: 19073 - protein, 298 aa, Panicum virgatum
MKFGKSLSGQIVETLPEWRDKFLSYKDLKKRLKLIGAGNNGAERPPKRARRDDAGEADAASPAAAVAMTPEEADFMRLLEAELDKFNSFFVEKEEEYIIRQKELQDRVARAAGQESKEELMRVRKEIVDFHGEMVLLENYSALNYTGLVKILKKYDKRTGALIRLPFIQKVLQQPFFTTDLLYKLVKQCEAMLEQLLPTTSEPSVSREDGKGDSNDEEKPANPTSSLLNGGGIPELDEIEYMESMYMKSTVAALRSLKEIRSKSSTVSMFSLPPLQGNNAPEEPERWNKIPVIEQAAK

SEQ ID NO: 19074 - protein, 293 aa, Panicum virgatum
MKFGKSLSGQIVETLPEWRDKFLSYKDLKKRLKLIGAGNGAERQPKRARRDDAGEADASPAAAMTPEEADFMRLLGAELDKFNSFFVEKEEEYIIRQKELQDLVARVAGQESKEELMRARKEIVDFHGEMVLLENYSALNYTGLVKILKKYDKRTGALIRLPFIQKVLQQPFFTTDLLYKLVKQCEAMLEQFLPTSEPSVSREDGKGDSNDEEKPANPTSSLLNGDGIPELDEIEYMESMYMKSTVAALRSLKEIRSKSSTVSMFSLPPLQGNNAPEEPERWNKIPVIEQAAK

SEQ ID NO: 19075 - protein, 302 aa, Setaria italica
MKFGKSLSGQIVETLPEWRDKFLSYKDLKKRLKLIGAGAGSGAERQPKRARREDGGKADASSGAPAAAAAAAAMTPEEADFMQLLEAELDKFNSFFVEKEEEYIIRQKELQDRVARAAGQDSKEELMRVRKEIVDFHGEMVLLENYSALNYTGLVKILKKYDKRTGALIRLPFIQKVLQQPFFTTDLLYKLVKQCETMLEQLLPTSKPSVSREDGKVDSNDEEKPAKPTSLVNGSGIPDLDELEYMEGMYMKSTVAALRSLKEIRSKSSTVSMFSLPPLQGNNAPEEPERWNKIPVIEQAAK

SEQ ID NO: 19076 - protein, 303 aa, Pennisetum glaucum
MKFGKSLSGQIVETLPEWRDKFLSYKDLKKRLKLIGAGGAGAGSAAERQPKRARREDAGEADASSAAPAAAAAMTPEEADFMQLLEAELDKFNSFFVEKEEEYIIRQKELQDRVARVAGQDSKEELMLVRKEIVDFHGEMVLLENYSALNYTGLVKILKKYDKRTGALIRLPFIQKVLQQPFFTTDLLYKLVKQCETMLGQLMPTSKPTVSCEDGKVDSNDQEKPAKPTSSLVNGSGIPDLDELEYMEGMYMKSTVAALRSLKEIRGKSSTVSMFSLPPLQGNNAPEEPEKWNKIPVIEQAAK

SEQ ID NO: 19077 - protein, 293 aa, Echinochloa colona
MKFGKSLSAQIVETLPEWRDKFLSYKDLKKRLKLIGAGAGDGAERPPKRARRDDAGGEADAAAMTPEEAEFMQLLEAELEKFNSFFVEKEEEYIIRQKELQDRVARAAGQESKEELMRARKEIVDFHGEMVLLENYSALNYTGLVKILKKYDKRTGALIRLPYSQKVLQQPFFTTDILLKLVKQCETMLEQLMPTSEPSVSSKDGKRESNGEATPAKPTSTLVNGGGIPELDEIEYMESMYMKSTIAALRSLKEIRSKSSTVSMFSLPPLQSNTAPEELERWNKIPVIEQAAK

SEQ ID NO: 19078 - protein, 295 aa, Oryza sativa
MKFGKSLSSQIVETLPEWRDKFLSYKDLKKRLKLIGGGGGGEERQAKRARVAADGGEEEAAAAAMTPEEAGFMRLLEAELDKFNSFFVEKEEEYIIRQKELQDRVARAAGRESKEELMRVRKEIVDFHGEMVLLENYSALNYTGLVKILKKYDKRTGALIRLPFIQKVLQQPFFTTDLLYKLVKQCEAMLDQLLPSNELSVSSEDGRGDSTNEDKPSNPSSSLVNGGTIPELDEIEYMESMYMKGTVAALRSLKEIRSGSSTVSAFSLPPLQGDSSPEEQQELWNKIPVIEQAAK

SEQ ID NO: 19079 - protein, 212 aa, Saccharum officinarum
TDLKKFIRGHRSNREKIPSATVKILMYQLCKGVAFVHGRGVLHRDLKPHNLLMDRKTMALKIADLGLSRAITVPVKKYTHEILTLWYRAPEILLGATHYSTPVDIWSVGCIFAELVTNQPLFPGDSELQQLLRIFKLLGTPNEEVWPGVGKLPNWHEYPQWKPTKLSTLVPGLDADGYDLLEKMLEYEPAKRIPAKKALEHPYFNDVRKEMH

SEQ ID NO: 19080 - protein, 411 aa, Hordeum vulgare
MAAAADFTQSKQAMSYALCKHLNLDPNSISSTLIKENDIVSLFSHIVTSPQDEVKKWVDFSSNFAVSDGEQHAVLGNLNQHLSQMSVLLGGFKPSAADIIVFATVHVFMCHLSDSELQKYPNILRWMDYIQNVVDFGMTLQKINLTKSIFNPPAPAPSHPKKADKGDGDPNSKKAVSGQKNADKSDGAADSKKAAGENKVPGDKANPTSAKNNKPSGDKKKAQEKTAGKTTEAAAEKAPQKSAEKDSECSVSILNIQVGVIRKAWKHPSADSLLVEEIDLGDGNVRQVVSGLAKFFSPDELVNRHVVLITNVKPGKLRDVMSAGLVLCASNKDHTVVEPLIPPEGAKLGERISFAGFDGKPEDVLNPKKKQLDKITPHLRTDENGIATFRGVPFTTSAGPCRSSVPNADVK

SEQ ID NO: 19081 - protein, 413 aa, Secale cereale
MAAAAAADFTQSKQAMSHALCKHLNLDPNSISSTLIKENDIASLFSHIVTSPQDEVKKWVEFSSNFVQSDGEQHALLGNLNQHLSQTSVLLAGFKPSAADIVVFATVHVFMCHLSDSELQKYPNILRWMDYIQNVVDFGTTLQKIKLTKSIFNPPAPAPSHPKKADKGDGEPNSKKAVSGQKIADKSDGAADSKKAAGENKVPGDKANPTSAKNNKPSGDKKKVQENSAGKTTEAAAEKAPQKSAEKDSECSVSILNIQVGVIRKAWKHPSADSLLVEEIDLGDGNVRQVVSGLAKFFSPDELVNRHVVLITNVKPGKLRDVMSAGLVLCASNKDHTVVEPLIPPEGAKLGERISFAGFDGKPEDVLNPKKKQLDKITPHLRTDENGIATFRGVPFTTSAGPCRSSVPNADVK

SEQ ID NO: 19082 - protein, 411 aa, Triticum aestivum
MAAAADFTQSKQAMSYALCKHLNLDPNSISSTLIKENDIASLFSHIVTSPQDEVKKWVEFSSNFVLSDGEQHALLGNLNQHLSQMSVLLAGFKPSAADIIVFATVHVFMCHLSDSELQKYPNILRWMDYIQNVVDFGMTLQKINLTKSIFNPPAPAPSHPKKADKGDGEPNSKKAVSGQKVADKSDGAADSKKAAGENKVPGDKANPTSAKNNKPSGDKKKVQEKTAGKTTEAAAEKAPQKSAEKDSECSVSILNIQVGVIRKAWKHPSADSLLVEEIDLGDGNVRQVVSGLAKFFSPDELVNRHVVLITNVKPGKLRDVMSAGLVLCASNKDHTVVEPLIPPEGAKLGERISFAGFDGKPEDVLNPKKKQLDKITPHLRTDENGIATFRGVPFTTSAGPCRSSVPNADVK

SEQ ID NO: 19083 - protein, 404 aa, Brachypodium distachyon
MAAAADFAQSKQAMSYALCKHLNRDPSDISSTIIKESDIASLFSHIVNPSQDEVKKWVEFSSNFVQSDGEQHVLLGNLNQHLSQMSVLLAGGFKPSVADIVVFATVHVFMCHLSDSELQKCPHILRWMDYIQNAVDFGTTVQKINVTKSVFNPPSHPKKAEKGDVDPSCKKVLSGQKITEKSDGTADSKKAAVENKVPGDQANPTSAKNNKPSGDKKKAQEKTAGKATEAAPQKSAEKDSECSVSILNIQVGVIRKAWKHPSADSLLVEEIDLGDGNVRQVVSGLAKFFNPDDLVNRHVVLITNVKPGKLRDVMSAGLVLCASNKDHTIVEPLIPPEGAKLGERISFAGFDGKPEDVLNPKKKQLDKITPHLRTDENGIATFRGIPFITSAGPCRSSVPNADVK

SEQ ID NO: 19084 - protein, 405 aa, Leymus cinereus x Leymus triticoides
MAAAADFAQSKQAMSYALCKHLNLDPNSISSTLIKENDIVSLFSHIVTSPQDEVKKWVEFSSNFVLSDGEQHALLGNLNQHLSQMSVLLAGFKPSAADIIVFATVHVFVCHLSDSELQKYPNILRWMDYIQNVVDFGMTLQKINLTKSPSPSHPKKADKGDGDPNSKKAVPGQKIADKSDGAADSKKAAGENKVPGDKANPTSAKNNKPSGDKKEVQEKTAGKTTEAAAEKAPQKSADKDSECSVSILNIQVGVIRKAWKHPSADSLLVEEIDLGDGNVRQVVSGLAKFFSPDELVNRHVVLITNVKPGKLRDVMSAGLVLCASNKDHTVVEPLIPPEGAKLGERISFAGFDGKPEDVLNPKKKQLDKITPHLRTDENGIATFRGIPFTTSAGPCRSSVPNADVK

SEQ ID NO: 19085 - protein, 411 aa, Avena sativa
MAAAAADFARSKEAMSYALCIHLDRDPKSISSTLIKESDIASLFSHFVNNPDDEVKKWVEFSSNFASSDGEQHTLLGNLNQHLSQMSVILASGFIPSVADIVVFATVQVFMSHLSDSELQKYPNILRWMDYIQNTIDFGTALQKINVAKSVFNPPSPSPPKKADKGDTDPSSKKAVSGQKIAAKSDGAADSKKAAEENKVPGDKANATSAKNNKPSGDKKKAQEKTTGKTTEAAAEKAPQKSAEKDSECNVSILNIQVGLIRKAWKHPSADSLLVEEIDLGDGNVRQVVSGLAKFFSPDEIVNRRVVLITNVKPGKLRDVMSAGLVLCASNKDHTVVEPLIPPEEAKLGERISFAGFDGKPEDVLNPKKKQLDKITPHLRTDENGIATFRGVPFTTSAGPCRSSVPNADVK

SEQ ID NO: 19086 - protein, 411 aa, Secale cereale
MAAAADFTQSKQAMSHALCKHLNLDPNSISSTLTKENDIASLFSHIVTSPQDEVKKWVEFSSNFVQSDGEQHALLGNLNQHLSQTSVLLAGFKPSAADIVVFATVHVFMCHLSDSELQKYPNILRWMDYIQNVVDFGTTLQKIKLTKSIFNPPAPAPSHPKKADKGDGEPNSKKAVSGQKIADKSDGAADSKKAAGENKVPGDKANPASAKNNKPSGDKKKVQEKTAGKTTEAAAEKAPQKSAEKDSECSVSILNIQVGVIRKAWKHPSADSLLVEEIDLGDGNVRQVVSGLAKFFSPDELVNRHVVLITNVKPGKLRDVMSAGLVLCASNKDHTVVEPLIPPEGAKLGERISFAGFDGKPEDVLNPKKKQLDKITPHLRTDENGIATFQGVPFTTSAGPCRSSVPNADVK

SEQ ID NO: 19087 - protein, 411 aa, Secale cereale
MAAAADFTQSKQAMSHALCKHLNLDPNSISSTLTKENDIASLFSHIVTSPQDEVKKWVEFSSNFVQSDGEQHALLGNLNQHLSQTSVLLAGFKPSAADIVVFATVHVFMCHLSDSELQKYPNILRWMDYIQNVVDFGTTLQKIKLTKSIFNPPAPAPSHPKKADKGDGEPNSKKAVSGQKIADNSDGAADSKKAAGENKVPGDKANPASAKNNKPSGDKKKVQEKTAGKTTEAAAEKAPQKSAEKDSECSVSILNIQVGVIRKAWKHPSADSLLVEEIDLGDGNVRQVVSGLAKFFSPDELVNRHVVLITNVKPGKLRDVMSAGLVLCASNKDHTVVEPLIPPEGAKLGERISFAGFDGKPEDVLNPKKKQLDKITPHLRTDENGIATFRGVPFTTSAGPCRSSVPNADVK

SEQ ID NO: 19088 - protein, 410 aa, Avena sativa
MAAAADFARSKEAMSYALCIHLDRDPKSISSTLIKESDIASLFSHFVNNPDDEVKKWVEFSSNFASSDGEQHTSLGNLNQHLSQMSVILASGFIPSVADIVVFATVQVFMSHLSDSELQKYPNILRWMDYIQNTIDFGTALQKINVPKSVFNPPSPSPPKKADKGDTDPSSKKAVSGQKIAAKSDGAADSKKAAEENKVPGDKANATSAKNNKPSGDKKKAQEKTTGKTTEAAAEKAPQKIAEKDSECNVSILNIQVGLIRKAWKHPSADSLLVEEIDLGDGNVRQVVSGLAKFFSPDEIVNRRVVLITNVKPGKLRDVMSAGLVLCASNKDHTVVEPLIPPEGAKLGERISFAGFDGKPEDVLNPKKKQLDKITPHLRTDENGIATFRGVPFTTSAGPCRSSVPNADVK

SEQ ID NO: 19089 - protein, 968 aa, Avena sativa
QQSGSPTSTATTTSSSRLTPEMSLDGGPASPRPDDDQPTKENVTVTVRFRPLSPREIRQGEEVAWYADGDTVVRSEQNPNVGYAYDRVFAPTTTTRQVYDVAAQHVVSGAMEGIFGTIFAYGVTSSGKTHTMHGDQRSPGIIPLAVKDAFSIIQETPDREFLLRVSYLEIYNEVVNDLLNPAGQSLRIREDPQGTFVEGIKEEVVLSPAHALSLIAAGEEHRHVGSTNFNLLSSRSHTIFTLTIESSSYGESNEGEAVTFSQLHLIDLAGSESSRAETTGVRRKEGSYINKSLLTLGTVISKLTDGKATHIPFRDSKLTRLLQSSLSGQGRVSLICTVTPASSNSEETHNTLKFAHRAKRIEVQASQNKIIDEKSLIKKYQNEIRRLKEELEQLKMGIICGTPSKEAEEDNIILWKQKLEDGNVKLQSRLEQEEEAKSALLARIQRLTKLILVSTKATQTSRFSPHPGPRRRHSFGEEELAYLPYRRRDIMLDNESNELLTPGEGFGVTLEDSSKEEKKNRKGLLNWFKIRKRDGGASTLTSSDCDKSSLTKSTAPSTPIGGSMNFPAEPRISNSLVNDSISADMLSIAHGEFPSDDLPGEETILASSKTIDHVDLLREQLKILSGEVALHTSVLKRLTEEAARNPNSEKIQMKMKKTSDEIKAKQQQITSLEKQIPHSLSDSQVKVDKLDLSPSYAELLEQLNEKSFELEVKAADNRVIQDQLEEKTSECLELQEAVSLLKEHLSQALQAKDSLSNSIVMQNSSGANHEVQHSDQEKTVPREISAEPLQKEQQSVEIGELKQRLCELDKVKAQLEARNQKLLEESTYAKGLASAAGVELKALSEEVTKLMNQNEKLASELASLRSPTPRRASNGPRGTNTRRESMSRRNEPASRRDGNASHERERVLETVLMEKEQKEAELQRKVEESKQKEAFLESELANMWVLVAKLKKSQGEDHEDLDAKYNGS

SEQ ID NO: 19090 - protein, 996 aa, Secale cereale
MATRPASRQRRAAKGSQQQQSGSPTSTATTSSSRLTPEMMSSLEGPASPRLAAGLDADADDLAATKENVTVTVRFRPLSPREIRQGEEVAWYADGDTVVRSEQNPNVGYAYDRVFAPTTTTRQVYDVAAQHVVSGAMEGIYGTIFAYGVTSSGKTHTMHGDQRSPGIIPLAVKDAFSIIQETPNREFLLRVSYLEIYNEVVNDLLNPAGQSLRIREDPQGTFVEGIKEEVVLSPAHALSLIAAGEEHRHVGSTNFNLLSSRSHTIFTLTIESSSYGDSNEGEAVTFSQLNLIDLAGSESSRAETTGVRRKEGSYINKSLLTLGTVISKLTDGKATHIPFRDSKLTRLLQSSLSGQGRVSLICTVTPASSNSEETHNTLKFAHRAKRIEVQASQNKIIDEKSLIKKYQNEIRRLKEELEQLKMGIITGTPLKDAEDDNMILWKQKLEDGNVKLQSRLEQEEEAKSALLARIQRLTKLILVSTKATPTSRFSPHPGPRRRHSFGEEELAYLPYRRRDIMLDNESNELLTPGEGFGVTPEDSSKEEKKNRKGLLNWFKIRKRDGGASTLASSECDKSSLTKSTAPSTPIGESLNFPAEPRISTSLVNESESADMLSIGHGDFPSDGLTGEEASLASTKTIDHVDLLREQLKILSGEVALHTSVLKRLTEEAGRNPNSEKIQMKMKKISDEIKAKQQQISSLEKQMPHSLSNSQVKVDKLDLSPSYGELLEQLNEKSFELEVKVADNRVIQEQLQEKTTECMELQEAVACLKEHLSQALQAKDSLSNSIMMQNSSGANHEEQHSDQEKPVSRDISAEQLQKEQQSLELGELKHRVHELTEVKVQLEARNQKLLEESTYAKGLASAAGVELKALSEEVTKLMNQNEKLASELASLRSPTPRRVSNGPRGTARRESMSRRNEPASRRDGNAREERERALETILAEKEQKEAELQRKVEESKQKEAFLESELANMWVLVAKLKKSRGMMTMRIWRPNIMAPES

SEQ ID NO: 19091 - protein, 977 aa, Secale cereale
QQQSGSPTSTATTSSSRLTPEMMSSLEGPASPRLAAGLDADADDLAATKENVTVTVRFRPLSPREIRQGEEVAWYADGDTVVRSEQNPNVGYAYDRVFAPTTTTRQVYDVAAQHVVSGAMEGIYGTIFAYGVTSSGKTHTMHGDQRSPGIIPLAVKDAFSIIQETPNREFLLRVSYLEIYNEVVNDLLNPAGQSLRIREDPQGTFVEGIKEEVVLSPAHALSLIAAGEEHRHVGSTNFNLLSSRSHTIFTLTIESSSYGDSNEGEAVTFSQLNLIDLAGSESSRAETTGVRRKEGSYINKSLLTLGTVISKLTDGKATHIPFRDSKLTRLLQSSLSGQGRVSLICTVTPASSNSEETHNTLKFAHRAKRIEVQASQNKIIDEKSLIKKYQNEIRRLKEELEQLKMGIITGTPLKDAEDDNMILWKQKLEDGNVKLQSRLEQEEEAKSALLARIQRLTKLILVSTKATPTSRFSPHPGPRRRHSFGEEELAYLPYRRRDIMLDNESNELLTPGEGFGVTPEDSSKEEKKNRKGLLNWFKIRKRDGGASTLASSECDKSSLTKSTAPSTPIGESLNFPAEPRISTSLVNESESADMLSIGHGDFPSDGLTGEEASLASTKTIDHVDLLREQLKILSGEVALHTSVLKRLTEEAGRNPNSEKIQMKMKKISDEIKAKQQQISSLEKQMPHSLSNSQVKVDKLDLSPSYGELLEQLNEKSFELEVKVADNRVIQEQLQEKTTECMELQEAVACLKEHLSQALQAKDSLSNSIMMQNSSGVNHEEQHSDQEKPVSRDISAEQLQKEQQSLELGELKQRVHELTEVKVQLEARNQKLLEESTYAKGLASAAGVELKALSEEVTKLMNQNEKLASELASLRSPTPRRVSNGPRGTARRESMSRRNEPASRRDGNAREERERALETILAEKEQKEAELQRKVEESKQKEAFLESELANMWVLVAKLKKSRGDDDHEDLEAKYNGS

SEQ ID NO: 19092 - protein, 404 aa, Saccharum officinarum
MEAPPGPEPMELDAPPPAAAEAAAAVPPAGSEKKKEGEGGDAVTGHIISTTIGGKNGEPKRTISYMAERVVGTGSFGIVFQAKCLETGETFAIKKVLQDRRYKNRELQLMRAMEHPNVICLKHCFFSTTSRDELFLNLVMEFVPETLYRVLKHYSNANQRMPLIYVKLYMYQLFRGLAYIHNVPGVCHRDVKPQNVLVDPLTHQVKLCDFGSAKVLVPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRAPNARLPNGRPFPLLFNFKHELANASPDLINRLVPEHIRRQNGVNFGHIGS

SEQ ID NO: 19093 - protein, 406 aa, Zea mays
MEAPPVPELMDLDAPPPAAADAAAAAPVPPAVSDKKKEGEGGDTVTGHIISTTIGGKNGEPKRTISYMAERVVGTGSFGIVFQAKCLETGETFAIKKVLQDRRYKNRELQLMRAMEHPNVICLKHCFFSTTSRDELFLNLVMEFVPETLYRVLKHYSNANQRMPLIYVKLYMYQLFRGLAYIHNVPGVCHRDVKPQNVLVDPLTHQVKLCDFGSAKVLIPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRAPNARLPNGRPFPPLFNFKHELANASPDLINRLVPEHIRRQNGVNFGHIGS

SEQ ID NO: 19094 - protein, 400 aa, Zea mays
MEAPPGPGPMELDAPPPAAAAAAIPPAGSDKHKDGEGGDAVTGHIISTTIGGKNGEPKRTISYMAERVVGTGSFGIVFQAKCLETGETFAIKKVLQDRRYKNRELQLMRAMEHPNVICLKHCFFSTTSRDELFLNLVMEFVPETLYRVLKHYSNANQRMPLIYVKLYMYQLFRGLAYIHNVPGVCHRDVKPQNVLVDPLTHQVKLCDFGSAKVLIPGEPNISYICSRYYRAPELIFGATEYTSSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRTPNARLPNGRPFPPLFNFKHELANASPDLVSRLVPEHIRRQIGVNFGSS

SEQ ID NO: 19095 - protein, 406 aa, Panicum virgatum
MDAPPGPEPMALDAPPAATAAEDAAAAVPPAGGEKKKEGQEGERVPGHIISTTIGGKNGEPKRTISYMAERVVGTGSFGIVFQAKCLETGETFAIKKVLQDRRYKNRELQLMRAMEHPNVICLKHCFFSTTPRDELFLNLVMEYVPETLYRVLKHYSNANQRMPLIYVKLYMYQLFRGLAYIHTVPGVCHRDVKPQNVLVDPLTHQVKLCDFGSAKVLIPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRAPNARLPNGRPFPLLFNFKHELANASPDLINRLIPEHIRRQHGVNFGHTGS

SEQ ID NO: 19096 - protein, 407 aa, Echinochloa colona
MEAPPGPEPMELDAPPAAAAATDATAAVVPPAGSEKKKEDAGRDGVPGHIISTTIGGKNGEPKRTISYMAERVVGTGSFGIVFQAKCLETGETFAIKKVLQDRRYKNRELQLMRAMEHPNVICLKHCFFSTTPRDELFLNLVMEYVPETLYRVLKHYSNANQRMPLIYVKLYMYQLFRGLAYIHTVPGVCHRDVKPQNVLVDPLTHQVKLCDFGSAKVLIPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRASNARLPNGRPFPPLFNFKHELANASPELINRLIPEHIRRQHGINFGHTGS

SEQ ID NO: 19097 - protein, 406 aa, Setaria italica
MEAPPGPEPMALDAPPAAGDATAAAAAVAPAGDEKKKEGEGGDKMPGHIISTTIGGKNGEPKRTISYMAERVVGTGSFGIVFQAKCLETGETFAIKKVLQDRRYKNRELQLMRAMEHPNVVCLKHCFFSTTPRDELFLNLVMEYVPETLYRVLKHYSNANQRMPLIYVKLYMYQLFRGLAYIHTVPGVCHRDVKPQNVLVDPLTHQVKLCDFGSAKVLIPGEPNISYICSRYYRAPELIFGATEYSTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRAPNARLPNGRPFPPLFNFKHELANASPELVNRLIPEHIRRQHGVNFGHAGS

SEQ ID NO: 19098 - protein, 407 aa, Oryza sativa
MEAPPGPEPMELDAPPPPAAVAAAAATAGISEKVLQKKEEGGGDAVTGHIISTTIGGKNGEPKRTISYMAERVVGTGSFGIVFQAKCLETGETVAIKKVLQDRRYKNRELQLMRAMEHPNVICLKHCFFSTTSRDELFLNLVMEYVPETLYRVLKHYSNANQRMPLIYVKLYIYQLFRGLAYIHTVPGVCHRDVKPQNVLVDPLTHQVKLCDFGSAKVLVPGEPNISYICSRYYRAPELIFGATEYTTSIDIWSAGCVLAELLLGQPLFPGESAVDQLVEIIKVLGTPTREEIRCMNPNYTEFKFPQIKAHPWHKIFHKRMPPEAIDLASRLLQYSPSLRCTALDACAHSFFDELREPNARLPNGRPFPPLFNFKHELASASPELIHRLIPDHIRRQHGLNFAHAGS

SEQ ID NO: 19099 - protein, 399 aa, Brachypodium distachyon
MEAPPGSEAMALDAPPPGAAVAGPAVGDKRKEEGGDPVTGHIISTTIGGKNGEPKRTISYMAERVVGTGSFGIVFQAKCLETGETVAIKKVLQDRRYKNRELQLMRSMDHPNVVSLKHCFFSTTSRDELFLNLVMEYVPETLYRVLKHYSNANQRMPLIYVKLYMYQLFRGLAYIHAVPGVCHRDVKPQNVLVDPLTHQVKICDFGSAKVLVPGEPNISYICSRYYRAPELIFGATEYTTSIDIWSAGCVLAELLLGQPLFPGETAVDQLVEIIKVLGTPTREEIRCMNPNYTEFRFPQIKAHPWHKIFHKRMPAEAIDLASRLLQYSPSLRCTALDACAHSFFDELREPNARLPNGRPFPPLFNFKPELVNASPELINRLIPEHVRRQNSLNFAHSGS

SEQ ID NO: 19100 - protein, 398 aa, Avena sativa
MEAAPEPMELDAPPPLAAAVPAHAGNEKKREDGGDPVTGHIISTTIGGKNGEPKRTISYMAERVVGTGSFGIVFQAKCIETGETVAIKKVLQDRRYKNRELQLMRSMDHPNVVSLKHCFFSTTSRDELFLNLVMEYVPETLYRVLKHYSNANQRMPLIYVKLYMYQLFRGLAYIHTVPGVCHRDVKPQNVLVDPLTHQVKLCDFGSAKVLVPGEPNISYICSRYYRAPELIFGATEYTTSIDIWSAGCVLAELLLGQPLFPGETAVDQLVEIIKVLGTPTREEIRCMNPNYTEFRFPQIKAHPWHKIFHKRMPAEAIDLASRLLQYSPSLRCTALDACAHSFFDELREPNARLPNGRPFPPLFNFKPELANASPDLISRLIPEHVRRQNSLNFAHAGS

SEQ ID NO: 19101 - protein, 400 aa, Secale cereale
MEAPPGPEPMVLDAPPPLAAAVPAHAATEKARTEGGDPVTGHIISTTIGGKNGEPKRTISYMAERVVGTGSFGIVFQAKCLETGETVAIKKVLQDRRYKNRELQLMRSMDHPNVVSLKHCFFSTTSRDELFLNLVMEYVPETLYRVLKHYSNANQRMPLIYVKLYMYQLFRGLAYVHTVPGVCHRDVKPQNVLVDPLTHQVKICDFGSAKVLVPGEPNIAYICSRYYRAPELIFGATEYTTSIDIWSAGCVLAELLLGQPLFPGETAVDQLVEIIKVLGTPTREEIRCMNPNYTEFRFPQIKAHPWHKIFHKRMPAEAIDLASRLLQYSPNLRCTALDACAHSFFDELREPNARLPNGRPFPPLFNFKPELANASPELINRLVPEHVRRQNGLNFAHAGS

SEQ ID NO: 19102 - protein, 380 aa, Pennisetum glaucum
AVAPAGDEKRKEGEGEDKMPGHIISTTIGGKNGEPKRTISYMAERVVGTGSFGIVFQAKCLETGETFAIKKVLQDRRYKNRELQLMRAMEHPNVVCLKHCFFSTTPRDELFLNLVMEYVPETLYRVLKHYSNANQRMPLIYVKLYMYQLFRGLAYIHTVPGVCHRDVKPQNVLVDPLTHQVKLCDFGSAKVLIPGEPNISYICSRYYRAPELIFGATEYSTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRAPNARLPNGRPFPPLFNFKHELANASPELINRLIPEHIRRQHGVNFGHTGS

SEQ ID NO: 19103 - protein, 390 aa, Panicum virgatum
CRHRRRRGRGGGGSPAGGEKKEGEGGERVPGHIISTTIGGKNGEPKRTISYMAERVVGTGSFGIVFQAKCLETGETFAIKKVLQDRRYKNRELQLMRAMEHPNVICLKHCFFSTTPRDELFLNLVMEYVPETLYRVLKHYSNANQRMPLIYVKLYMYQLFRGLAYIHTVPGVCHRDVKPQNVLVDPLTHQVKLCDFGSAKVLIPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCSALDACAHPFFDELRAPNARLPNGRPFPPLFNFKHELANASPELVNRLIPEHIRRQHGVNFGHTGS

SEQ ID NO: 19104 - protein, 402 aa, Oryza sativa
MDQPAPAPEPMLLDAQPPAAVACDKKQQEGEAPYAEGNDAVTGHIISTTIGGKNGEPKRTISYMAERVVGTGSFGIVFQAKCLETGETVAIKKVLQDRRYKNRELQLMRAMDHPNVISLKHCFFSTTSRDELFLNLVMEYVPETLYRVLKHYSNANHRMPLIYVKLYMYQLFRGLAYIHTVPGVCHRDVKPQNVLVDPLTHQVKLCDFGSAKTLVPGEPNISYICSRYYRAPELIFGATEYTTSIDIWSAGCVLAELLLGQPLFPGESAVDQLVEIIKVLGTPTREEIRCMNPNYTEFRFPQIKAHPWHKVFHKRMPPEAIDLASRLLQYSPSLRCTALDACAHPFFDELREPNARLPNGRPFPPLFNFKHELANSSQELISRLIPEHVRRQATHNFFNTGS

SEQ ID NO: 19105 - protein, 403 aa, Brachypodium distachyon
MEQTAPAAPEPMLLDDQPPTAVACEKKQQDGEAPYAEANDAMTGHIISTTIGGKNGEPKQTISYMAERVVGTGSFGIVFQAKCLETGETVAIKKVLQDRRYKNRELQLMRSINHPNVISLKHCFFSTTSRDELFLNLVMEYVPETLYRVLKHYSNANQRMPLIYVKLYMYQLFRGLAYIHTVPGVCHRDVKPQNVLVDPLTHQVKICDFGSAKVLVAGEPNISYICSRYYRAPELIFGATEYTTSIDIWSAGCVLAELLLGQPLFPGESAVDQLVEIIKVLGTPTREEIRCMNPNYTEFRFPQIKAHPWHKVFHKRMPPEAIDLASRLLQYSPSLRCTALEACAHPFFDELRELNARLPNGRPFPPLFNFKHELANASADLINRLVPEHVRRQPGFNFFHAGS

SEQ ID NO: 19106 - protein, 402 aa, Secale cereale
MEHPAPAPEPMLLDEQPPTAVACEKKQQDGEAPYAEGNDAMTGHIISTTIGGKNGEPKQTISYMAERVVGTGSFGIVFQAKCLETGETVAIKKVLQDRRYKNRELQLMRSMIHSNVVSLKHCFFSTTSRDELFLNLVMEYVPETLYRVLKHYSNAKQGMPLIYVKLYTYQLFRGLAYIHTVPGVCHRDVKPQNVLVDPLTHQVKICDFGSAKVLVAGEPNISYICSRYYRAPELIFGATEYTTSIDIWSAGCVLAELLLGQPLFPGESAVDQLVEIIKVLGTPTREEIRCMNPNYTEFRFPQIKAHPWHKVFHKKMPPEAIDLASRLLQYSPSLRCTALDACAHPFFDELREPNARLPNGRPFPPLFNFKHELANASQDLINRLVPEHVRRQAGLAFMHAGS

SEQ ID NO: 19107 - protein, 366 aa, Echinochloa colona
GRDGVPGHIISTTIGGKNGEPKRTISYMAERVVGTGSFGIVFQAKCLETGETFAIKKVLQDRRYKNRELQLMRAMEHPNVICLKHCFFSTTPRDELFLNLVMEYVPETLYRVLKHYSNANQRMPLIYVKLYMYQLFRGLAYIHTVPGVCHRDVKPQNVLVDPLTHQVKLCDFGSAKVLIPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRASNARLPNGRPFPPLFNFKHELANASPELINRLIPEHIRRQHGINFGHTGS

SEQ ID NO: 19108 - protein, 402 aa, Triticum aestivum
MEHPAPAPEPMLLDEQPPTAVACEKKQQDGEAPYAEGNDAMTGHIISTTIGGKNGEPKQTISYMAERVVGTGSFGIVFQAKCLETGEMVAIKKVLQDRRYKNRELQLMRSMIHSNVVSLKHCFFSTTSRDELFLNLVMEYVPETLYRVLKHYSNAKQGMPLIYVKLYTYQLFRGLAYIHTVPGVCHRDVKPQNVLVDPLTHQVKICDFGSAKVLVAGEPNISYICSRYYRAPELIFGATEYTTSIDIWSAGCVLAELLLGQPLFPGESAVDQLVEIIKVLGTPTREEIRCMNPNYTEFRFPQIKAHPWHKVFHKKMPPEAIDLASRLLQYSPSLRCTALDACAHPFFDELREPNARLPNGRPFPPLFNFKHELANASQDLINRLVPEHVRRQAGLAFVHAGS

SEQ ID NO: 19109 - protein, 402 aa, Triticum aestivum
MEHPAPAPEPMLLDEQPPTAVACEKKQQDGEAPYAEGNDAMTGHIISTTIGGKNGEPKQTISYMAERVVGTGSFGIVFQAKCLETGETVAIKKVLQDRRYKNRELQLMRSMIHSNVVSLKHCFFSTTSRDELFLNLVMEYVPETLYRVLKHYSNAKQGMPLIYVKLYTYQLFRGLAYIHTVPGVCHRDVKPQNVLVDPLTHQVKICDFGSAKVLVAGEPNISYICSRYYRAPELIFGATEYTTSIDIWSAGCVLAELLLGQPLFPGESAVDQLVEIIKVLGTPTREEIRCMNPNYTEFRFPQIKAHPWHKVFHKKMPPEAIDLASRLLQYSPSLRCTALDACAHPFFDELWEPNARLPNGRPFPPLFNFKHELANASQDLINRLVPEHVRRQAGLAFVHAGS

SEQ ID NO: 19110 - protein, 402 aa, Triticum aestivum
MEHSAPAPEPMLLDEQPPTAVACEKKQQDGEAPYAEGNDAMTGHIISTTIGGKNGEPKQTISYMAERVVGTGSFGIVFQAKCLETGETVAIKKVLQDRRYKNRELQLMRSMIHSNVVSLKHCFFSTTSRDELFLNLVMEYVPETLYRVLKHYSNAKQGMPLIYVKLYTYQLFRGLAYIHTVPGVCHRDVKPQNVLVDPLTHQVKICDFGSAKVLVAGEPNISYICSRYYRAPELIFGATEYTISIDIWSAGCVLAELLLGQPLFPGESAVDQLVEIIKVLGTPTREEIRCMNPNYTEFRFPQIKAHPWHKVFHKKMPPEAIDLASRLLQYSPSLRCTALDACAHPFFDELREPNARLPNGRPFPPLFNFKHELANASQDLINRLVPEHVRRQAGLAFVHAGS

SEQ ID NO: 19111 - protein, 402 aa, Hordeum vulgare
MEHPAPAPEPMLLDEQPPTAVACEKKQQDGEAPYAEGNDAMTGHIISTTIGGKNGEPKQTISYMAERVVGTGSFGIVFQAKCLETGETVAIKKVLQDRRYKNRELQLMRSMNHSNVVSLKHCFFSTTSRDELFLNLVMEYVPETLYRVLKHYSNAKQGMPLIYVKLYTYQLFRGLAYIHTVPGVCHRDVKPQNVLVDPLTHQVKVCDFGSAKVLVAGEPNISYICSRYYRAPELIFGATEYTSSIDIWSAGCVLAELLLGQPLFPGESAVDQLVEIIKVLGTPTREEIRCMNPNYTEFRFPQIKAHPWHKVFHKKMPPEAIDLASRLLQYSPSLRCTALDACAHPFFDELREPNAHLPNGRPFPPLFNFKHELANVSQDLINRLVPEHVRRQAGLAFLHAGS

SEQ ID NO: 19112 - protein, 376 aa, Avena sativa
HAGNEKKREESGDPVTGHIISTTIGGKNGEPKRTISYMAERVVGTGSFGIVFQAKCIETGETVAIKKVLQDRRYKNRELQLMRSMDHPNVVSLKHCFFSTTSRDELFLNLVMEYVPETLYRVLKHYSNANQRMPLIYVKLYMYQLFRGLAYIHTVPGVCHRDVKPQNVLVDPLTHQVKLCDFGSAKVLVPGEPNISYICSRYYRAPELIFGATEYTTSIDIWSAGCVLAELLLGQPLFPGETAVDQLVEIIKVLGTPTREEIRCMNPNYTEFRFPQIKAHPWHKIFHKRMPAEAIDLASRLLQYSPSLRCTALDACAHSFFDELREPNARLPNGRPFPPLFNFKPELANASPDLISRLIPEHVRRQNSLNFAHAGS

SEQ ID NO: 19113 - protein, 368 aa, Avena sativa
MEAAPEPMELDAPPPLAAAVPAHAGNEKKREEGGDPVTGHIISTTIGGKNGEPKRTISYMAERVVGTGSFGIVFQAKCIETGETVAIKKVLQDRRYKNRELQLMRSMDHPNVVSLKHCFFSTTSRDELFLNLVMEYVPETLYRVLKHYSNANQRMPLIYVKLYMYQLFRGLAYIHTVPGVCHRDVKPQNVLVDPLTHQVKLCDFGSAKVLVPGEPNISYICSRYYRAPELIFGATEYTTSIDIWSAGCVLAELLLGQPLFPGETAVDQLVEIIKVLGTPTREEIRCMNPNYTEFRFPQIKAHPWHKIFHKRMPAEAIDLASRLLQYSPSLRCTALDACAHSFFDELREPNARLPNGRPFPPLFNFKPE

SEQ ID NO: 19114 - protein, 401 aa, Festuca arundinacea
MERPAPAPEPMLLDEKPPTAVACEKKQQDGEARYAEGNGAMTGHIISTTIGGKNGEPKKTISYKAERIVGSGSFGIVFQAKCLETGEAVAIKKVIQDPRYKSRELQLMRSINHPNIVCLKHCFFSTTSRDELYLNIVMEFVPETLYRVLKHYSNAKHGMPLIYVKLYMYQIFRGLAYIHAVGVCHRDLKPQNVLVDPLTHQVKICDFGSAKVLVKGEPNIAYICSRYYRAPELIFGATEYTTSIDIWSSGCILAELLLGQPLFPGGTAVDQLVEIIKVLGTPTREEIRCMNPNYTEFRFPQIKAHPWHKVFHKRMPPEAIDLASRLLQYSPSLRCTALDACAHPFFDELREPNARLPNGRPFPPLFNFKHELANASPDLINRLVPEHVRWQAGLNFSHAGS

SEQ ID NO: 19115 - protein, 414 aa, Setaria italica
MAALPGGAHAAGAADPMQVDQPRPAAAGAAAAAPATADAKHAGSMIEGGDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLTFLPATGP

SEQ ID NO: 19116 - protein, 395 aa, Pennisetum glaucum
MQVDQPRPVAAAAAPATADAKHAGPMIEGGDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRQFPPLFNFKQELANASPELINRLIPDHARRHLGLTFLPATGP

SEQ ID NO: 19117 - protein, 396 aa, Saccharum officinarum
MQVDQPLPAAAAAAAHAPADAKHAGSMIEGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLTLLPTTGP

SEQ ID NO: 19118 - protein, 406 aa, Ananas comosus
MASLPMGPNRAPEPEPEPMIVDPRPPEAAEKKHEASTIEGNDPVTGHIISTTIGGKNGEPKRTISYMAERVVGTGSFGIVFQAKCLETGETVAIKKVLQDRRYKNRELQLMRSMDHSNVISLKHCFFSTTSRDELFLNLVMEYVPENLYRVLKHYSNANQRMPLIYVKLYMYQIFRGLAYIHTALGVCHRDVKPQNLLVDPLTHQVKLCDFGSAKILVKGEANISYICSRYYRAPELIFGATEYTTSIDIWSAGCVLAELLLGQPLFPGESAVDQLVEIIKVLGTPTREEIRCMNPNYTDFRFPQIKAHPWHKIFHKRMPPEAIDLASRLLQYSPSLRCTALEACAHPFFDELREPNARLPNGRPFPPLFNFKQELAGVSPELISRLIPEHVRRQTGLNFLHPSGT

SEQ ID NO: 19119 - protein, 405 aa, Panicum virgatum
MAAPPGGAHAAGAADPMQVDQPRPAAAAAAATAPADAKHASSMIEGGDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLVPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLT

SEQ ID NO: 19120 - protein, 416 aa, Sorghum bicolor
MAAPPGGAAGAGAADPMQVDQPLPGAAAAAAAAAAHGPADAKHAGSMIEGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLTLLPTTGP

SEQ ID NO: 19121 - protein, 412 aa, Zea mays
MAAMPGGAHGAGAADPMQVDQPLPPAAAGTAHAPADAKHAGSMIEGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDDLREPHARLPNGRPFPPLFNFKQELANASPELINRLIPDHARRHLGLTLLPATGP

SEQ ID NO: 19122 - protein, 396 aa, Avena sativa
MERPVPAPEPMLLDEKSATKNQQDGEAPYAEGNGAMTGHIISTTIGGKNGEPKQTISYKAERVVGTGSFGIVFQAKCLETGEFVAIKKVLQDSRYKNRELQLMRSINHPNIVCLKHCFFSTTSKDELFLNIVMEFVPETLYRVLQHYCNAKQGMPLIYVKLYMYQVFRGLAYLHAVGVCHRDVKPQNILVDALTHQVKICDFGSAKVLVKGEPNISYICSRYYRAPELIFGATEYTTSIDIWAAGCVLAELLLGQPLFPGDTGVDQLVEIIKVLGTPTREEIRCMNPNYTEFRFPQIKAHPWHKVFHKRMPPEAIDLASRLLQYSPSLRCTALDACAHPFFDELREPNARLPNGRPFPPLFNFKHELANASPDLINRLVPEHVRRQAGLNSSHAAR

SEQ ID NO: 19123 - protein, 404 aa, Panicum virgatum
MAALPGGAHAAGAADPMQVDQPRPAAAAAATAPADAKQAGSMIEGGDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHVGLS

SEQ ID NO: 19124 - protein, 396 aa, Avena sativa
MERPVPAPEPMLLDEKSATKNQQDGEAPYAEGNGAMTGHIISTTIGGKNGEPKQTISYKAERIVGTGSFGIVFQAKCLETGEFVAIKKVLQDSRYKNRELQLMRSINHPNIVCLKHCFFSTTSKDELFLNIVMEFVPETLYRVLQHYRNAKQGMPLIYVKLYMYQVFRGLAYLHAVGVCHRDVKPQNILVDALTHQVKICDFGSAKVLVKGEPNISYICSRYYRAPELIFGATEYTTSIDIWAAGCVLAELLLGQPLFPGDTGVDQLVEIIKVLGTPTREEIRCMNPNYTEFRFPQIKAHPWHKVFHKRMPPEAIDLASRLLQYSPSLRCTALDACAHPFFDELREPNARLPNGRPFPPLFNFKHELANASPDLINRLVPEHVRRQAGLNSSHAAR

SEQ ID NO: 19125 - protein, 406 aa, Musa acuminata
MASLPLGPHNPPPPEQGAFVPAVPSSHPEMAQDKASVVEGNDAVTGHIISTTIGGKNGEPKQTISYMAERVVGNGSFGIVFQAKCLETGETVAIKKVLQDRRYKNRELQLMRSIDHPNVISLKHCFFSTTSRDELFLNLVMEYVPETLYRVLRHYSSVSQRMPLIYVKLYTYQIFRGLAYIHTVPGVCHRDVKPQNVLVDPLTHQVKLCDFGSAKVLVKGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPLEAIDLTSRLLQYSPSFRCTALEACAHPFFDELREPNARLPNGRPLPPLFNFKQELAGASPELIDKLIPEHVRRQSGLSFLQMPGT

SEQ ID NO: 19126 - protein, 409 aa, Echinochloa colona
MAALPGGAHAAGAADPMQVDQPRPAAAAAAPADAKHAGSMIEGGDPVTGHIISTTIGGKNGEPKRTISYMAERVVGTGSFGIVFQAKCLETGETVAIKKVLQDKRYKNRELQIMRSMDHCNVVSLKHCFFSTTTRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLTFLPTTGP

SEQ ID NO: 19127 - protein, 378 aa, Cocos nucifera
MAEDKQASIIEGNDPVTGHIISTTIGGKNGEPKQTISYMAERVVGTGSFGIVFQAKCLETGETVAIKKVLQDRRYKNRELQLMRSMDHPNVISLKHCFFSTTTRDELFLNLVMEYVPETLYRVLRHYSNVNQRMPLIYVKLYTYQLFRGLAYIHTVPGVCHRDVKPQNVLVDPLTHQVKLCDFGSAKVLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLTSRLLQYSPSLRCTALDACAHPFFDELREPNARLPNGRALPPLFNFKHELAGASPELINKLIPEHVKRQSGLSFLHPAGT

SEQ ID NO: 19128 - protein, 378 aa, Cocos nucifera
MAEDKQASVIEGSDQVTGHIISTTIGGKNGEPKQTISYMAERVVGTGSFGIVFQAKCLETQETVAIKKVLQDRRYKNRELQLMRAMDHPNVISLKHCFFSTTSRDELFLNLVMEYVPETLYRVLRHYSNVNQRMPLIYVKLYTYQLFRGLAYIHTVPGVCHRDVKPQNVLVDPLTHQVKLCDFGSAKVLVKGEANISYICSRYYRAPELIFGATEYATSIDIWSAGCVLAELLLGQTLFPGESAVDQLVEIIKVLGTPTREEIRCMNPNYTEFRFPQIKAHPWHKIFHKRMPPEAIDLTSRLLQYSPSLRCTALDACAHPFFDELREPNARLPNGRALPPLFNFKHELAGASPELINKLIPEHVKRQSGLSFLHPAGT

SEQ ID NO: 19129 - protein, 378 aa, Cocos nucifera
MAEDKQASIIEGNDPVTGHIISTTIGGKNGEPKQTISYMAERVVGTGSFGIVFQAKCLETQETVAIKKVLQDRRYKNRELQLMRAMDHPNVISLKHCFFSTTSRDELFLNLVMEYVPETLYRVLRHYSNVNQRMPLIYVKLYTYQLFRGLAYIHTVPGVCHRDVKPQNVLVDPLTHQVKLCDFGSAKVLVKGEANISYICSRYYRAPELIFGATEYTTSIDIWSAGCVLAELLLGQPLFPGESSVDQLVEIIKVLGTPTREEIRCMNPNYTEFRFPQIKAHPWHKIFHKRMPPEAIDLTSRLLQYSPSLRCTALDACAHSFLDELREPNARLPNGRPLPPLFNFKHVLAGASPELINKLIPEHVRRQSGLSFLHSAGT

SEQ ID NO: 19130 - protein, 378 aa, Elaeis guineensis
MAEDKQASIIEGNDPVTGHIISTTIGGKNGEPKQTISYMAERVVGTGSFGIVFQAKCLETGETVAIKKVLQDRRYKNRELQLMRSMDHPNVITLKHCFFSTTTRDELFLNLVMEYVPETLYRVLRHYSNVNQRMPLIYVKLYTYQLFRGLAYIHTGPGVCHRDVKPQNVLVDPLTHQVKLCDFGSAKVLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLTSRLLQYSPSLRCTALDACAHPFFDELREPNARLPNGRPLPPLFNFKHELAGASPELINKLIPEYVRRQSGLSVLHSAGT

SEQ ID NO: 19131 - protein, 355 aa, Triticum aestivum
TTIGGKNGEPKRTISYMAERVVGTGSFGIVFQAKCLETGETVAIKKVLQDRRYKNRELQLMRSMDHPNVVSLKHCFFSTTSRDELFLNLVMEYVPETLYRVLKHYSNANQRMPLIYVKLYMYQLFRGLAYVHTVPGVCHRDVKPQNVLVDPLTHQVKICDFGSAKVLVPGEPNIAYICSRYYRAPELIFGATEYTTSIDIWSAGCVLAELLLGQPLFPGETAVDQLVEIIKVLGTPTREEIRCMNPNYTEFRFPQIKAHPWHKIFHKRMPAEAIDLASRLLQYSPNLRCTALDACAHSFFDELREPNARLPNGRPFPPLFNFKPELANASPELINRLVPEHVRRQNGLNFAHAGS

SEQ ID NO: 19132 - protein, 379 aa, Amsonia hubrichtii
MDSDKDMSAPVIEGNDAVTGHIISTTIGGKNGEPKRTISYMAERVVGTGSFGIVFQAKCLETGETIAIKKVLQDRRYKNRELQLMRLMDHPNVIALKHCFFSTTTRDELFLNLVMEYVPETLYKVLKHYSNSNQRMPLIYVKLYTYQIFRGLAYIHTVPGVCHRDVKPQNLLVDPLTHQVKLCDFGSAKVLVRGEANISYICSRYYRAPELIFGATEYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACAHPFFDELRDPNARLPNGRPFPPLFNFKQELTGASLELINRLIPEHVRRQAGPFPHPAGT

SEQ ID NO: 19133 - protein, 378 aa, Elaeis guineensis
MAEDKQASVIEGNDQVTGHIISTTIGGKNGEPKQTISYMAERVVGTGSFGIVFQAKCLETQETVAIKKVLQDRRYKNRELQLMRTMDHPNVISLKHCFFSTTSRDELFLNLVMEYVPETLYRVLRHYSNVNQRMPLIYVKLYTYQLFRGLAYIHTVPGVCHRDVKPQNVLVDPLTHQVKLCDFGSAKVLVKGEANISYICSRYYRAPELIFGATEYATSIDIWSAGCVLAELLLGQPLFPGESAVDQLVEIIKVLGTPTREEIRCMNPNYTEFRFPQIKAHPWHKIFHKRMPPEAIDLTSRLLQYSPSLRCTALEACAHSFFDELREPNARLPNGRPLPPLFNFKHELASVSPELINKLIPEHVKRQSGLSFLHPAGT

SEQ ID NO: 19134 - protein, 409 aa, Vinca minor
ATTTHHPHDQGAGAAAAALKLAAQSRRSDMDSSDKDMSAPVVEGNEAVTGHIISTTIGGKNGEPKRTISYMAERVVGTGSFGIVFQAKCLETGETVAIKKVLQDRRYKNRELQLMRLMDHPNVIALKHCFFSTTTRDELFLNLVMEYVPETLYKVLKHYSSSNQRMPLIYVKLYTYQIFRGLAYIHTVPGVSHRDVKPQNLLVEPLTHQVKLCDFGSAKVLVRGEANISYICSRYYRAPELIFGATEYTSSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACTHPFFDELRDPNARLPNGRPLPPLFNFKQELTGASPELINRLIPEHVRRQNGPFPHPAGT

SEQ ID NO: 19135 - protein, 410 aa, Musa acuminata
MASLPLGPHHPPPLPPQEHDTLNPAAAPRRPGMDEDKKTSVLEGNDAVTGHIISTTIGGKNGEPKQTISYMAERVVGTGSFGIVFQAKCLETGETVAIKKVLQDPRYKNRELQLMRSMDHSNVISLKHCFFSTTSRDELFLNLVMEYVPETLYRVLRHYSSVNQRMPLIYVKLYTYQIFRGLAYIHTVPGVCHRDVKPQNVLVDPLTHQVKLCDFGSAKVLVKGEPNISYICSRYYRAPELIFGATEYTASIDIWSVGCVLAELLLGQPLFPGDSAVDQLVEIIKVLGTPTREEIRCMNPNYTEFRFPQIKAHPWHKIFHKRMPPEAIDLTSRLLQYSPSFRCTALEACAHPFFDELREPNARLPNGRPLPPLFDFKQELNGASPELIDKLIPEHLRRQSSLSFLRVPGT

SEQ ID NO: 19136 - protein, 414 aa, Oryza sativa
MATLPGGPHPTGGGAAADPMQVDQPRSAAAAAAVAPAGEKHGASLMEGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYVYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHSFFDELREPHARLPNGRPFPPLFNFKQELANISPELINRLIPEHARRHCGFNFLPAAGP

SEQ ID NO: 19137 - protein, 405 aa, Musa acuminata
MASLPLGPHHHPPPPAPEHDAVNSAAPPCDQEMAEDKQASVMEGNDAVTGHIISTTIGGKNGEPKQTISYMAERVVGNGSFGIVFQAKCLETRETVAIKKVLQDRRYKNRELQLMRSMDHPNVISLKHCFFSTTSRDELFLNLVMEYVPETLYRVLRHYSSVNQRMPLIYVKLYTYQLFRGLAYIHTVPGVCHRDVKPQNVLVDPLTHQVKLCDFGSAKVLVKGEPNISYICSRYYRAPELIFGATEYTTSIDIWSAGCVLAELLLGQPLFPGDSAVDQLVLGTPTREEIRCMNPNYTEFRFPQIKAHPWHKIFHKRMPPEAIDLTSRLLQYSPSFRCTALEACAHPFFDELREPNARLPNGRPLPSLFNFKPELAGASPELIAKLIPEHVRRQSGLSFLQMPGT

SEQ ID NO: 19138 - protein, 408 aa, Festuca arundinacea
MATLPSGPHPAGAAADLMQVDEPHAAAAAPVVEKHGASIIQGSDPVTGHIISTTIGGKNGEPKRTISYMAERVVGTGSFGIVFQAKCLETGETVAIKKVLQDKRYKNRELQIMRSMDHCNVVCLKHCFFSTTSRDELFLNLVMEFVPESLYRVLKHYSNMNQRMPLIYVKLYVYQIFRGLAYIHSVPGVCHRDIKPQNLLVDPLTHTVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACTHPFFDELREPHAKLPNGRPFPPLFNFKQELANASPDLISRLIPEHARRHCGFNFSPSTGQ

SEQ ID NO: 19139 - protein, 407 aa, Arabidopsis thaliana
MASLPLGPQPHALAPPLQLHDGDALKRRPELDSDKEMSAAVIEGNDAVTGHIISTTIGGKNGEPKQTISYMAERVVGTGSFGIVFQAKCLETGESVAIKKVLQDRRYKNRELQLMRPMDHPNVISLKHCFFSTTSRDELFLNLVMEYVPETLYRVLRHYTSSNQRMPIFYVKLYTYQIFRGLAYIHTVPGVCHRDVKPQNLLVDPLTHQVKLCDFGSAKVLVKGEPNISYICSRYYRAPELIFGATEYTASIDIWSAGCVLAELLLGQPLFPGENSVDQLVEIIKVLGTPTREEIRCMNPNYTDFRFPQIKAHPWHKVFHKRMPPEAIDLASRLLQYSPSLRCTALEACAHPFFNELREPNARLPNGRPLPPLFNFKQELGGASMELINRLIPEHVRRQMSTGLQNS

SEQ ID NO: 19140 - protein, 380 aa, Quercus alba
MDSDKEMSAAVIEGNDAVTGHIISTTIGGKNGEPKRTISYMAERVVGTGSFGIVFQAKCLETGETVAIKKVLQDRRYKNRELQLMRLMDHPNVVSLKHCFFSTTSKDELFLNLVMEYVPETMYRVLKHYSSMNQRMPLIYVKLYTYQIFRGLAYIHTVPGVCHRDVKPQNLLVDPLTHQVKLCDFGSAKVLVKGEANISYICSRYYRAPELIFGATEYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACAHPFFDELREPNARLPNGRPLPPLFNFKQELQGASPELINRLIPEHVRRQIGLSFPHPAGT

SEQ ID NO: 19141 - protein, 380 aa, Citrus sinensis
MDSDKEMSAAVIQGNDAVTGHIISTTIGGKNGEPKQTISYMAERVVGTGSFGIVFQAKCLETGETVAIKKVLQDRRYKNRELQLMRLMDHPNVISLKHCFFSTTSKDELFLNLVMEYVPETMYRVLKHYSSMNQRMPLIYVKLYTYQIFRGLAYIHTVPGVCHRDVKPQNLLVDPLTHQVKLCDFGSAKVLVKGEANISYICSRYYRAPELIFGATEYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACAHPFFDELREPNARLPNGRPFPPLFNFKQELAGASPELINRLIPEHVRRQTGLSMPHSAGT

SEQ ID NO: 19142 - protein, 379 aa, Tabernaemontana elegans
MDSDKDISAPVIEGNDAVTGHIISTTIGGKNGEPKRTISYMAERVVGTGSFGIVFQAKCLETGETVAIKKVLQDRRYKNRELQLMRLMDHPNVIALKHCFFSTTTRDELFLNLVMEYVPETLYKVLKHYSNSNQRMPLIYVKLYTYQIFRGLAYIHTVPGVCHRDVKPQNLLVDPLTHQVKLCDFGSAKFLVRGEANISYICSRYYRAPELIFGATEYTTSIDIWSAGCVLAELLLGQPLFPGENAVDQLVEIIKVLGTPTREEIRCMNPSYTDFRFPQIKAHPWHKVFHKRMPPEAIDLASRLLQYSPSLRCTALEACAHPFFDELRDPNARLPNGRPFPPLFNFKQELTGASPELINRLIPEHVRRPNGLLPHPAGT

SEQ ID NO: 19143 - protein, 378 aa, Amorphophallus konjac
MGDEKEASVVEGNDPLTGHIISTTIGGKNGEPKRTISYMAERVVGTGSFGIVFQAKCLETGETIAIKKVLQDRRYKNRELQLMRSMEHPNVICLKHCFFSTTSRDELFLNLVMEYVPETVYRVLKHYSNVNQRMPLIYVKLYTYQIFRGLAYIHTVQGICHRDVKPQNLLVDPLTHQVKLCDFGSAKILVKGEANISYICSRYYRAPELIFGATEYTTSIDIWSAGCVLAELLLGQPLFPGESAVDQLVEIIKVLGTPTREEIRCMNPNYTEFKFPQIKAHPWHKVFHKRMPPEAIDLTSRLLQYSPSLRCTALEACAHPFFDELREPNARLPNGRPLPPLFNFKQELVGTSPELINKLIPEHVRRQAGLNFLHPAGT

SEQ ID NO: 19144 - protein, 380 aa, Aristolochia fimbriata
MATIPEITTSVVEGNDPVTGHIISTTIGGKNGEAKRTISYMAERVVGTGSFGIVFQAKCLETGETVAIKKVLQDRRYKNRELQLMRSMDHPNVISLKHCFFSTTSKNELFLNLVMEYVPETVYRVLKHYSNVNQRMPLIYVKLYTYQIFRGLAYIHTVPGVCHRDVKPQNLLVDPLTHQVKLCDFGSAKILVKGEANISYICSRYYRAPELIFGATEYTTSIDIWSAGCVLAELLLGQPLFPGESAVDQLVEIIKVLGTPTREEIRCMNPNYTEFRFPQIKAHPWHKVFHKRMPPEAIDLASRLLQYSPSLRCTALEACAHPFFDELREPNARLPNGRPFPPLFNFKQELSGACPELINKLIPEHVRRQSGLSFLHLAGT

SEQ ID NO: 19145 - protein, 403 aa, Cenchrus ciliaris
MATAPGGGPLPAAADAMEVDPPRASADEKHVATVMGGNDAVTGHIISTTIGGKNGEPKRTISYMAERVVGTGSFGVVFQAKCIETGETVAIKKVLQDKRYKNRELQIMRSIDHCNVISLKHCFFSTTSRDELFLNLVMEFVPESLYRVLKHYKDMKQRMPLIYVKLYMYQIFRGLAYIHNAPGVCHRDIKPQNILVDPLSHQVKVCDFGSAKILVKGEANISYICSRYYRAPELIFGATEYTTSIDIWSAGCVLAELLLGQPLFPGESAVDQLVEIIKVLGTPTREEIRCMNPNYTEFKFPQIKACPWHKIFHKRMPPEAIDLVSRLLQYSPNLRCSALEACAHSFFDELREPHARLPNGRPFPPLFNFKQELANASPELISKLLPEHARRHSGFNSLFGTGP

SEQ ID NO: 19146 - protein, 380 aa, Citrus clementina
MDSDKEMSAAVIQGNDAVTGHIISTTIGGKNGEPKQTISYMAERVVGTGSFGIVFQAKCLETGETVAIKKVLQDRRYKNRELQLMRLMDHPNVISLKHCFFSTTSKDELFLNLVMEYVPETMYRVLKHYSSMNQRMPLIYVKLYTYQIFRGLAYTHTVPGVCHRDVKPQNLLVDPLTHQVKLCDFGSAKVLVKGEANISYICSRYYRAPELIFGATEYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACAHPFFDELREPNARLPNGRPFPPLFNFKQELAGASPELINRLIPEHVRRQTGLSMPHSAGT

SEQ ID NO: 19147 - protein, 409 aa, Zea mays
MAAMPGGAHAAGAADQMQVDQPLPAAAAHGPADAKHAGSMIEGNDPVTGHIISTTIGGKNGEPKKTISYMAERVVGTGSFGIVFQAKCLETGETVAIKKVLQDKRYKNRELQIMRSMDHCNAVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLTLLPTAGP

SEQ ID NO: 19148 - protein, 380 aa, Fagus grandifolia
MDSDKEMSAAVIEGNDAVTGHIISTTIGGKNGEPKQTISYMAERVVGTGSFGIVFQAKCLETGETVAIKKVLQDRRYKNRELQLMRLMDHPNVVSLKHCFFSTTSKDELFLNLVMEYVPETMYRVLKHYSSMNQRMPLIYVKLYTYQIFRGLAYIHSVPGVCHRDVKPQNLLVDPLTHQVKLCDFGSAKVLVKGEANISYICSRYYRAPELIFGATEYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACVHPFFDELREPNARLPNGRPLPTLFNFKQELQGVSPDLINRLIPEHVRRQTGLSFPHPAGT

SEQ ID NO: 19149 - protein, 380 aa, Panax ginseng
MDSDKEMSAAVIEGNDQVTGHIISTTIGGKNGEPKRTISYMAERVVGTGSFGIVFQAKCLETGETIAIKKVLQDRRYKNRELQLMRLMDHPNVVCLKHCFFSTTTKDELFLNLVMEYVPETMYRVLKHYSNVNQRMPLIYVKLYTYQIFRGLAYIHTVPGVCHRDVKPQNLLVDPLTHQVKLCDFGSAKNLVKGEANISYICSRYYRAPELIFGATEYTTSIDIWSAGCVLAELLLGQPLFPGENAVDQLVEIIKVLGTPTREEIRCMNPSYTDFRFPQIKAHPWHKVFHKRMPPEAIDLASRLLQYSPSLRCTALEACAHSFFDELRDPNARLPNGRPLPPLFNFKQELTGASPELINRLIPEHIRRQSGLSFPHPAGT

SEQ ID NO: 19150 - protein, 378 aa, Elaeis guineensis
MAEDKEASVIEGNGPVTGHIISTTIGGKNGEAKRTISYMAERVVGTGSFGIVFQAKCLETGEIVAIKKVLQDRRYKNRELQLMRSMDHPNVISLKHCFFSTTNRDELFLNLVMEYVPETVFRVLKHYSNVKQRMPLIYVKLYMYQVFRGLAYIHTVPGICHRDVKPQNILVDPLTHQVKLCDFGSAKILVKGEANISYICSRYYRAPELIFGATEYTTSIDIWSAGCVLAELLLGQPLFPGESAVDQLVEIIKVLGTPTREEIRCMNPNYTEFRFPQIKAHPWHKVFHKRMPPEAIDLASRLLQYSPSLRCTALEACAHPFFDELREPNARLPNGRPFPPLFNFKQELAVASPELINKLIPEHVRRQYGPTFPLPTGT

SEQ ID NO: 19151 - protein, 401 aa, Oryza sativa
MATLPGGPHPTGGGAAADPMQVDQPRSAAAAAAVAPAGEKHGASLMEGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYVYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYAPNLRCTALEACAHSFFDELREPHARLPNGRPFPPLFNFKQELANLSPELINRLIPEHAR

SEQ ID NO: 19152 - protein, 380 aa, Vaccinium corymbosum
MDSDKEMTSAVIEGNDQVTGHIISTTIGGKNGEPKQTISYMAERVVGTGSFGIVFQAKCLETGETVAIKKVLQDRRYKNRELQLMRLMDHPNVVSLKHCFFSTTTKDELFLNLVMEYVPETMYRVLKHYSNANQRMPLIYVKLYTYQIFRGLAYIHTVPGVCHRDVKPQNLLVDPLTHQVKLCDFGSAKVLVKGEANISYICSRYYRAPELIFGATEYSSSIDIWSAGCVLAELLLGQPLFPGENAVDQLVEIIKVLGTPTREEIRCMNPNYTDFRFPQIKAHPWHKVFQKRMPPEAIDLASRLLQYSPSLRCTALEACAHPFFDELREPNARLPNGRPLPTLFNFKQELAGASPELINRLIPEHVRRQMGLTFPHPAGT

SEQ ID NO: 19153 - protein, 377 aa, Cannabis sativa
DMSASSTVIEGNDQVTGHIISTTIGGKNGEPKRTISYMAERVVGTGSFGIVFQAKCLETGETVAIKKVLQDRRYKNRELQLMRLMDHPNVVSLKHCFFSTTSKDELFLNLVMEYVPETMYRVLKHYSSMNQRMPLIYVKLYTYQIFRGLAYIHTVPGVCHRDVKPQNLLVDPLTHQVKLCDFGSAKVLVRGEANISYICSRYYRAPELIFGATEYTTSIDIWSAGCVLAELLLGQPLFPGENKVDQLVEIIKVLGTPTREEIRCMNPSYTDFRFPQIKAHPWHKVFHKRMPPEAIDLASRLLQYSPSLRCTALEACSHPFFDELREPNARLPNGRPLPPLFNFKHELSAASPELINRLIPEHIRRQASQNFPHLVGT

SEQ ID NO: 19154 - protein, 411 aa, Festuca arundinacea
MATLPGGAHPAGGAAADLMQVDEPHAAGGAAAPVVKKHGASIIQGSDPVTGHIISTTIGGKNGEPKRTISYMAERVVGTGSFGIVFQAKCLETGETVAIKKVLQDKRYKNRELQIMRSMEHCNVVCLKHCFFSTTSRDELFLNLVMEFVPESLYRVLKHYSNMNQRMPLIYVKLYVYQIFRGLAYIHSVPGVCHRDIKPQNLLVDPLTHTVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACTHPFFDELREPHAKLPNGRPFPPLFNFKQELANASPDLIGRLIPEHARRHCGFNFSPSTGQ

SEQ ID NO: 19155 - protein, 348 aa, Festuca arundinacea
GEPKRTISYMAERVVGTGSFGIVFQAKCLETGETVAIKKVLQDRRYKNRELQLMRSMDHPNVVSLKHCFFSTTSRDELFLNLVMEYVPETLYRVLKHYSNANQRMPLIYVKLYMYQLFRGLAYIHTVPGVCHRDVKPQNVLVDPLTHQVKICDFGSAKVLVPGEPNISYICSRYYRAPELIFGATEYTTSIDIWSAGCVLAELLLGQPLFPGETAVDQLVEIIKVLGTPTREEIRCMNPNYTEFRFPQIKAHPWHKIFHKRMPAEAIDLASRLLQYSPSLRCTALDACAHSFFDELREPNARLPNGRPFPPLFNFKPELANASPDLINRLIPEHVRRQNSLNFAHAGS

SEQ ID NO: 19156 - protein, 380 aa, Panax ginseng
MDSDKEMSAAVIEGNDQVTGHIISTTIGGKNGEPKRTISYMAERVVGTGSFGIVFQAKCLETGETIAIKKVLQDRRYKNRELQLMRLMDHPNVVCLKHCFFSTTTKDELFLNLVMEYVPETMYRVLKHYSNVNQRMPLIYVKLYTYQIFRGLAYIHTVPGVCHRDVKPQNLLVDPLTHQVKLCDFGSAKNLVKGEANISYICSRYYRAPELIFGATEYTTSIDIWSAGCVLAELLLGQPLFPGENAVDQLVEIIKVLGTPTREEVRCMNPSYTDFRFPQIKAHPWHKVFHKRMPPEAIDLASRLLQYSPSLRCTALEACAHSFFDELRDPNARLPNGRPLPPLFNFKQELTGASPELINRLIPEHIRRQSGLSFPHPAGT

SEQ ID NO: 19157 - protein, 408 aa, Avena sativa
MATLPGGAHPAGAAADPMQVDEPHAAAAAPVVEKHGASIIQGSDPVTGHIISTTIGGKNGEPKRTISYMAERVVGTGSFGIVFQAKCLETGETVAIKKVLQDKRYKNRELQIMRSMDHCNVVCLKHCFFSTTSRDELFLNLVMEFVPESLYRVLKHYSNMNQRMPLIYVKLYVYQIFRGLAYIHSVPGVCHRDIKPQNLLVDPLTHTVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACTHPFFDELREPHAKLPNGRPFPPLFNFKQEVANASPELISRLIPEHARRHSGLNFLPSTGQ

SEQ ID NO: 19158 - protein, 380 aa, Prunus mume
MDSDKEMSAPVIEGNDAVTGHIISTTIGGKNGEPKRTISYMAERVVGTGSFGIVFQAKCIETGETVAIKKVLQDRRYKNRELQLMRLMDHPNVVSLKHCFFSTTSKDELFLNLVMEYVPETMYRVLKHYSSMNQRMPLIYVKLYTYQIFRGLAYIHAVPGVCHRDVKPQNLLVDPLTHQVKLCDFGSAKVLVKGEANISYICSRYYRAPELIFGATEYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACTHPFFDELREPNARLPNGRPLPPLFNFKQELSGASPELINRLIPEYMRQQTGLGFPHPVGT

SEQ ID NO: 19159 - protein, 380 aa, Prunus persica
MDSDKEMSAPVIEGNDAVTGHIISTTIGGKNGEPKRTISYMAERVVGTGSFGIVFQAKCIETGETVAIKKVLQDRRYKNRELQLMRLMDHPNVVSLKHCFFSTTSKDELFLNLVMEYVPETMYRVLKHYSSMNQRMPLIYVKLYTYQIFRGLAYIHAVPGVCHRDVKPQNLLVDPLTHQVKLCDFGSAKVLVKGEANISYICSRYYRAPELIFGATEYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACTHPFFDELREPNARLPNGRPLPPLFNFKQELSGASPELINKLIPEHMRQQTGLGFPHPVGT

SEQ ID NO: 19160 - protein, 379 aa, Chelidonium majus
MGDDKEISATVIEGNDPVTGHIISTTIGGKNGEPKQTISYMAERVVGTGSFGIVFQAKCLETGEPVAIKKVLQDRRYKNRELQLMRSMDHPNVISLKHCFFSTTSRNELFLNLVMEYVPETVYRVLKHYSNVNQRMPLIYVKLYMYQIFRGLAYIHTVPGVCHRDVKPQNILVDPLTHQVKLCDFGSAKVLVKGEANISYICSRYYRAPELIFGATEYTTSIDIWSGGCVLAELLLGQPLFPGESAVDQLVEIIKILGTPTREEIRCMNPNYTDFRFPQIKAHPWHKVFHKRMPPEAIDLASRLLQYSPSLRCTALEACAHPFFDEIREPNARLPNGRPLPPLFNFKPELSGASVELINKLVPEHVRRQSGLSFLYPGT

SEQ ID NO: 19161 - protein, 378 aa, Cocos nucifera
MAEDKEASVIEGNGPVTGHIISTTIGGKNGEAKRTISYMAERVVGTGSFGIVFQAKCLETGEIVAIKKVLQDRRYKNRELQLMRSMDHPNVISLKHCFFSTTNRDELFLNLVMEYVPETVFRVLKHYSNVKQRMPLIYVKLYMYQVFRGLAYIHTVPGICHRDVKPQNILVDPLTHQVKLCDFGSAKILVKGEANISYICSRYYRAPELIFGATEYTTSIDIWSAGCVLAELLLGQPLFPGESAVDQLVEIIKVLGTPTREEIRCMNPNYTEFRFPQIKAHPWHKVFHKRMPPEAIDLASRLLQYSPSLRCTALEACAHPFFDELREPNARLPNGRPFPPLFNFKQELAVASPELINKLIPENVRRQYGLTFPLPAGT

SEQ ID NO: 19162 - protein, 379 aa, Eschscholzia californica
MGDEKDISAAVVEGNDQVTGHIISTTIGGKNGEPKQTISYMAERVVGTGSFGIVFQAKCLETGETVAIKKVLQDRRYKNRELQLMRSMDHPNVISLKHCFFSTTSRNELFLNLVMEYVPETLYRVLEHYSNVNQRMPLIYVKLYTYQIFRGLAYIHTVHGVSHRDLKPQNLLVDPLTHQLKLCDFGSAKVLVRSEANISYICSRYYRAPELIFGATEYTTSIDIWSAGCVLAELLLGQPLFPGESAVDQLVEIIKVLGTPTREEIRCMNPNYTEFRFPQIKAHPWHKVFHKRMPPEAIDLASRLLQYSPSLRCTALEACSHPFFDELREPNARLPNGRPLPTLFNFKQELSGASPELINRLIPEHIRRQSGLNFLHPTT

SEQ ID NO: 19163 - protein, 402 aa, Cyclamen graecum
MASLPVGPLDNHHLAPPPHRPPETDADKEMTPAIIEGNDQVTGHIISTTIGGKNGEPKRTISYMAERVVGTGSFGIVFQAKCLETGETVAIKKVLQDRRYKNRELQLMRLMDHPNVVSLKHCFFSTTTRDELFLNLVMEYVPETMYRVLKHYTNANQRMPLIYVKLYTYQILRGLAYIHTGPGVCHRDVKPQNLLVDPLTHQVKLCDFGSAKILIKGEANISYICSRYYRAPELIFGATEYTSAIDVWSAGCVLAELLLGQPLFPGENAVDQLVEIIKVLGTPTREEIRCMNPNYTDFRFPQIKAHPWHKVFHKRMPPEAIDLASRLLQYSPSLRCTALEACTHPFFDELREPNARLPNGRPLPPLFNFKQELAGASSELISRLIPEHVQRQIGLFPHPAGT

SEQ ID NO: 19164 - protein, 402 aa, Echinochloa colona
MTTVPGGGPHPAADAMEVDPPRASADEKHVATVMGGNDAVTGHIISTTIGGKNGEPKRTISYMAERVVGTGSFGVVFQAKCIETGETVAIKKVLQDKRYKNRELQIMRSIDHCNVISLKHCFFSTTNRDELFLNLVMEFVPESLYRVLKHYKDMKQRMPLIYVKLYMYQIFRGLAYIHNAPGVCHRDIKPQNILVDPLSHQVKVCDFGSAKILVKGEANISYICSRYYRAPELIFGATEYTTSIDIWSAGCVLAELLLGQPLFPGESAVDQLVEIIKVLGTPTREEIRCMNPNYTEFKFPQIKACPWHKIFHKRMPPEAIDLVSRLLQYSPNLRCSALEACAHSFFDELREPNARLPNGRPFPPLFNFKQELANAPPELISKLLPEHARRHSGFSSLFGTGP

SEQ ID NO: 19165 - protein, 402 aa, Setaria italica
MATAPGGGPLPAADAMEVDPPRASADEKHVATVMGGNDAVTGHIISTTIGGKNGEPKRTISYMAERVVGTGSFGVVFQAKCIETGETVAIKKVLQDKRYKNRELQIMRSIDHCNVISLKHCFFSTTSRDELFLNLVMEFVPESLYRVLKHYKDMKQRMPLIYVKLYMYQIFRGLAYIHNAPGVCHRDIKPQNILVDPLSHQVKVCDFGSAKILVKGEANISYICSRYYRAPELIFGATEYTTSIDIWSAGCVLAELLLGQPLFPGESAVDQLVEIIKVLGTPTREEIRCMNPNYTEFKFPQIKACPWHKIFHKRMPPEAIDLVSRLLQYSPNLRCSALEACAHSLFDELREPHARLPNGRPFPPLFNFKQELANAPPELISKLLPEHARRHSGFNSLFGSGP

SEQ ID NO: 19166 - protein, 410 aa, Eutrema parvulum
MTSIPLGPQPPATAPPPQLRDGDASKHRPDMNTDKEMSAAVTEGNDAVTGHIISTTIGGKNGEPKQTISYMAERVVGTGSFGIVFQAKCLETGESVAIKKVLQDRRYKNRELQLMRLMDHPNVISLKHCFFSTTSRDELFLNLVMEYVPETLYRVLRHYTSSNQRMPIFYVKLYTYQIFRGLAYIHTAPGVCHRDVKPQNLLVDPLTHQCKLCDFGSAKVLVKGEANISYICSRYYRAPELIFGATEYTSSIDIWSAGCVLAELLLGQPLFPGENSVDQLVEIIKVLGTPTREEIRCMNPNYTDFRFPQIKAHPWHKVFHKRMPPEAIDLASRLLQYSPSLRCTALEACAHPFFNELREPNARLPNGRPLPPLFNFKQELSGASPELINRLIPEHVRRQMSGGFPFQAGH

SEQ ID NO: 19167 - protein, 406 aa, Musa acuminata
MASLPTGPPHAPASEALVMDPPRPEMVDADKQEASVIQGNQPMTGHIISTTIGGKNGEPKQTISYMAERVVGTGSFGIVFQAKCLETGETVAIKKVLQDIRYKNRELQLMRLMGHPNVISLKHCFFSTTNKDELFLNLVMDFVPETLYRVSKHYSNVNRGMPLIYVKLYMYQIFRGLAYIHNVLRVCHRDVKPQNVLVDPLTHQVKLCDFGSAKVLVKGEANISYICSRYYRAPELIFGATEYTTSIDIWSAGCVLAELLLGHPLFPGESAVDQLVEIIKVLGTPTREEIRCMNPNYTEFRFPQIKAHPWHKVFNKRMPLEAVDLASRLLQYSPNLRCSALEACAHPLFDELRERNARLPNGRPFPLLFDFNKQELLGASPALINKLVPEHARRQCGLDFVQVAGT

SEQ ID NO: 19168 - protein, 380 aa, Chelidonium majus
MGDEKDISAAVVEGNDQVTGHIISTTIGGKNGEPKQTISYMAERVVGTGSFGIVFQAKCLETGETVAIKKVLQDRRYKNRELQLMRSMDHPNAISLKHCFFSTTSRNELFLNLVMEYVPETVYRVLKHYSNVNQRMPLIYVKLYTYQIFRGLAYIHNVHGVSHRDVKPQNLLVDPLTHQVKLCDFGSAKVLVKGEANISYICSRYYRAPELIFGATEYTTSIDIWSAGCVLAELLLGQPLFPGESAVDQLVEIIKVLGTPTREEIRCMNPNYTEFRFPQIKTHPWHKVFHKRMPAEAIDLASRLLQYSPSLRCTALEACSHPFFDELREPNARLPNGRPLPSLFNFKQESSGASPELINRLIPEHVRRQSGLNFLHPAGT

SEQ ID NO: 19169 - protein, 408 aa, Avena sativa
MATLPGGAHPAGAAADLMQVDEPHAAAAAPVVEKHGASIIQGSDPVTGHIISTTIGGKNGEPKRTISYMAERVVGTGSFGIVFQAKCLETGETVAIKKVLQDKRYKNRELQIMRSMDHCNVVCLKHCFFSTTSRDELFLNLVMEFVPESLYRVLKHYSNMNQRMPLIYVKLYVYQIFRGLAYIHSVPGVCHRDIKPQNLLVDPLTHTVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACTHPFFDELREPHAKLPNGRPFPPLFNFKQEVANASPELIGRLIPEHARRHSGLNFLPLTGQ

SEQ ID NO: 19170 - protein, 380 aa, Solanum phureja
MESEKEMSAAVVEGNGAVTGHIISTTIGGKNGEPKRTISYMAERVVGTGSFGIVFQAKCLETGETVAIKKVLQDKRYKNRELQLMRLMDHPNVITLKHCFFSTTSRDELFLNLVMDYVPESLYKVLKHYSNSNQRMPLIYVKLYMYQIFRGLAYIHNVPRICHRDVKPQNLLVDPLTHQVKLCDFGSAKVLVNGEANISYICSRYYRAPELIFGATEYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACAHSFFDELREPNARLPNGRPFPPLFNFKQELTGASPDLVNKLIPEHVWRQLGLNFPFPGAT

SEQ ID NO: 19171 - protein, 378 aa, Cocos nucifera
MAEDKEAAIVEGNGPTTGHIISTTIGGKNGESKRTISYMAERIVGTGSFGIVFQAKCLETGETVAIKKVLQDRRYKNRELQLMRSMDHPNVISLKHCFFSTTNRDELFLNLVMEYVHETLFRALKHYSNVNQRMPLIYVKLYMYQIFRGLAYIHTVPGACHRDVKPQNLLVDPLTHQVKLCDFGSAKILVKGEANISYICSRYYRAPELIFGATEYTTSIDIWSAGCVLAELLLGQPLFPGESSVDQLVEIIKVLGTPTREEIRCMNPNYTEFRFPQIKAHPWHKVFDKRMPPEAIDLASRLLQYSPSLRCTALEACAHPFFDELREPNARLPNGRPFPPLFNFKQELVGASPELINKLIPEHVRRQYGLNFTHPAGT

SEQ ID NO: 19172 - protein, 378 aa, Elaeis guineensis
MAEDKEASVVEGNGPATGHIISTTIGGKNGESKRTISYMAERVVGTGSFGVVFQAKCLETGETVAIKKVLQDRRYKNRELQLMRSMDHPNVISLKHCFFSTTNRDELFLNLVMEYVPETLFRVLKHYSNVNQRMPLIYVKLYMYQIFRGLAYIHTVPGVCHRDVKPQNLLVDPLTHQVKLCDFGSAKVLVKGEGNISYICSRYYRAPELIFGATEYTASIDIWSAGCVLAELLLGQPLFPGESSVDQLVEIIKVLGTPTREEIRCMNPNYTEFRFPQIKAHPWHKVFHKRMPPEAIDLASRLLQYSPNLRCTALEACAHPFFDELREPNARLPSGRPFPPLFNFKQELVDASPELINKLIPEHVKRQYGLNFTRPAGT

SEQ ID NO: 19173 - protein, 380 aa, Papaver somniferum
METEKEISAAVVEGNDQVTGHIISTTIGGKNGEPKQTISYMAERVVGTGSFGIVFQAKCLETGETVAIKKVLQDRRYKNRELQLMRSMDHPNVVTLKHCFFSTTSRNELFLNLVMEYVPETVYRVLKHYSNVNQRMPLIYVKLYTYQIFRGLAYIHSVHGVSHRDVKPQNLLVDPLTHQVKLCDFGSAKVLVKGEANISYICSRYYRAPELIFGATEYTTSIDIWSAGCVLAELLLGQPLFPGESAVDQLVEIIKVLGTPTREEIRCMNPNYTEFRFPQIKAHPWHKVFHKRMPPEAIDLASRLLQYSPSLRCTALEACSHPFFDELREPNARLPNGRPLPPLFNFKQELSGASPELINRLIPEHVRRQLGLSFVHPTGT

SEQ ID NO: 19174 - protein, 380 aa, Vaccinium corymbosum
MDSDKEMTSAVVEGNDQVTGHIISTTIGGKNGEPKRTITYMAERVVGTGSFGIVFQAKCLETGEMVAIKKVLQDRRYKNRELQLMRLMDHPNVVSLKHCFFSTTSKDELFLNLVMEYVPETMYRVLKHYTNANQRMPLIYVKLYTYQIFRGLVYIHTVPGVCHRDVKPQNLLVDPLTHQVKLCDFGSAKVLVKGEANISYICSRYYRAPELIFGATEYTSSIDIWSAGCVLAELLLGQPLFPGESAVDQLVEIIKVLGTPTREEIRCMNPNYTDFRFPQIKAHPWHKVFHKRMPPEAIDLASRLLQYSPSLRCTALEACTHSFFDELREPNARLPNGRPLPPLFNFKQELTGASPELINRLIPEHVRRQSGFNLPHPAGT

SEQ ID NO: 19175 - protein, 380 aa, Manihot esculenta
MDSDKEMTSAEVEGNGAITGHIISTTIGGKNGEPKQTISYMAERVVGTGSFGIVFQAKCLETGEPVAIKKVLQDKRYKNRELQLMRLMDHPNVVPLRHCFFSTTSKDELFLNLVMEYVPETMYRVLKHYTSINQRMPLIYVKLYTYQIFRGLAYIHTVPGVCHRDVKPQNLLVDPLTHQVKLCDFGSAKVLVQGEANISYICSRYYRAPELIFGATEYTTSIDIWSAGCVLAELLLGQPLFPGENAVDQLVEIIKVLGTPTREEIRCMNPNYTDFRFPQIKAHPWHKIFHKRMPPEAIDLASRLLQYSPSLRCTALEACSHPFFDELREPNARLPNGRPLPPLFNFKQELSEASPELINRLIPEHVRRQGGLSFLHPAGS

SEQ ID NO: 19176 - protein, 408 aa, Avena sativa
MATLPGGAHPAGAAADPMQVDEPHAAAAAPVVEKHGASIIQGSDPVTGHIISTTIGGKNGEPKRTISYMAERVVGTGSFGIVFQAKCLETGETVAIKKVLQDKRYKNRELQIMRSMDHCNVVCLKHCFFSTTSRDELFLNLVMEFVPESLYRVLKHYSNMNQRMPLIYVKLYVYQIFRGLAYTHSVPGVCHRDIKPQNLLVDPLTHTVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACTHPFFDELREPHAKLPNGRPFPPLFNFKQEVANASPELIGRLIPEHAKRHSGLNFLPLTGQ

SEQ ID NO: 19177 - protein, 379 aa, Prunus mume
MADDKEISAPVVDGSDPTGHIISTTIGGKNGEPKQTISYMAERVVGTGSFGIVFQAKCLESGETVAIKKVLQDRRYKNRELQLMRVMDHPNVVSLKHCFFSTTSRNELFLNLVMEYVPETMYRVLKHYSNANQRMPLIYVKLYMYQIFRGLAYIHTVPGVCHRDLKPQNLLVDPLTHQVKLCDFGSAKVLVKGEANISYICSRFYRAPELIFGATDYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALDACAHPFFDELREPNARLPNGRPFPPLFNFKQDLSGASPELINRLIPEHVKRQMGLNFLHPAGT

SEQ ID NO: 19178 - protein, 410 aa, Arabidopsis lyrata
MASLPLGHQPHALAPPPPQPQLHDGDALKRRPEMDSDKEMSAAVIEGNDAVTGHIISTTIGGKNGEPKQTISYMAERVVGTGSFGIVFQAKCLETGESVAIKKVLQDRRYKNRELQLMRPMDHPNVISLKHCFFSTTSRDELFLNLVMEYVPETLYRVLRHYTSSNQRMPIFYVKLYTYQIFRGLAYIHTVPGVCHRDVKPQNLLVDPLTHQVKLCDFGSAKVLVKGEANISYICSRYYRAPELIFGATEYTASIDIWSAGCVLAELLLGQPLFPGENSVDQLVEIIKVLGTPTREEIRCMNPNYTDFRFPQIKAHPWHKVFHKRMPPEAIDLASRLLQYSPSLRCTALEACAHPFFNELREPNARLPNGRPLPPLFNFKQELGGASVELVNRLIPEHVRRQMGTGLQNS

SEQ ID NO: 19179 - protein, 410 aa, Eutrema halophilum
MASFPLGPQPHVLAPPPPPQQLHDGDALKRRPELDSDKEMSAAVTEGNDAVTGHIISTTIGGKNGEPKQTISYMAERVVGTGSFGIVFQAKCLETGESVAIKKVLQDRRYKNRELQLMRLMDHPNVISLKHCFFSTTSRDELFLNLVMEYVPETLYRVLRHYTSSNQRMPIFYVKLYTYQIFRGLAYIHAVPGVCHRDVKPQNLLVDPLTHQVKLCDFGSAKVLVKGEANISYICSRYYRAPELIFGATEYTASIDIWSAGCVLAELLLGQPLFPGENSVDQLVEIIKVLGTPTREEIRCMNPNYTDFRFPQIKAHPWHKVFHKRMPPEAIDLASRLLQYSPSLRCTALEACAHPFFNELREPNARLPNGRPLPPLFNFKQELTGVSLELINRLIPEHVRRQMSTGLQNT

SEQ ID NO: 19180 - protein, 383 aa, Valeriana officinalis
MDSDKEMSATSTVVEGNDQVTGHIISTTIGGKNGEPKRTISYMAERVVGTGSFGIVFQAKCLETGETVAIKKVLQDRRYKNRELQLMRMMDHPNVVSLKHCFFSTTSRDELFLNLVMEFVPETMYRVLKHYSNVNQRMPLIYVKLYTYQIFRGLAYIHSVPGVCHRDVKPQNLLVDPLTHQVKLCDFGSAKVLVRGEANIAYICSRYYRAPELIFGATEYTSSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACAHSFFDELRDPNVRLPNGRPVPPLFNFKQELAGASSELVNRLIPEHIQRQMGLNLPSHPPGT

SEQ ID NO: 19181 - protein, 381 aa, Brassica oleracea
MADDREMPPAAVVDGHDQVTGHIISTTIGGKNGEPKQTISYMAERVVGTGSFGIVFQAKCLETGETVAIKKVLQDRRYKNRELQLMRVMDHPNVVCLKHCFFSTTSKDELFLNLVMEYVPESLYRVLKHYSTANQRMPLVYVKLYMYQIFRGLAYIHNVAGVCHRDLKPQNLLVDPLTHQVKICDFGSAKQLVKGEANISYICSRFYRAPELIFGATEYTTSIDIWSAGCVLAELLLGQPLFPGENAVDQLVEIIKVLGTPTREEIRCMNPHYTDFRFPQIKAHPWHKIFHKRMPPEAIDFASRLLQYSPSLRCTALEACAHPFFDELREPNARLPNGRPFPPLFNFKQEVAGASPELVNKLIPDHIKRQLGLSFLNQSGT

SEQ ID NO: 19182 - protein, 411 aa, Musa acuminata
MASLPLGPHHPPPPPGHAAAAAALNLAPPPRTELADNKQASVVEGNEPVTGHIISTTIGGKNGEPKQTLSYMAERVVGTGSFGIVFQAKCLETRETVAIKKVLQDKRYKNRELQLMRTMAHPNVISLKHCFFSSTSRDELFLNLVMEYVPESLYGVLRHYSNVNQRMPLIFVKLYTYQIFRGLAYIHTVPGVCHRDLKPQNILVDPLTHQVKLCDFGSAKVLVKGEANISYICSRYYRAPELIFGATEYTTSIDIWSAGCVLAELLLGQPLFPGDSAVNQLVEIIKVLGTPTREEIRCMNPGYTEFRFPQIKAHPWHKIFHKRMPPEAIDLTSRLLQYSPSFRCTALEACTHPFFDELREPNARLPNGRPLPPLYNFKQELAGASPDLINKLIPEHARRQSGFSCLHMAGT

SEQ ID NO: 19183 - protein, 412 aa, Arabidopsis lyrata
MTSIPLGHPQPPSLAPQPPHLHGGDALKRRPDMDTDKEMSAAVIEGNDAVTGHIISTTIGGKNGEPKQTISYMAERVVGTGSFGIVFQAKCLETGESVAIKKVLQDRRYKNRELQLMRLMDHPNVVSLKHCFFSTTTRDELFLNLVMEYVPETLYRVLKHYTSSNQRMPIFYVKLYTYQIFRGLAYIHTAPGVCHRDVKPQNLLVDPLTHQCKLCDFGSAKVLVKGEANISYICSRYYRAPELIFGATEYTSSIDIWSAGCVLAELLLGQPLFPGENSVDQLVEIIKVLGTPTREEIRCMNPNYTDFRFPQIKAHPWHKVFHKRMPPEAIDLASRLLQYSPSLRCTALEACAHPFFNELREANARLPNGRPLPPLFNFKQELSGASPELINRLIPEHVRRQMNGGFPFQAGP

SEQ ID NO: 19184 - protein, 412 aa, Arabidopsis thaliana
MTSIPLGPPQPPSLAPQPPHLHGGDSLKRRPDIDNDKEMSAAVIEGNDAVTGHIISTTIGGKNGEPKQTISYMAERVVGTGSFGIVFQAKCLETGESVAIKKVLQDRRYKNRELQLMRLMDHPNVVSLKHCFFSTTTRDELFLNLVMEYVPETLYRVLKHYTSSNQRMPIFYVKLYTYQIFRGLAYIHTAPGVCHRDVKPQNLLVDPLTHQCKLCDFGSAKVLVKGEANISYICSRYYRAPELIFGATEYTSSIDIWSAGCVLAELLLGQPLFPGENSVDQLVEIIKVLGTPTREEIRCMNPNYTDFRFPQIKAHPWHKVFHKRMPPEAIDLASRLLQYSPSLRCTALEACAHPFFNELREPNARLPNGRPLPPLFNFKQELSGASPELINRLIPEHVRRQMNGGFPFQAGP

SEQ ID NO: 19185 - protein, 378 aa, Cicer arietinum
MDTDKEMSSTVVDSNDAVTGHIISTTIGGKNGEPKRTISYMAERVVGTGSFGIVFQAKCLETSEAVAIKKVLQDKRYKNRELQLMRVMDHPNVISLKHCFFSTTSRDELFLNLVMEYVPETMYRVLKHYNNINQRMPLIYVKLYTYQIFRGLAYIHTVPGVCHRDVKPQNLLVDPLTHQVKLCDFGSAKVLVKGEANISYICSRYYRAPELIFGATEYTTSIDIWSAGCVLAELLLGQPLFPGENQVDQLVEIIKVLGTPTREEIRCMNPNYSDFRFPQIKAHPWHKVFHKRMPPEAIDLASRLLQYSPSLRCSALEACAHPFFDELREPNARLPNGRPLPPLFNFKQELSGASPELINKLIPEHVRRQTGLGFPYPG

SEQ ID NO: 19186 - protein, 380 aa, Vitis vinifera
MSDDKEISAPVVDGNDPVTGHIISTTIGGKNGEPKQTISYMAERVVGTGSFGIVFQAKCLETGETVAIKKVLQDRRYKNRELQLMRTMDHPNVISLKHCFFSTTSRDELFLNLVMEYVPETMYRVLKHYSNAKQRMPLIYVKLYTYQIFRGLAYIHSVPGVCHRDLKPQNLLVDPLTHQVKLCDFGSAKVLVKGEANISYICSRFYRAPELIFGATEYTTSIDIWSAGCVLAELLLGQPLFPGENAVDQLVEIIKVLGTPTREEIRCMNPSYTDFRFPQIKAHPWHKVFHKRMPPEAIDLASRLLQYSPSLRCTALEACAHPFFDELREPNARLPNGRPLPPLFNFKQELSGASPELVNKLIPEHVRRQIGLSFFHPAGT

SEQ ID NO: 19187 - protein, 408 aa, Avena sativa
MATLPGGAHPAGAAADLMQVDEPHAAAAAPVVEKHGASIIQGSDPVTGHIISTTIGGKNGEPKRTISYMAERVVGTGSFGIVFQAKCLETGETVAIKKVLQDKRYKNRELQIMRSMDHCNVVCLKHCFFSTTSRDELFLNLVMEFVPESLYRVLKHYSNMNQRMPLIYVKLYVYQIFRGLAYTHSVPGVCHRDIKPQNLLVDPLTHTVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACTHPFFDELREPHAKLPNGRPFPPLFNFKQEVANASPELIGRLIPEHAKRHSGLNFLPLTGQ

SEQ ID NO: 19188 - protein, 412 aa, Musa acuminata
MTSLPLGPHQPPPPPGHDAAAAANLTLAVPPRAEMADNKQTSVVGKSEQVTGHVISTTIGGKNGEPKKTISYMAERVVGTGSFGIVFQAKCLETGEAVAIKKVLQDKRYKNRELQLMRSMDHPNVIPLKHCFFSTTSRDELFLNLVMEYVPETLYGVLRHFSNGNQRMPLIYVKLYTYQIFRGLAYIHTVPGVCHRDVKPQNILVDPLTHQVKLCDFGSAKVLVKGEANISYICSRYYRAPELIFGATEYTTSIDIWSAGCVLAELLLGQPLFPGASAVDQLVQIIKVLGTPTREEIRCMNPSYTEFRFPQIKAHPWHKIFHKRMPPEAIDLTSRLLQYSPCFRCSALEACAHPFFDELREPNVRLPNGRPLPPLFNFKQELAGASPELVTKLIPEHVRQRSVLSFLHPVGT

SEQ ID NO: 19189 - protein, 375 aa, Brassica napus
EMPAAVVDGHDQVTGHIISTTIGGKNGEPKQTISYMAERVVGTGSFGIVFQAKCLETGETVAIKKVLQDRRYKNRELQLMRVMDHPNVVCLKHCFFSTTSKDELFLNLVMEYVPESLYRVLKHYSTANQRMPLVYVKLYMYQIFRGLAYIHNVAGVCHRDLKPQNLLVDPLTHQVKICDFGSAKQLVKGEANISYICSRFYRAPELIFGATEYTTSIDIWSAGCVLAELLLGQPLFPGENAVDQLVEIIKVLGTPTREEIRCMNPHYTDFRFPQIKAHPWHKIFHKRMPPEAIDFASRLLQYSPSLRCTALEACAHPFFDELREPNARLPNGRPFPPLFNFKQEVAGASPELVNKLIPDHIKRQLGLSFLNQSGT

SEQ ID NO: 19190 - protein, 376 aa, Raphanus sativus
EMPAAVVDGGHDQVTGHIISTTIGGKNGEPKQTISYMAERVVGTGSFGIVFQAKCLETGETVAIKKVLQDRRYKNRELQLMRVMDHPNVVRLKHCFFSTTSKDELFLNLVMEYVPESLYRVLKHYSTANQRMPLVYVKLYMYQIFRGLAYIHNVAGVCHRDLKPQNLLVDPLTHQVKICDFGSAKQLVKGEANISYICSRFYRAPELIFGATEYTTSIDIWSAGCVLAELLLGQPLFPGENAVDQLVEIIKVLGTPTREEIRCMNPHYTDFRFPQIKAHPWHKIFHKRMPPEAIDFASRLLQYSPSLRCTALEACAHPFFDELREPNARLPNGRPFPPLFNFKQEVAGASPELVNKLIPDHIKRQLGLSFLSQSGT

SEQ ID NO: 19191 - protein, 374 aa, Eutrema parvulum
MPAAVVDGHDQVTGHIISTTIGGKNGEPKQTISYMAERVVGTGSFGIVFQAKCLETGETVAIKKVLQDRRYKNRELQLMRVMDHPNVVCLKHCFFSTTSKDELFLNLVMEYVPESLYRVLKHYSSANQRMPLVYVKLYMYQIFRGLAYIHNVAGVCHRDLKPQNLLVDPLTHQVKICDFGSAKQLVKGEANISYICSRFYRAPELIFGATEYTTSIDIWSAGCVLAELLLGQPLFPGENAVDQLVEIIKVLGTPTREEIRCMNPHYTDFRFPQIKAHPWHKIFHKRMPPEAIDFASRLLQYSPSLRCTALEACAHPFFDELREPNARLPNGRPFPPLFNFKQEVAAASPELVNKLIPDHIKRQLGLSFLNQSGT

SEQ ID NO: 19192 - protein, 604 aa, Saccharum officinarum
MAERLTRIAIVSEDKCKPKKCRQECKKSCPVVKTGKLCIEVTPASKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKAELCVDLELNQVIDRNVGDLSGGELQRFAIAVVAVQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLTVVEGEFTDSQIVVMLGENGTGKTTFIRMLAGLLKPDTVEGTDIEIPEFNVSYKPQKISPKFQNTVRHLLHQKIRDSYMHPQFVSDVMKPLQIEQLMDQEVVNLSGGELQRVAICLCLGKPADIYLIDEPSAYLDSEQRIVASKVIKRFILHAKKTAFIVEHDFIMATYLADKVIVYEGRPSIDCTANAPQSLVSGMNKFLSHLDITFRRDPTNYRPRINKLDSTKDREQKSAGSYYYLDD

SEQ ID NO: 19193 - protein, 604 aa, Setaria italica
MAERLTRIAIVSEDKCKPKKCRQECKKSCPVVKTGKLCIEVTSASKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKAELCVDLELNQVIDRNVGDLSGGELQRFAIAVVAVQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLTVVEGEFTDSQIVVMLGENGTGKTTFIRMLAGLLKPDTVEGTDIEIPEFNVSYKPQKISPKFQNTVRHLLHQKIRDSYMHPQFVSDVMKPLQIEQLMDQEVINLSGGELQRVAICLCLGKPADIYLIDEPSAYLDSEQRIVASKVIKRFILHAKKTAFIVEHDFIMATYLADKVIVYEGRPSIDCIANAPQSLVSGMNKFLSHLDITFRRDPTNYRPRINKLDSTKDREQKSAGSYYYLDD

SEQ ID NO: 19194 - protein, 604 aa, Zea mays
MAERLTRIAIVSEDKCKPKKCRQECKKSCPVVKTGKLCIEVTSASKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKAELCVDLELNQVIDRNVGDLSGGELQRFAIAVVAVQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLTVVEGEFTDSQIVVMLGENGTGKTTFIRMLAGLLKPDTVEGTDIEIPEFNVSYKPQKISPKFKNTVRHLLHQKIRDSYMHPQFVSDVMKPLQIEQLMDQEVVNLSGGELQRVAICLCLGKPADIYLIDEPSAYLDSEQRIVASKVIKRFILHAKKTAFIVEHDFIMATYLADKVIVYEGRPSIDCSANAPQSLVSGMNKFLSHLDITFRRDPTNYRPRINKLDSTKDREQKSAGSYYYLDD

SEQ ID NO: 19195 - protein, 604 aa, Zea mays
MAERLTRIAIVSEDKCKPKKCRQECKKSCPVVKTGKLCIEVTSASKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKSELCVDLELNQVIDRNVGDLSGGELQRFAIAVVAVQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKIAETQENAEEIETYQRYKYPTMSKTQGNFKLTVVEGEFTDSQIVVMLGENGTGKTTFIRMLAGLLKPDTVEGTDIEIPEFNVSYKPQKISPKFQNTVRHLLHQKIRDSYMHPQFVSDVMKPLQIEQLMDQEVVNLSGGELQRVAICLCLGKPADIYLIDEPSAYLDSEQRIVASKVIKRFILHAKKTAFIVEHDFIMATYLADKVIVYEGRPSIDCTANAPQSLVSGMNKFLSHLDITFRRDPTNYRPRINKLESTKDREQKSAGSYYYLDD

SEQ ID NO: 19196 - protein, 604 aa, Echinochloa colona
MADRLTRIAIVSEDKCKPKKCRQECKKSCPVVKTGKLCIEVTSASKVAFISEELCIGCGICVKKCPFDAIDIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKAELCVDLELNQVIDRNVGDLSGGELQRFAIAVVAVQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLTVVEGEFTDSQIVVMLGENGTGKTTFIRMLAGLLKPDTVEGTDIEIPEFNVSYKPQKISPKFQHTVRHLLHQKIRDSYMHPQFVSDVMKPLQIEQLMDQEVINLSGGELQRVAICLCLGKPADIYLIDEPSAYLDSEQRIVASKVIKRFILHAKKTAFIVEHDFIMATYLADKVIVYEGRPSIDCTANAPQSLVSGMNKFLSHLDITFRRDPTNYRPRINKLDSTKDREQKLAGSYYYLDD

SEQ ID NO: 19197 - protein, 604 aa, Echinochloa colona
MADRLTRIAIVSEDKCKPKKCRQECKKSCPVVKTGKLCIEVTSASKVAFISEELCIGCGICVKKCPFDAIDIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKAELCVDLELNQVIDRNVGDLSGGELQRFAIAVVAVQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLSVVEGEFTDSQIVVMLGENGTGKTTFIRMLAGLLKPDTVEGTDIEIPEFNVSYKPQKISPKFQHTVRHLLHQKIRDSYMHPQFVSDVMKPLQIEQLMDQEVINLSGGELQRVAICLCLGKPADIYLIDEPSAYLDSEQRIVASKVIKRFILHAKKTAFIVEHDFIMATYLADKVIVYEGRPSIDCTANAPQSLVSGMNKFLSHLDITFRRDPTNYRPRINKLESTKDREQKLAGSYYYLDD

SEQ ID NO: 19198 - protein, 604 aa, Oryza sativa
MAERLTRIAIVSEDKCKPKKCRQECKKSCPVVKTGKLCIEVTPASKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLDQKDERGVKAELCVDLELNQVIDRNVGDLSGGELQRFAIAVVAVQNAEIFMFDEPSSYLDVKQRLKAAQVVRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLTVVEGEFTDSQIVVMLGENGTGKTTFIRMLAGLLKPDTVEGTEIEIPEFNVSYKPQKISPKFQHSVRHLLHQKIRDSYTHPQFVSDVMKPLQIEQLMDQEVINLSGGELQRVAICLCLGKPADIYLIDEPSAYLDSEQRIVASKVIKRFILHAKKTAFIVEHDFIMATYLADKVIVYEGRPSIDCTANAPQSLVSGMNKFLSHLDITFRRDPTNYRPRINKLDSTKDREQKSAGSYYYLDD

SEQ ID NO: 19199 - protein, 604 aa, Brachypodium distachyon
MADRLTRIAIVSEDKCKPKKCRQECKKSCPVVKTGKLCIEVSPAAKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKNELCVDLELNQVIDRNVGDLSGGELQRFAIAVVAVQSAEIYMFDEPSSYLDVKQRLKAAQVIRSLLRSNSYVIVVEHDLSVLDYLSDFICCLYGKPGAYGVVTLPFSVREGINIFLAGFVPTENLRFRDESLTFKIAETQENAEEVASYQRYKYPSMSKTQGNFKLSVAEGEFTDSQIVVMLGENGTGKTTFIRMLAGLLKPDTIEGTEVEIPEFNVSYKPQKISPKFQHPVRHLLHQKIRDSYTHPQFVSDVMKPLQIEQLMDQEVVNLSGGELQRVALCLCLGKPADIYLIDEPSAYLDSEQRIVASKVIKRFILHAKKTAFIVEHDFIMATYLADKVIVYEGRASIDCTANAPQSLVSGMNKFLSHLDITFRRDPTNYRPRINKLESTKDREQKNAGSYYYLDD

SEQ ID NO: 19200 - protein, 604 aa, Secale cereale
  Sequence also found in Organisms: Triticum aestivum
MADRLTRIAIVSEDKCKPKKCRQECKKSCPVVKTGKLCIEVSPAAKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKNELCVDLELNQVIDRNVGDLSGGELQRFAIAVVAVQSAEIYMFDEPSSYLDVKQRLKAARVIRSLLRSNSYVIVVEHDLSVLDYLSDFICCLYGKPGAYGVVTLPFSVREGINIFLAGFVPTENLRFRDESLTFKIAETQENAEEVATYQRYKYPTMSKTQGNFKLSVVEGEFTDSQIVVMLGENGTGKTTFIRMLAGLLKPDTMEGTEVEIPEFNVSYKPQKISPKFQHPVRHLLHSKIRDSYTHPQFVSDVMKPLQIEQLMDQEVINLSGGELQRVALCLCLGKPADIYLIDEPSAYLDSEQRIVASKVIKRFILHAKKTAFIVEHDFIMATYLADKVIVYEGLASIDCTANAPQSLVSGMNKFLSHLDITFRRDPTNYRPRINKLESTKDREQKNAGSYYYLDD

SEQ ID NO: 19201 - protein, 604 aa, Avena sativa
MADRLTRIAIVSEDKCKPKKCRQECKKSCPVVKTGKLCIEVSPAVKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKNELCVDLELNQVIDRNVGDLSGGELQRFAIAVVAVQSAEIYMFDEPSSYLDVKQRLKAARVIRSLLRSNSYVIVVEHDLSVLDYLSDFICCLYGKPGAYGVVTLPFSVREGINIFLAGFVPTENLRFRDESLTFKIAETQENAEEVASYQRYKYPTMTKTQGNFKLCVAEGEFTDSQIVVMLGENGTGKTTFIRMLAGLLKPDTVEGTEIEIPEFNVSYKPQKISPKFQHPVRHLLHSKIRDSYTHPQFVSDVMKPLQIEALMDQEVINLSGGELQRVALCLCLGKPADIYLIDEPSAYLDSEQRIVASKVIKRFILHAKKTAFIVEHDFIMATYLADKVIVYEGRASIDCTANAPQSLVSGMNKFLSHLDITFRRDPTNYRPRINKLESTKDREQKNAGSYYYLDD

SEQ ID NO: 19202 - protein, 604 aa, Triticum aestivum
MADRLTRIAIVSEDKCKPKKCRQECKKSCPVVKTGKLCIEVSPAAKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKNELCVDLELNQVIDRNVGDLSGGELQRFAIAVVAVQSAEIYMFDEPSSYLDVKQRLKAARVIRSLLRSNSYVIVVEHDLSVLDYLSDFICCLYGKPGAYGVVTLPFSVREGINIFLAGFVPTENLRFRDESLTFKIAETQENAEEVATYQRYKYPTMSKTQGNFKLSVVEGEFTDSQIVVMLGENGTGKTTFIRMLAGLLKPDTMEGSEVEIPEFNVSYKPQKISPKFQHPVRHLLHSKIRDSYTHPQFVSDVMKPLQIEQLMDQEVINLSGGELQRVALCLCLGKPADIYLIDEPSAYLDSEQRIVASKVIKRFILHAKKTAFIVEHDFIMATYLADKVIVYEGLASIDCTANAPQSLVSGMNKFLSHLDITFRRDPTNYRPRINKLESTKDREQKNAGSYYYLDD

SEQ ID NO: 19203 - protein, 604 aa, Triticum aestivum
MADRLTRIAIVSEDKCKPKKCRQECKKSCPVVKTGKLCIEVSPVAKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKNELCVDLELNQVIDRNVGDLSGGELQRFAIAVVAVQSAEIYMFDEPSSYLDVKQRLKAARVIRSLLRSNSYVIVVEHDLSVLDYLSDFICCLYGKPGAYGVVTLPFSVREGINIFLAGFVPTENLRFRDESLTFKIAETQENAEEVATYQRYKYPTMSKTQGNFKLSVVEGEFTDSQIVVMLGENGTGKTTFIRMLAGLLKPDTMEGTEVEIPEFNVSYKPQKISPKFQHPVRHLLHSKIRDSYTHPQFVSDVMKPLQIEQLMDQEVINLSGGELQRVALCLCLGKPADIYLIDEPSAYLDSEQRIVASKVIKRFILHAKKTAFIVEHDFIMATYLADKVIVYEGLASIDCTANAPQSLVSGMNKFLSHLDITFRRDPTNYRPRINKLESTKDREQKNAGSYYYLDD

SEQ ID NO: 19204 - protein, 591 aa, Panicum virgatum
MAERLTRIAIVSEDKCKPKKCRQECKKSCPVVKTGKLCIEVTPASKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKAELCVDLELNQVIDRNVGDLSGGELQRFAIAVVAVQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLTVVEGEFTDSQIVVMLGENGTGKTTFIRMLAGLLKPDTVEGTDIEIPEFNVSYKPQKISPKFQNTVRHLLHQKIRDSYMHPQFVSDVMKPLQIEQLMDQEVINLSGGELQRVAICLCLGKPADIYLIDEPSAYLDSEQRIVASKVIKRFILHAKKTAFIVEHDFIMATYLADKVIVYEGRPSIDCTANAPQSLVSGMNKFLSHLGVTFKRDPANYRPCFPTSSMIRIQ

SEQ ID NO: 19205 - protein, 604 aa, Festuca arundinacea
MAERLTRIAIVSEDKCKPKKCRQECKKSCPVVKTGKLCIEVSPAAKIAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKNELCVDLELNQVIDRNVGDLSGGELQRFAIAVVAVQSAEIYMFDEPSSYLDVKQRLKAARVIRSLLRSNSYVIVVEHDLSVLDYLSDFICCLYGKPGAYGVVTLPFSVREGINIFLAGFVPTENLRFREESLTFKIAETQENAEEVASYQRYKYPTMTKTQGNFKLCVAEGEFTDSQIVVMLGENGTGKTTFIRMLAGLLKPDTVEGTEVEIPEFNVSYKPQKISPKFQHPVRHLLHSKIRDSYTHPQFVSDVMKPLQIEALMDQEVINLSGGELQRVALCLCLGKPADIYLIDEPSAYLDSEQRIVASKVIKRFILHAKKTAFIVEHDFIMATYLADKVIVYEGRASIDCTANAPQSLVSGMNKFLSHLDITFRRDPTNYRPRINKLESTKDREQKNAGSYYYLDD

SEQ ID NO: 19206 - protein, 605 aa, Musa acuminata
MADRLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDEREMKAELCNGLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQESAEEIQTYQRYKYPTMSKTQGNFKLKVIEGEFTDSQIIVMLGENGTGKTTFIRMLAGLLKPDTVEDSDVEMPEFNVSYKPQKISPKFPSTVRHLLHQKIRDSYMHPQFVSDVMKPLQIEQLMDQEVVNLSGGELQRVALCLCLGKPADIYLIDEPSAYLDSEQRIVASKVIKRFILHAKKTAFIVEHDFIMATYLADKVIVYEGRPSIDCTANAPQSLVSGMNLFLSHLDITFRRDPTNYRPRINKLDSTKDREQKAAGSYYYLDD

SEQ ID NO: 19207 - protein, 605 aa, Ananas comosus
MADRLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDMKAELCVDLELNQVIDRNVGDLSGGELQRFAIAVVAVQNAEIYMFDEPSSYLDVKQRLKAAQVVRSLLRPNSYVIVVEHDLSVLDYLSDFICCLYGKPGAYGVVTLPFSVREGINIFLAGFVPTENLRFREESLTFKVAETPQESAEEIQTYQRYKYPTMTKTQGNFRLSVIEGEFTDSQIIVMLGENGTGKTTFIRMLAGLLKPDTVEGTDVEIPEFHVSYKPQKISPKFQSTVRHLLHQKIRDSYMHAQFVSDVMKPLQIEQLMDQEVVNLSGGELQRVALCLCLGKPADIYLIDEPSAYLDSEQRIVASKVIKRFILHAKKTAFVVEHDFIMATYLADKVIVYEGIPSVDCTANAPQSLVSGMNRFLSHLDITFRRDPTNYRPRINKLDSTKDREQKSAGSYYYLDD

SEQ ID NO: 19208 - protein, 604 aa, Brachypodium distachyon
MADRLTRIAIVNEDRCKPKKCRQECKKSCPVVKTGKLCIEVSSASKVAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLDQKDERGIKAELCVDLELNQVIDRNVGDLSGGELQRFAIAVVAVQSAEIYMFDEPSSYLDVKQRLKAAQVIRSLLRANSYVIVVEHDLSVLDYLSDFICCLYGKPGAYGVVTLPFSVREGINIFLAGFVPTENLRFRDESLTFKIVESQESAEEIETYQRYKYPTMSKTLGNFKLTVMEGEFTDSQIVVMLGENGTGKTTFIRLLAGHLKPDTVEGTDIEIPEFNVSYKPQKLSPKFQGSVRQLLHKKIRDSYTHPQFTSDVIKPLQIEQLMDQEVINLSGGELQRMALCLCLGQPADIYLIDEPSAYLDSEQRIVASKVIKRFILHAKKTAFIVEHDFIMATYLADKVVVYEGRPSIDCTANAPQSLVSGMNKFLSHLDITFRRDPTNYRPRINKLESTKDREQKSAGSYYYLDD

SEQ ID NO: 19209 - protein, 604 aa, Avena sativa
MADRLTRIAILNEDRCKPKKCRQECRKSCPVVKTGKLCIEVSPATKVAFISEDLCIGCGICVKKCPFSAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKNELCVDLELNQVIDRNVGDLSGGELQRFAIAVVAVQSAEIYMFDEPSSYLDVKQRLKAARVIRSLLRSNSYVIVVEHDLSVLDYLSDFICCLYGKPGAYGVVTLPFSVREGINIFLAGFVPTENLRFRDESLTFKIAETQENAEEVASYQRYKYPTMTKTQGNFKLCVAEGEFTDSQIVVMLGENGTGKTTFIRMLAGLLKPDTVEGTEIEIPEFNVSYKPQKISPKFQHPVRHLLHSKIRDSYTHPQFVSDVMKPLQIEALMDQEVINLSGGELQRVALCLCLGKPADIYLIDEPSAYLDSEQRIVASKVIKRFILHAKKTAFIVEHDFIMATYLADKVIVYEGRASIDCTANAPQSLVSGMNKFLSHLDITFRRDPTNYRPRINKLESTKDREQKNAGSYYYLDD

SEQ ID NO: 19210 - protein, 605 aa, Manihot esculenta
MADRLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDEREMKAELCHDLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQESAEEIETYARYKYPTMTKTQGNFRLRVIEGEFTDSQIIVMLGENGTGKTTFIRMLAGLLKPDTVEDSDVEIPEFNVSYKPQKISPKFQSTVRHLLHQKIRDSYTHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGRPSIDCTANSPQSLLTGMNLFLSHLDITFRRDPTNYRPRINKLDSTKDREQKSAGSYYYLDD

SEQ ID NO: 19211 - protein, 605 aa, Ricinus communis
MADRLTRIAIVSSDRCKPKKCRQECKKSCPVVKTGKLCIEVTVASKIAFISEELCIGCGICVKKCPFEALQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDEREMKAELCHDLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQESAEEIETYARYKYPTMTKTQGNFKLRVVEGEFTDSQIIVMLGENGTGKTTFIRMLAGLLKPDSVEGSDVEIPEFNVSYKPQKISPKFQSTVRHLLHQKIRDSYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGRPSVDCTANSPQSLLTGMNLFLSHLDITFRRDPTNYRPRINKLDSTKDREQKAAGSYYYLDD

SEQ ID NO: 19212 - protein, 605 aa, Citrullus lanatus
MADRLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLEQKDERDMKQELCRDLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQESAEEIETYARYKYPTMSKTQGNFKLRVIEGEFTDSQIIVMLGENGTGKTTFIRMLAGLLKPDSVEGSDIEIPEFNVSYKPQKISPKFQSTVRHLLHQKIRESYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGQPSVDCTANCPQSLLTGMNLFLSHLDITFRRDPTNYRPRINKVDSAKDREQKSAGSYYYLDD

SEQ ID NO: 19213 - protein, 605 aa, Musa acuminata
MADRLTRIAIVSSDRCKPKKCRQECKKSCPVVKTGKLCIEVTPASKLAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDEREKKAQLCADLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLMFKVAETPQESAEEIQTYQRYRYPTMSKTQGNFKLKVIEGEFTDSQIIVMLGENGTGKTTFIRMLAGLLKPDTVEDSDVEMPEFNVSYKPQKISPKFQYTVRHLLHLKIRDSYMHPQFVTDVMKPLQIEQLMDQEVVNLSGGELQRVALCLCLGKPADIYLIDEPSAYLDSEQRIVASKVIKRFILHAKKTAFVVEHDFIMATYLADKVIVYEGKPSVDCIANAPQSLVSGMNLFLSHLDITFRRDPTNYRPRINKLDSTKDREQKSAGSYYYLDD

SEQ ID NO: 19214 - protein, 605 aa, Cocos nucifera
MADRLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRYNNPPDWQEILTYFRGSELQNYFTRILEDNLKAIIKPQYVDHIPKAVQGNVGQVLDQKDERDMKAELCIDLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESGEDIQTYQRYRYPTMSKTQGNFKLSVIEGEFTDSQIIVMLGENGTGKTTFIRMLAGLLKPDVVEDTDVEIPEFNVSYKPQKISPKFQSTVRHLLHQKIRDSYMHPQFTTDVMKPLQIEQLMDQEVVNLSGGELQRVALCLCLGKPADIYLIDEPSAYLDSEQRIVAAKVIKRFILHAKKTAFVVEHDFIMATYLADKVIVYEGRPSVDCIANAPQSLVSGMNRFLSHLDITFRRDPTNYRPRINKLDSTKDREQKAAGSYYYLDD

SEQ ID NO: 19215 - protein, 605 aa, Cocos nucifera
MADRLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRYNNPPDWQEILTYFRGSELQNYFTRILEDNLKAIIKPQYVDHIPKAVQGNVGQVLDQKDERDMKAELCIDLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAEAPQESAEEIQTYQRYRYPTMSKTQGGFKLSVIEGEFTDSQIIVMLGENGTGKTTFIRMLAGLLKPDSVEDSDIEIPEFNVSYKPQKISPKFQSTVRHLLHQKIRDSYMHPQFTSDVMKPLQIEQLMDQEVVNLSGGELQRVALCLCLGKPADIYLIDEPSAYLDSEQRIIASKVIKRFILHAKKTAFIVEHDFIMATYLADKVIVYEGKPSVNCTANAPQSLVSGMNCFLSHLDITFRRDPTNFRPRINKLNSTKDREQKAAGSYYYLDD

SEQ ID NO: 19216 - protein, 605 aa, Cocos nucifera
MADRLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRYNNPPDWQEILTYFRGSELQNYFTRILEDNLKAIIKPQYVDHIPKAVQGNVGQVLDQKDERDMKAKLCIDLELNQVIDRNVGDLSGGELQRFAIAVVAIQNAEIYMFDEPSSYLDVRQRLKAAQVIRSLLRANSYVIVVEHDLSVLDYLSDFICCLYGKPGAYGVVTLPFSVREGINIFLAGFVPTENLRFRDESLTFKVAETPQESAEEIQTYQRYKYPTMSKTQGNFKLSVIEGEFTDSQIIVMLGENGTGKTTFIRMLAGLLRPDVVEGTDVEIPEFHVSYKPQKISPKFESTVRHLLHQKIRDSYMHPQFTTDVMKPLQIEQLMDQEVVNLSGGELQRVALCLCLGKPADIYLIDEPSAYLDSEQRIVASKVIKRFILHAKKTAFVVEHDFIMATYLADKVIVYEGQPSVDCTANAPQSLVSGMNRFLSHLDITFRRDPTNYRPRINKLDSTKDREQKAAGSYYYLDD

SEQ ID NO: 19217 - protein, 605 aa, Gossypium hirsutum
  Sequence also found in Organisms: Gossypium raimondii
MADRLTRIAIVSSDRCKPKKCRQECKKSCPVVKTGKLCIEVTPASKIAFISEELCIGCGICVKKCPFEAIQIINLPRDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDEREMKAELCADLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQESAEEIETYARYKYPTMTKTQGNFKLKVMEGEFTDSQIIVMLGENGTGKTTFIRMLAGLLKPDNVEGSDVEIPEFNVSYKPQKISPKFQSTVRHLLHQKIRDSYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGKPSVDCIANSPQSLLTGMNLFLSHLDITFRRDPTNYRPRINKLDSTKDREQKSAGSYYYLDD

SEQ ID NO: 19218 - protein, 605 aa, Elaeis guineensis
MADRLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRYNNPPDWQEILTYFRGSELQNYFTRILEDNLKAIIKPQYVDHIPKAVQGNVGQVLDQKDERDMKAKLCIDLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLIFKVAETPQESAEEIQTYQRYKYPTMSKTQGNFKLSVIEGEFTDSQIIVMLGENGTGKTTFIRMLAGLLRPDVVEDTDVEIPEFNVSYKPQKISPKFQSTVRHLLHQKIRDSYMHPQFTTDVMKPLQIEQLMDQEVVNLSGGELQRVALCLCLGKPADIYLIDEPSAYLDSEQRIVASKVIKRFILHAKKTAFVVEHDFIMATYLADKVIVYEGQASVDCTANAPQSLVSGMNRFLSHLDITFRRDPTNYRPRINKLDSTKDREQKAAGSYYYLDD

SEQ ID NO: 19219 - protein, 605 aa, Fagus grandifolia
MSERLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRFKNPPDWQEILTHFRGSELQNYFTRILEDNLKAIIKPQYVDHIPKAVQGNVGQVLDQKDERDMKSELCADLELNQVIDRNVGDLSGGELQRFAIAVVAVQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIETYARYKYPTMTKTQGNFRLRVVEGEFTDSQIVVMLGENGTGKTTFIRMLAGLLKPDSVEGTDVEIPEFNVSYKPQKISPRFQSTVRSLLHQKIRDSYMHPQFMSDVMKPLLIEQLMDQEVVNLSGGELQRVALCLCLGKPADIYLIDEPSAYLDSEQRIVASKVIKRFILHAKKTAFVVEHDFIMATYLADRVIVYEGQPSIDCSANSPQSLLTGMNLFLSHLDITFRRDPTNFRPRINKLESTKDREQKSAGSYYYLDD

SEQ ID NO: 19220 - protein, 605 aa, Panax ginseng
MADRLTRIAIVSSDRCKPKKCRQECKKSCPVVKTGKLCIEVTPAAKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDMKAELCFDLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQESAEEIETYARYRYPTMSKTQGGFKLKVMEGEFTDSQIVVMLGENGTGKTTFIRTLAGLLKPDTVEGSDVEIPEFNVSYKPQKISPKFQNTVRHLLHSKIRDSYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGKPSIDCIANAPQSLLTGMNLFLSHLNITFRRDPTNFRPRINKLESAKDREQKSAGSYYYLDD

SEQ ID NO: 19221 - protein, 606 aa, Sesamum indicum
MADQKLTRIAIVSSDKCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLEQKDERDMKGELGVDLELNQVMDRNVGDLSGGELQRFAIAVVAVQNAEIYMFDEPSSYLDVKQRLKAAQVIRSLLRPNSYVIVVEHDLSVLDYLSDFICCLYGKPGVYGVVTLPFSVREGINIFLAGFVPTENLRFRDESLTFKVAETPQESAEEIETYARYKYPTMTKTQGNFKLKVMEGEFTDSQIIVMLGENGTGKTTFIRMLAGLLKPDSVEGSDVEIPEFNVSYKPQKISPKFQSTVRMLLHQKIRDSYMHPQFVSDVMKPLLIEQLMDQEVVNLSGGELQRVALTLCLGKPADIYLIDEPSAYLDSEQRIVASKVIKRFILHAKKTAFVVEHDFIMATYLADRVIVYEGKPSIDCVANSPQSLLTGMNLFLSHLDITFRRDPTNYRPRINKLDSTKDREQKSAGSYYYLDD

SEQ ID NO: 19222 - protein, 606 aa, Tabernaemontana elegans
MADQRLTRIAIVSSDKCKPKKCRQECKKSCPVVKTGKLCIEVTPGSKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDEREMKQELCVDLELNQVLDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIETYARYKYPTMTKTQGNFKLKVMEGEFTDSQIVVMLGENGTGKTTFIRMLAGLLKPDLVEGSDVEIPEFNVSYKPQKISPKFQSTVRHLLHQKIRDSYTHPQFISDVMKPLQIEQLMDQEVVNLSGGELQRVALALCLGKPADIYLIDEPSAYLDSEQRIVASKVIKRFILHAKKTAFVVEHDFIMATYLADRVIVYEGRPSVDCVANAPQSLLTGMNLFLSHLDITFRRDPTNYRPRINKLDSTKDREQKSAGSYYYLDD

SEQ ID NO: 19223 - protein, 605 aa, Cocos nucifera
MADRLTRIAIVSSDRCKPKKCRQECKKSCPVVKTGKLCIEVTPASKIAFISEELCIGCGICVKKCPFEAIQIINLPKDLSRDTTHRYGPNTFKLHRLPVPRPGQVLGLVGTNGIGKSTALKVLAGRLKPNLGRYDNPPDWQEILTYFRGSELQNYFTRILEDNLKAIIKPQYVDHIPKAVQGNVGQVLDQKDEREMKAELCADLELNQVIDRNVGDLSGGELQRFAIAVVAVQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAEAPQESAEEIQTYQRYRYPTMSKTQGGFKLSVIEGEFTDSQIIVMLGENGTGKTTFIRMLAGLLKPDSVEDSDIEIPEFNVSYKPQKISPKFQSTVRHLLHQKIRDSYMHPQFTSDVMKPLQIEQLMDQEVVNLSGGELQRVALCLCLGKPADIYLIDEPSAYLDSEQRIIASKVIKRFILHAKKTAFIVEHDFIMATYLADKVIVYEGKPSVNCTANAPQSLVSGMNCFLSHLDITFRRDPTNFRPRINKLNSTKDREQKAAGSYYYLDD

SEQ ID NO: 19224 - protein, 605 aa, Euonymus alatus
MSDRLTRIAIVSSDRCKPKKCRQECKKSCPVVKTGKLCIEVSSASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDMKAELCADLELNQVIDRNVGDLSGGELQRFAIAVVAIQNAEIYMFDEPSSYLDVRQRLKAAQVVRSLLRPNSYVIVVEHDLSVLDYLSDFICCLYGKPGAYGVVTLPFSVREGINIFLAGFVPTENLRFRDESLTFKVAETPQESAEEIETYARYKYPTMTKTQGNFKLRVVEGEFTDSQIVVMLGENGTGKTTFIRMLAGLLKPDTVEGTDVEIPEFNVSYKPQKISPKFQSTVRHLLHQKIRDSYTHPQFHSDVMKPLLIEQLMDQEVVNLSGGELQRVALCLCLGKPADIYLIDEPSAYLDSEQRIAASKVIKRFILHAKKTAFVVEHDFIMATYLADRVIVYEGKPSLDCTANSPQSLLTGMNLFLSHLDITFRRDPTNFRPRINKLESTKDREQKAAGSYYYLDD

SEQ ID NO: 19225 - protein, 605 aa, Aristolochia fimbriata
MADRLTRIAIVSSDRCKPKKCRQECKKSCPVVKTGKLCIEVTPASKIAFISEELCIGCGICVKKCPFEAIQIINLPKDLNKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDMKAELCDDLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFREESLTFKVAETPQESAEEIQTYARYRYPTMSKTQGNFKLKVIEGEFTDSQIIVMLGENGTGKTTFIRMLAGLLKPDVVESSEAEIPEFNVSYKPQKISPKFPSTVRHLLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGKPSVDCIANCPQSLLTGMNLFLSHLDITFRRDPTNYRPRINKLDSTKDREQKSAGSYYYLDD

SEQ ID NO: 19226 - protein, 605 aa, Theobroma cacao
MADRLTRIAIVSSDRCKPKKCRQECKKSCPVVKTGKLCIEVTPASKIAFISEELCIGCGICVKKCPFEAIQIINLPRDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDEREMKSELCVDLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIETYARYKYPTMTKTQGNFKLKVIEGEFTDSQIIVMLGENGTGKTTFIRMLAGLLKSDSIEGSDVEIPEFNVSYKPQKISPKFQSTVRHLLHQKIRDSYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGKPSVDCIANSPQSLLTGMNLFLSHLDITFRRDPTNYRPRINKLDSTKDREQKSAGSYYYLDD

SEQ ID NO: 19227 - protein, 605 aa, Chrysanthemum coronarium
MADRLTRIAILKEDRCKPKKCRQECKKSCPVVKTGKLCIEVSSASKVAYISEELCIGCGICVKKCPFDAIEIINLPKDLEKDTTHRYGVNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLEQKDERDAKAELCADLELNQVIDRNVGDLSGGELQRFAIAVVAIQMAEIYMFDEPSSYLDVKQRLKAAQVIRSLLRPNSYVIVVEHDLSVLDYLSDFICCLYGKPGAYGVVTLPFSVREGINIFLDGFVPTENLRFRDESLTFRVSETTQESAEEIETYARYKYPTMSKTQGGFKLKVVEGEFTDSQIIVMLGENGTGKTTFIRMLAGLLKPDTVEGTDVEIPEFNVSYKPQKISPKFPHSVRHLLHSKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGQPSVDCVANCPQSLLSGMNLFLSHLTITFRRDPTNYRPRINKLNSTKDREQKLAGSYYYLDD

SEQ ID NO: 19228 - protein, 605 aa, Echinacea purpurea
MADRLTRIAILKEDRCKPKKCRQECKKSCPVVKTGKLCIEVTSQSKVAYISEELCIGCGICIKKCPFDAIEIINLPKDLDKDTTHRYGVNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDVKAELCADLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLEGFVPTENLRFRDESLTFKVAETPQESAEEIETYARYKYPTMSKTQGGFKLKVVEGEFTDSQIVVMLGENGTGKTTFIRMLAGLLKPDTVEDSETEIPEFNVSYKPQKISPKFQNTVRLLLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGKPSIDCVANSPQSLLTGMNLFLSHLNITFRRDPTNFRPRINKLNSTKDREQKLAGSYYYLDD

SEQ ID NO: 19229 - protein, 605 aa, Vitis vinifera
MADRLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDMKEELCFDLDLNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFREESLTFKVAETPQESAEEIETYARYKYPTMTKTQGNFKLRVVEGEFTDSQIIVMLGENGTGKTTFIRMLAGLLKPDSVEDSDVEIPEFNVSYKPQKISPKFQSTVRHLLHQKIRDSYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGQPSVDCTANTPQSLLTGMNLFLSHLDITFRRDPTNFRPRINKLESTKDREQKSAGSYYYLDD

SEQ ID NO: 19230 - protein, 605 aa, Phalaenopsis aphrodite
MADRLTRIAIVSSDRCKPKKCRQECKKSCPVVKTGKLCIEVISSSRIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDEKDKKVELCNDLELNQVIDRNVGDLSGGELQRFAIAVVAVQNAEIYMFDEPSSYLDVRQRLKAAQVVRSLLRPNSYVIVVEHDLSVLDYLSDFICCLYGKPGAYGVVTLPFSVREGINIFLAGFVPTENLRFRDESLTFKVAETPQESAEEIQTYQRYRYPTMIKLQGNFKLCVMEGEFTDSQIIVMLGENGTGKTTFIRMLAGLLKPDSVEGSDVEIPEFNVSYKPQKISPKFQSTVRHLLHQKIRDSYMHPQFVSDVMKPLQIEQLMDQEVINLSGGELQRVALCLCLGKPADIYLIDEPSAYLDSEQRIVASKVIKRFILHAKKTAFVVEHDFIMATYLADKVIVYEGKPSVDCTANTPQTLVSGMNRFLSHLDITFRRDPTNYRPRINKLDSTKDREQKSAGSYYYLDD

SEQ ID NO: 19231 - protein, 605 aa, Tripterygium wilfordii
MADRLTRIAIVSSDRCKPKKCRQECKKSCPVVKTGKLCIEVTSASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDVKAELCADLELNQVIDRNVGDLSGGELQRFAIAVVAIQNAEIYMFDEPSSYLDVKQRLKAARVVRSLLRPNSYVIVVEHDLSVLDYLSDFICCLYGKPGAYGVVTLPFSVREGINIFLAGFVPTENLRFRDESLTFKVAETPQESAEEIETYARYKYPTMAKTQGNFKLRVIEGEFTDSQIVVMLGENGTGKTTFIRMLAGLLKPDTVEGTDVEIPEFNVSYKPQKISPRFQSTVRHLLHQKIRDSYTHPQFMSDVMKPLLIEQLMDQEVVNLSGGELQRVALCLCLGKPADIYLIDEPSAYLDSEQRIVASKVIKRFILHAKKTAFVVEHDFIMATYLADRVIVYEGKPSLDCVANSPQSLLTGMNLFLSHLDITFRRDPTNFRPRINKLESTKDREQKAAGSYYYLDD

SEQ ID NO: 19232 - protein, 604 aa, Brachypodium distachyon
MAAERLTRIAIVNEDRCKPKKCRQECKKSCPVVKTGRLCIEVSPASKVAFISEELCIGCGICVKKCPFDAIEIINLPKDLEKDTTHRYGPNTFKLHRLPVPRPGQVLGLVGTNGIGKSTALKVLAGKVKPNLGRFKNPPDWQEILTYFRGSELQNYFTRILEDNLKAIIKPQYVDHIPKAVQGNVGQVLDQKDERGMKAELCVDLELNQVIDRNVADLSGGELQRFAIAVVAVQSAEIYMFDEPSSYLDVKQRLKAARVIRSLLRTNSYVIVVEHDLSVLDYLSDFICCLYGKPGAYGVVTLPFSVREGINIFLAGFVPTENLRFRDESLTFKIVETQEAEEITSYQRYKYPTMSKTLADFKLTVMEGEFTDSQIIVMLGENGTGKTTFIRMLAGHLKPDTVEGTEIEIPEFNVSYKPQKLSPKFQGSVRQLLHKKIRDSYTHPQFTSDVMKPLQIEQLMDQEVMNLSGGELQRVALCLCLGKPADIYLIDEPSAYLDSEQRIVASKVIKRFILHAKKTAFIVEHDFIMATYLADKVVVYEGRPSVDCTANAPESLVSGMNKFLSHLDITFRRDPTNYRPRINKLESTKDREQKSVGSYYYLDD

SEQ ID NO: 19233 - protein, 606 aa, Catharanthus roseus
MADQRLTRIAIVSSDKCKPKKCRQECKKSCPVVKTGKLCIEVTPQSRIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDMKKELCVDLELNQVLDRGVGDLSGGELQRFAIAVVAIQNAEIFMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQETGEEIETYARYKYPTMTKTQGNFKLKVIEGEFTDSQIVVMLGENGTGKTTFIRMLAGLLKPDLVEGSDVEIPEFNVSYKPQKISPKFQSTVRHLLHQKIRDSYTHPQFMSDVMKPLQIEQLMDQEVVNLSGGELQRVALALCLGKPADIYLIDEPSAYLDSEQRIVASKVIKRFILHAKKTAFVVEHDFIMATYLADRVIVYEGRPSVDCVANAPQSLLTGMNLFLSHLDITFRRDPTNYRPRINKLDSTKDREQKSAGSYYYLDD

SEQ ID NO: 19234 - protein, 606 aa, Amborella trichopoda
MADQRLTRIAIVNSDRCKPKKCRQECKKSCPVVKTGKLCIEVSPASKIAYISEELCIGCGICVKKCPFDAIQIINLPKDLDKDTTHRYGPNTFKLHRLPVPRPGQVLGLVGTNGIGKSTALKVLAGKLKPNLGRYNNPPDWQEILTYFRGSELQNYFTRILEDNLKAIIKPQYVDHIPKAVQGNVGQVLDQKDEREMKAELCHDLELNQVIDRNVGDLSGGELQRFAIAVVAVQNAEIYMFDEPSSYLDVKQRLKAAQVVRSLLRPNSYVIVVEHDLSVLDYLSDFICCLYGKPGIYGVVTLPFSVREGINIFLAGFVPTENLRFRDEYLTFKVAENPQESAEEIQTYARYRYPTMSKTQGNFKLTVVEGEFTDSQIIVMLGENGTGKTTFIRMLAGLLKPDVIEGSDVEIPEFNVSYKPQKISPKFQHTVRHLLHQKIRDSYMHPQFMSDVMKPLQIEQLMDQEVINLSGGELQRVALCLCLGKPADIYLIDEPSAYLDSEQRIVASKVIKRFILHAKKTAFVVEHDFIMATYLADRVIVYEGKPSVDCTANAPQSLLTGMNLFLSHLDITFRRDPTNYRPRINKLDSTKDREQKSAGSYYYLDD

SEQ ID NO: 19235 - protein, 599 aa, Cucumis sativus
MADRLTRIAIVSSDRCKPKKCRQECKKSCPVVKTGKLCIEVTPAAKIAFISEELCIGCGICVKKCPFEAIQIINLPKDLDKDTTHRYGPNTFKLHRLPVPRPGQVLGLVGTNGIGKSTALKVLAGKLKPNLGRFNEILTYFRGSELQNYFTRILEDNLKAIIKPQYVDHIPKAVQGNVGQVLEQKDERDMKQELCHDLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQESAEEIETYARYKYPTMSKTQGNFKLRVIEGEFTDSQIIVMLGENGTGKTTFIRMLAGLLKPDSVEGSDIEIPEFNVSYKPQKISPKFQSTVRHLLHQKIRESYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGQPSVDCTANCPQSLLTGMNLFLSHLDITFRRDPTNYRPRINKVDSAKDREQKSAGSYYYLDD

SEQ ID NO: 19236 - protein, 605 aa, Flaveria ramosissima
MADRLTRIAILKEDRCKPKKCRQECKKSCPVVKTGKLCIEVTSQSKMAYISEELCIGCGICVKKCPFDAIEIINLPKDLDKDTTHRYGANTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLEQKNERDVKEELCADLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLEGYVPTENLRFRDESLTFKVAETPQESAEEIETYARYRYPTMSKTQGGFKLKVVEGEFTDSQIIVMLGENGTGKTTFIRMLAGLLKPDTVEGSESEIPEFNVSYKPQKISPKFPNSVRHLLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGTPSVDCVANAPQSLLTGMNLFLSHLTITFRRDPTNYRPRINKLNSTKDREQKLAGSYYYLDD

SEQ ID NO: 19237 - protein, 605 aa, Quercus alba
MSERLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDMKSELCADLQLNQVIDRNVGDLSGGELQRFAIAVVAVQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIETYARYKYPTMTKTQGNFRLRVVEGEFTDSQIIVMLGENGTGKTTFIRMLAGLLKPDSVEGSDVEIPEFNVSYKPQKISPKFPSTVRNLLHSKIRDSYMHAQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGRPSLDCIANSPQSLLTGMNLFLSHLDITFRRDPTNFRPRINKLESTKDREQKSAGSYYYLDD

SEQ ID NO: 19238 - protein, 606 aa, Allium cepa
MADRLTRIAIVSSDRCKPKKCRQECKKSCPVVKTGKLCIEVTSAAKLAYISEELCIGCGICVKKCPFEAIQIINLPKNLDKDTTHRYGPNTFKLHRLPVPRPGQVLGLVGTNGIGKSTALKVLAGKLKPNLGRFNNPPDWQEILTHFRGSELQNYFTRILEDNLKALIKPQYVDHIPKAVQGNVGQVLDQKDETDRKAELCVDLELNQVIERNVGDLSGGELQRFAIAVVAVQNAEIYMFDEPSSYLDVKQRLKAAKVIRSLLKSQSYVIVVEHDLSVLDYLSDFICCLYGKPGAYGVVTLPFSVREGINIFLAGFVPTENLRFREESLTFKVSETPQESAEEIETYQRYKYPGMSKTQGNFKLTVCEGEFTDSQIIVMLGENGTGKTTFIRMLAGLLKPDVVEGAADVEIPEFNVSYKPQKISPKFQSTVRHLLHQKIRESYMHPQFVSDVMKPLQIEQLMDQEVVNLSGGELQRVALCLCLGKPADIYLIDEPSAYLDSEQRIVASKVIKRFILHAKKTAFVVEHDFIMATYLADKVIVYEGKPSIDCIANAPQSLVSGMNLFLSHLDITFRRDPTNYRPRINKLESAKDREQKNAGSYYYLDD

SEQ ID NO: 19239 - protein, 605 aa, Helianthus annuus
MADRLTRIAILKEDRCKPKKCRQECKKSCPVVKTGKLCIEVTSQSKVAYISEELCIGCGICVKKCPFDAIEIINLPKDLDKDTTHRYGANTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDVKAELCVDLELNQVIDRNVGDLSGGELQRFAIAVVAIQNAEIYMFDEPSSYLDVKQRLKAAQVIRSLLRANSYVIVVEHDLSVLDYLSDFICCLYGKPGAYGVVTLPFSVREGINIFLEGYVPTENLRFRDESLTFKVAETPQESAEEIETYARYKYPTMSKTQGGFKLKVVEGEFTDSQIIVMLGENGTGKTTFIRMLAGILKPDTIEGSETEIPEFNVSYKPQKISPKFPHSVRHLLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGTPSIDCVANAPQSLLTGMNLFLSHLTITFRRDPTNYRPRINKLNSTKDREQKLAGSYYYLDD

SEQ ID NO: 19240 - protein, 606 aa, Ambrosia trifida
MADRLTRIAILKEDRCKPKKCRQECKKSCPVVKTGKLCIEVSSQSKVAYISEELCIGCGICVKKCPFDAIEIINLPKDLDKDTTHRYGANTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDVKAELCADLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLEGYVPTENLRFRDESLTFKVAETPQETAEEIETYARYKYPTMSKTQGGFKLKVVEGEFTDSQIVVMLGENGTGKTTFIRMLAGLLKPDTVEGGSETEIPEFNVSYKPQKISPKFPHSVRHLLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGKPSVDCVANAPQSLLTGMNLFLSHLTITFRRDPTNYRPRINKLNSTKDREQKLAGSYYYLDD

SEQ ID NO: 19241 - protein, 605 aa, Daucus carota
MSDRLTRIAIVSSDRCKPKKCRQECKKSCPVVKTGKLCIEVTSAAKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLEQKDERDMKEELCIDLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFREESLTFKVSETPQESAEEIETYARYKYPTMSKTQGGFKLKVTEGEFTDSQIIVMLGENGTGKTTFIRMLAGLLKPDTVEGSDIEIPEFNVSYKPQKISPKFQHSVRHLLHSKIRESYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGQPSIDCVANSPQSLLTGMNLFLSQLDITFRRDPTNFRPRINKLNSAKDREQKNAGSYYYLDD

SEQ ID NO: 19242 - protein, 605 aa, Cichorium intybus
MADRLTRIAILKEDRCKPKKCRQECKKSCPVVKTGKLCIEVTSASKMAYISEELCIGCGICVKKCPFDAIEIINLPKDLDKDTTHRYGVNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDVKAELCADLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLEGYVPTENLRFRDESLTFKVAETPQETAEEIETYARYRYPTMAKTQGGFKLKVVEGEFTDSQIIVMLGENGTGKTTFIRMLAGLLKPDTVEESDVEIPEFNVSYKPQKISPKFPHSVRHLLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGKPSVDCVANAPQSLLTGMNLFLSHLNITFRRDPTNYRPRINKLNSTKDREQKFAGSYYYLDD

SEQ ID NO: 19243 - protein, 605 aa, Cichorium intybus
MADRLTRIAILKEDRCKPKKCRQECKKSCPVVKTGKLCIEVTSASKMAYISEELCIGCGICVKKCPFDAIEIINLPKDLDKDTTHRYGVNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDVKAELCADLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLEGYVPTENLRFRDESLTFKVAETPQETAEEIETYARYRYPTMAKTQGGFKLKVVEGEFTDSQIIVMLGENGTGKTTFIRMLAGLLKPDTVEDSDVEIPEFNVSYKPQKISPKFPHSVRHLLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGKPSVDCVANAPQSLLTGMNLFLSHLNITFRRDPTNYRPRINKLNSTKDREQKFAGSYYYLDD

SEQ ID NO: 19244 - protein, 605 aa, Mimulus guttatus
MSEKLTRIAIVSSDKCKPKKCRQECKKSCPVVRTGKLCIEVTPLSKIAFISEELCIGCGICVKKCPFEAIQIINLPKDLEKDTTHRYGPNTFKLHRLPVPRPGQVLGLVGTNGIGKSTALKVLAGKLKPNLGKFKSPPDWQEILTNFRGSELQNYFTRILEDNLKAIIKPQYVDHIPKAVQGNVGQVLSQKDERDIKEEICFDLELNQVMDRNVGDLSGGELQRFAIAVVAVQNAEIYMFDEPSSYLDVRQRLKAAQVIRSLLRPTSYVIVVEHDLSVLDYLSDFICCLYGKPGVYGVVTLPFSVREGINIFLAGFVPTENLRFRDESLTFKVAETPQESAEEIETYARYRYPTMTKTQGNFKLKVMEGEFTDSQIVVMLGENGTGKTTFIRMLAGLLKPDSVEGSDIEIPEFNVSYKPQKISPKFQHTVRMLLHQKIRDSYMHPQFVSDVMKPLLIEQLMDQEVVNLSGGELQRVALTLCLGKPADIYLIDEPSAYLDSEQRIVASKVIKRFILHAKKTAFIVEHDFIMATYLADRVIVYEGKPSIDCTANAPQSLLTGMNLFLSHLDITFRRDPTNFRPRINKLDSTKDREQKNAGSYYYLDD

SEQ ID NO: 19245 - protein, 605 aa, Petroselinum crispum
MSDRLTRIAIVSSDRCKPKKCRQECKKSCPVVKTGKLCIEVTSAAKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLEQKDERDMKEVLCRDLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFREESLTFKVSETPQESAEEIETYARYKYPTMSKTQGGFKLKVTEGEFTDSQIIVMLGENGTGKTTFIRMLAGLLKPDTVEGSDIEIPEFNVSYKPQKISPKFQHSVRHLLHSKIRESYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGQPSIDCVANSPQSLLTGMNLFLSQLDITFRRDPTNFRPRINKLNSAKDREQKSAGSYYYLDD

SEQ ID NO: 19246 - protein, 605 aa, Cycas rumphii
MTDRLTRIAIVSSDRCKPKKCRQECKKSCPVVKTGKLCIEVSSASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLSQKDEREMKSELCNDLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIQTYARYRYPTMSKTQGNFKLNVNEGEFTDSQIVVMLGENGTGKTTFIRMLAGLLKPDTVEDSEVEIPEFNVSYKPQKISPKFQSTVRHLLHQKIRDSYTHPQFTSDVMKPLQIEQLMDQEVINLSGGELQRVALCLCLGKPADIYLIDEPSAYLDSEQRIVAAKVIKRFILHAKKTAFVVEHDFIMATYLADRVIVYEGKPSVECIANAPQSLQTGMNLFLSHLDITFRRDPTNYRPRINKLDSTKDREQKNAGSYYYLDD

SEQ ID NO: 19247 - protein, 605 aa, Ambrosia trifida
MADRLTRIAILKEDRCKPKKCRQECKKSCPVVKTGKLCIEVTSQSKVAYISEELCIGCGICVKKCPFDAIEIINLPKDLDKDTTHRYGANTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLEQKDERDVKAELCVDLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLEGYVPTENLRFRDESLTFKVAETPQESAEEVETYARYRYPTMTKTQGGFKLKVAEGEFTDSQIIVMLGENGTGKTTFIRMLAGIQKPDTVEGSETEIPEFNVSYKPQKISPKFPNSVRHLLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGKPSVDCVANAPQSLLTGMNLFLSHLTITFRRDPTNYRPRINKLNSTKDREQKLAGSYYYLDD

SEQ ID NO: 19248 - protein, 606 aa, Amsonia hubrichtii
MADQRLTRIAIVSSDKCKPKKCRQECKKSCPVVKTGKLCIEVTPQSRIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDEREMKEELCFDLELNQVLDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIETYARYKYPTMTKTQGGFKLKVMEGEFTDSQIVVMLGENGTGKTTFIRMLAGLLKPDLVEGSNVEIPEFNVSYKPQKISPKFQSTVRHLLHQKIRDSYTHPQFMSDVMKPLQIEQLMDQEVVNLSGGELQRVALALCLGKPADIYLIDEPSAYLDSEQRIVAAKVIKRFILHAKKTAFVVEHDFIMATYLADRVIVYEGRPSVDCVANAPQSLLTGMNLFLSHLDITFRRDPTNYRPRINKLESTKDREQKSAGSYYYLDD

SEQ ID NO: 19249 - protein, 605 aa, Malus domestica
MADRLTRIAIVSSDRCKPKKCRQECKKSCPVVKTGKLCIEVTPAAKIAFISEELCIGCGICVKKCPFEAIQIINLPKDLNKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGEVLNQKDERDMKEELCADLELNQVIERNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIETYARYRYPSMSKTQGNFRLRVVEGEFTDSQIIVMLGENGTGKTTFIRMLAGLLKPDIVENSDVEIPEFNVSYKPQKISPKFQSTVRHLLHSKIRDSYTHPQFMSDVMKPLLIEQLMDQEVVNLSGGELQRVALCLCLGKPADIYLIDEPSAYLDSEQRIVASKVIKRFILHAKKTAFVVEHDFIMATYLADRVIVYEGKPSIDCTANCPQSLLTGMNLFLSHLDITFRRDPTNYRPRINKLESTKDREQKAAGSYYYLDD

SEQ ID NO: 19250 - protein, 605 aa, Cannabis sativa
MSDRLTRIAIVSSDRCKPKKCRQECKKSCPVVKTGKLCIEVTTASKIAFISEELCIGCGICVKKCPFEAIQIINLPKDLDKDTTHRYGPNTFKLHRLPVPRPGQVLGLVGTNGIGKSTALKVLAGKLKPNLGRFTNPPDWQEILTYFRGSELQNYFTRILEDNLKAIIKPQYVDHIPKAVQGNVGQVLDQKDERDRKAELCKDLDLNQVIDRNVGDLSGGELQRFAIAVVAIQRAEIYMFDEPSSYLDVKQRLKAAQVIRSLLRADSYVIVVEHDLSVLDYLSDFICCLYGKPGAYGVVTLPFSVREGINIFLAGFVPTENLRFRDESLTFKVAETPQESAEEIETYARYKYPTMTKTQGNFRLHVMEGEFTDSQIVVMLGENGTGKTTFIRMLAGLLKPDVIGDTDVEIPEFNVSYKPQKISPKFQSTVRHLLHQKIRDSYTHPQFMSDVMKPLLIEQLMDQEVVNLSGGELQRVALCLCLGKPADIYLIDEPSAYLDSEQRIVASKVIKRFILHAKKTAFVVEHDFIMATYLADRVIVYEGNPSIDCTANAPQSLLTGMNLFLSHLDITFRRDPTNFRPRINKLDSTKDREQKHAGSYYYLDD

SEQ ID NO: 19251 - protein, 606 aa, Cajanus cajan
MADRLTRIAIVSNDRCKPKKCRQECKKSCPVVRTGRLCIEVTSASKIAFISEELCIGCGICVKKCPFEAIQIINLPKDLDKDTTHRYGPNTFKLHRLPVPRPGQVLGLVGTNGIGKSTALKVLAGKLKPNLGRFTNPPDWQEILTYFRGSELQNYFTRILEDDLKAIIKPQYVDHIPKAVQGNVGQVLDQKDERDMKQELCADLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDDSLTFKVAETPQESAEEAQTYARYKYPTMTKTQGNFKLRVVEGEFTDSQIVVMLGENGTGKTTFIRMLAGLLKPDSVEGGSDAEMPEFNVSYKPQKISPKFQSTVRHLLHQKIRDAYTHPQFVSDVMKPLLIEQLMDQEVVNLSGGELQRVALCLCLGKPADIYLIDEPSAYLDSEQRIHAAKVIKRFILHAKKTAFVVEHDFIMATYLADRVIVYEGQPSIDCIANAPQSLLTGMNLFLSHLDITFRRDPTNFRPRINKLDSTKDREQKSAGSYYYLDD

SEQ ID NO: 19252 - protein, 604 aa, Aquilegia formosa
MSDRLTRIAIVSSDRCKPKKCRQECKKSCPVVKTGKLCIEVSPAAKIAYISEELCIGCGICVKKCPFEAIQIINLPKDLDKDTTHRYGANTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLDQKDERDMKAELCKDLDLNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFREESLTFKVAETPQESAEEIQTYARYRYPTMTKTQGNFRLRVSEGEFTDSQIIVMLGENGTGKTTFIRMLAGLLKPDLVEGDAEIPEFNVSYKPQKISPKFQSTVRHLLHQKIRDMYMHPQFMSDVMKPLQIEQLMDQEVVNLSGGELQRVALCLCLGKPADIYLIDEPSAYLDSEQRIVASKVIKRFILHAKKTAFVVEHDFIMATYLADRVIVYEGNPSIDCTANAPQSLLTGMNLFLSHLDITFRRDPTNYRPRINKLESTKDREQKNAGSYYYLDD

SEQ ID NO: 19253 - protein, 605 aa, Citrus clementina
MSDRLTRIAIVSSDRCKPKKCRQECKKSCPVVKTGKLCIEVTPAAKIAFISEELCIGCGICVKKCPFEAIQIINLPKDLDKDTTHRYGPNTFKLHRLPVPRPGQVLGLVGTNGIGKSTALKILAGKLKPNLGRFNNPPDWQEILTYFRGSELQNYFTRILEDNLKAIIKPQYVDHIPKAVQGNVGQVLDQKDERDMKADLCADLDLNQVIDRNVGDLSGGELQRFAIAVVAVQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFRVAETPQESAEEIETYARYKYPTMVKTQGNFKLKVVEGEFTDSQIIVMLGENGTGKTTFIRMLAGLLKPDSVEDSDVEIPEFNVSYKPQKISPKFQSTVRHLLHQKIRDSYTHPQFVSDVMKPLLIEQLMDQEVVNLSGGELQRVALCLCLGKPADIYLIDEPSAYLDSEQRIVAAKVIKRFILHAKKTAFVVEHDFIMATYLADRVIVYEGQPSVDCVANAPQSLLTGMNLFLSHLDITFRRDPTNFRPRINKLDSTKDRDQKAAGSYYYLDD

SEQ ID NO: 19254 - protein, 605 aa, Eucalyptus grandis
MADRLTRIAIVSSDRCKPKKCRQECKKSCPVVKTGKLCIEVTTQSRIAFISEELCIGCGICVKKCPFEAIQIINLPKDLDKDTTHRYGPNTFKLHRLPVPRPGQVLGLVGTNGIGKSTALKILAGKLKPNLGRFDNPPDWQEILTYFRGSELQNYFTRILEDNLKAIIKPQYVDHIPKAVQGNVGQVLEQKDERDMKEELCVDLELNQVKDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQEVTEDVETYARYKYPTMTKTQGNFRLKVVEGEFTDSQIIVMLGENGTGKTTFIRMLAGLLKPDIVEGDDVEIPEFNVSYKPQKISPKFPASVRHLLHQKIRDSYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGRPSVDCIANSPQSLLTGMNLFLSHLDITFRRDPTNYRPRINKVDSTKDREQKSAGSYYYLDD

SEQ ID NO: 19255 - protein, 604 aa, Gnetum gnemon
MADRLTRIAIVSSDRCKPKKCRQECKKSCPVVKTGKLCIEVTSASKLAFISEELCIGCGICVKKCPFEAIQIINLPKDLDKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLSQKDEREMKAELCSDLDLNQVIDRNVGDLSGGELQRFAIAVVAIQNAEIYMFDEPSSYLDVRQRLKAAQVIRSLLRPNSYVIVVEHDLSVLDYLSDFICCLYGKPGAYGVVTLPFSVREGINIFLAGFVPTENLRFRDESLTFKVAETQESAEEIKSYARYRFPSMSKTQGSFKLHVKEGEFTDSQIIVMLGENGTGKTTFIRMLAGLLKPDTVENSEVEIPEFNVSYKPQKISPKFQSTVRHLLHQKIRDSYTHPQFMTDVMKPLQIEQLMDQEVINLSGGELQRVALALCLGKPADIYLIDEPSAYLDSEQRIVAAKVIKRFILHAKKTAFVVEHDFIMATYLADRVIVYEGQPSVECTANTPQSLQSGMNLFLSHLDITFRRDPTNYRPRINKLDSTKDREQKNAGSYYYLDD

SEQ ID NO: 19256 - protein, 606 aa, Allium cepa
MADRLTRIAIVSGDRCKPKKCRQECKKSCPVVKTGKLCIEVTSAAKVAYISEELCIGCGICVKKCPFEAIQIINLPKNLDKDTTHRYGPNTFKLHRLPSPRPGQVLGLVGTNGIGKSTALKVLAGKLKPNLGRFNNPPDWQEILTHFRGSELQNYFTRILEDNLKALIKPQYVDHIPKAVQGNVGQVLDQKDETERKAELCVDLELNQVIERNVGDLSGGELQRFAIAVVAVQNAEIYMFDEPSSYLDVKQRLKAAKVIRSLLRSQSYVIVVEHDLSVLDYLSDFICCLYGKPGAYGVVTLPFSVREGINIFLAGFVPTENLRFREESLTFKVSETPQESAEEVETYQRYKYPSMSKTQGNFKLTVCEGEFTDSQIIVMLGENGTGKTTFIRMLAGLLKPDVVEGAADVEIPEFNVSYKPQKISPKFQSTVRHLLHQKIRESYMHPQFVSDVMKPLQIEQLMDQEVVNLSGGELQRVALCLCLGKPADIYLIDEPSAYLDSEQRIVASKVIKRFILHAKKTAFVVEHDFIMATYLADKVIVYEGKPSIDCIANAPQSLVSGMNLFLSHLDITFRRDPTNYRPRINKLESAKDREQKNAGSYYYLDD

SEQ ID NO: 19257 - protein, 605 aa, Citrus sinensis
MSDRLTRIAIVSSDRCKPKKCRQECKKSCPVVKTGKLCIEVTPAAKIAFISEELCIGCGICVKKCPFEAIQIINLPKDLDKDTTHRYGPNTFKLHRLPVPRPGQVLGLVGTNGIGKSTALKILAGKLKPNLGRFNNPPDWQEILTYFRGSELQNYFTRILEDNLKAIIKPQYVDHIPKAVQGNVGQVLDQKDERDMKADLCTDLDLNQVIDRNVGDLSGGELQRFAIAVVAVQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFRVAETPQESAEEIETYARYKYPTMVKTQGNFKLKVVEGEFTDSQIIVMLGENGTGKTTFIRMLAGLLKPDSVEDSDVEIPEFNVSYKPQKISPKFQSTVRHLLHQKIRDSYTHPQFVSDVMKPLLIEQLMDQEVVNLSGGELQRVALCLCLGKPADIYLIDEPSAYLDSEQRIVAAKVIKRFILHAKKTAFVVEHDFIMATYLADRVIVYEGQPSVDCVANAPQSLLTGMNLFLSHLDITFRRDPTNFRPRINKLDSTKDRDQKAAGSYYYLDD

SEQ ID NO: 19258 - protein, 605 aa, Populus trichocarpa
MSDRLTRIAIVTSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPRAVQGNVGQVLDQKDERDKKAELCRDLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLSGFVPTENLRFRDESLTFKVAETPQENAEEIQTYARYKYPTMSKTQGNFKLRVVEGEFTDSQIVVMLGENGTGKTTFIRMLAGLLKPDTVEGSEAEIPEFNVSYKPQKISPKFQFSVRQLLHSKIRDSYMHPQFVSDVMKPLLIEQLMDQEVVNLSGGELQRVALCLCLGKPADIYLIDEPSAYLDSEQRIVASKVIKRFILHAKKTAFVVEHDFIMASYLADRVIVYEGQPSVDCTANSPQSLLTGMNLFLSHLDITFRRDPSNYRPRINKLESTKDREQKAAGSYYYLDD

SEQ ID NO: 19259 - protein, 605 aa, Solanum lycopersicum
MSDRLTRIAIVSDDKCKPKKCRQECKKSCPVVKTGKLCIEVTVGSKIAFISEELCIGCGICVKKCPFEAIQIINLPKDLDKDTTHRYGPNTFKLHRLPVPRPGQVLGLVGTNGIGKSTALKVLAGKLKPNLGRFTNPPDWQEILTHFRGSELQNYFTRILEDNLKAIIKPQYVDHIPKAVQGNVGQVLDQKDERDVKEKLCVDLELNQVLDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQEAAEEIESYARYRYPTMTKTQGNFKLKVSEGEFTDSQIVVMLGENGTGKTTFIRMLAGLLKPDVVEGSDIEMPEFNVSYKPQKISPKFQSTVRHLLHQKIRDSYQHPQFCSDVMKPLQIEQLMDQEVVNLSGGELQRVALALCLGKPADIYLIDEPSAYLDSEQRIVASKVIKRFILHAKKTAFVVEHDFIMATYLADRVIVYEGTPSIDCVANAPQSLLTGMNLFLSHLNITFRRDPTNYRPRINKLESTKDREQKSAGSYYYLDD

SEQ ID NO: 19260 - protein, 606 aa, Vinca minor
MSDQRLTRIAIVSSDKCKPKKCRQECKKSCPVVKTGRLCIEVTTLSKIAFISEELCIGCGICVKKCPFEAIQIINLPKDLDKDTTHRYGPNTFKLHRLPVPRPGQVLGLVGTNGIGKSTALKVLAGKLKPNLGRFSNPPDWQEILTHFRGSELQNYFTRILEDNLKAIIKPQYVDHIPKAVQGNVGQVLDQKDERDMKQELCVDLELNQVLDRAVGDLSGGELQRFAIAVVAIQNAEIYMFDEPSSYLDVRQRLKAAQVVRSLLRPNSYVIVVEHDLSVLDYLSDFICCLYGKPGAYGVVTLPFSVREGINIFLAGFVPTENLRFRDESLTFKVAETPQESAEEVETYARYKYPTMTKTQGNFKLKVMEGEFTDSQIVVMLGENGTGKTTFIRMLAGLLKPDSVEDSDVEIPEFNVSYKPQKISPKFQSTVRHLLHQKIRDSYTHPQFNSDVMKPLQIEQLMDQEVVNLSGGELQRVALTLCLGKPADIYLIDEPSAYLDSEQRIVASKVIKRFILHAKKTAFVVEHDFIMATYLADRVIVYEGKPSIDCVANAPQSLLTGMNLFLSHLDITFRRDPTNYRPRINKLESTKDREQKSAGSYYYLDD

SEQ ID NO: 19261 - protein, 606 aa, Vinca minor
MADQRLTRIAIVSSDKCKPKKCRQECKKSCPVVKTGKLCIEVTPLAKIAFISEELCIGCGICVKKCPFEAIQIINLPKDLNKDTTHRYGPNTFKLHRLPVPRPGQVLGLVGTNGIGKSTALKVLAGKLKPNLGRFNNPPDWQEILTHFRGSELQNYFTRILEDNLKAIIKPQYVDHIPKAVQGNVGQVLDQKDERDMKQELCVDLELNKVLDRAVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFRVAETPQESAEEVETYARYKYPTMTKTQGNFKLKVMEGEFTDSQIVVMLGENGTGKTTFIRMLAGLLKPDSVEDSDVEIPEFNVSYKPQKISPKFQSTVRHLLHQKIRDSYTHPQFNSDVMKPLQIEQLMDQEVVNLSGGELQRVALTLCLGKPADIYLIDEPSAYLDSEQRIVASKVIKRFILHAKKTAFVVEHDFIMATYLADRVIVYEGMPSIDCVANAPQSLLTGMNLFLSHLDITFRRDPTNYRPRINKLESTKDREQKSAGSYYYLDD

SEQ ID NO: 19262 - protein, 604 aa, Cyclamen graecum
MSDRLTRIAIVSSDRCKPKKCRQECKKSCPVVKTGKLCIEVTPATKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVVGNVGQVLDQKDERDLKESLCVDLDLNQVLDRNVGDLSGGELQRFAIAVVAIQNAEIFMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQESAEEIETYARYKYPTMCKTMGNFKIRVVEGEFTDSQIVVMLGENGTGKTTFIRMLAGLLKPDTVEGSDMDIPEYNVSYKPQKISPKFQSSVRHLLHQKIRDSYMHPQFVSDVMKPLMIEQLMDQEVVNLSGGELQRVALCLCLGKPADIYLIDEPSAYLDSEQRIVASKVIKRFILHAKKTAFVVEHDFIMATYLADRVIVYEGRPSVDCTANAPQSLLTGMNLFLSHLDITFRRDPTNFRPRINKLESTKDREQKNAGSYYYLD

SEQ ID NO: 19263 - protein, 605 aa, Amorphophallus konjac
MADRLTRIAIVSSDRCKPKKCRQECKKSCPVVKTGKLCIEVSPASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKALIKPQYVDHIPKAVQGNVGQVLDQKDERGLKGMLCDDLELNQVIDRNVGDLSGGELQRFAIAVVAIQNAEIYMFDEPSSYLDVKQRLKAAQVVRSLLRPDSYVIVVEHDLSVLDYLSDFICCLYGKPGAYGVVTLPFSVREGINIFLAGFVPTENLRFRDESLTFKVAETPQESAEEVQTYARYRYPTMSKTQGNFKLSVMEGEFTDSQIIVMLGENGTGKTTFIRMLAGLLKPDVVEDSDTDIPEFNVSYKPQKISPKFEHTVRLLLHQKIRDSYMHPQFVSDVMKPLQIEQLMDQEVKNLSGGELQRVALCLCLGKPADIYLIDEPSAYLDSEQRIVASKVIKRFILHAKKTAFVVEHDFIMATYLADKVIVYEGKPSIDCIANAPQSLVSGMNRFLSHLDITFRRDPTNYRPRINKLESLKDREQKAAGSYYYLDD

SEQ ID NO: 19264 - protein, 605 aa, Arnica chamissonis
MADRLTRIAILKEDRCKPKKCRQECKKSCPVVKTGKLCIEVTSQSKMAYISEELCIGCGICVKKCPFDAIEIINLPKDLDKDTTHRYGANTFKLHRLPVPRPGQVLGLVGTNGIGKSTALKVLAGKSKPNLGRFNNPPDWQEILTYFRGSELQNYFTRILEDNLKAIIKPQYVDHIPKAVQGNVGQVLEQKDERDVKAQLCADLELNQVIDRNVGDLSGGELQRFAIAVVAIQNAEIYMFDEPSSYLDVKQRLKAAQVIRSLLRANSYVIVVEHDLSVLDYLSDFICCLYGKPGAYGVVTLPFSVREGINIFLEGFVPTENLRFREESLTFKVAETPQESAEEIETYARYKYPTMSKTQGGFKLKVVEGEFTDSQIIVMLGENGTGKTTFIRMLAGILKPDTVEGSESELPEFNISYKPQKISPKFPHSVRHLLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGTPSVDCVANAPQSLLTGMNLFLSHLNITFRRDPTNFRPRINKLNSTKDREQKFAGSYYYLDD

SEQ ID NO: 19265 - protein, 605 aa, Pinus taeda
MSDRLTRIAIVSSDRCKPKKCRQECKKSCPVVKTGKLCIEVSSASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDIKSELCTDLDLNQVMDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIKSYARYKYPNMCKTQGNFKLNVKEGEFTDSQIIVMLGENGTGKTTFIRMLAGLLKPDTVDNTDVEIPEFNVSYKPQKISPKFQSTVRHLLHQKIRDSYTHPQFTSDVMKPLQIEQLMDQDVVNLSGGELQRVALCLCLGKPADIYLIDEPSAYLDSEQRIVAAKVIKRFILHAKKTAFVVEHDFIMATYLADRVIVYEGRPSIDCVANTPQSLQTGMNLFLSQLDITFRRDPTNYRPRINKLDSTKDREQKNAGSYYYLDD

SEQ ID NO: 19266 - protein, 605 aa, Papaver somniferum
MSDRLTRIAIVSGDRCKPKKCRQECKKSCPVVKTGKLCIEVTVAAKIAYISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLEQKDERGVKEELCRDLELNQVIERNVGDLSGGELQRFAIAVVAIQNAEIYMFDEPSSYLDVRQRLKAAQVIRSLLRPNSYVIVVEHDLSVLDYLSDFICCLYGKPGAYGVVTLPFSVREGINIFLAGFVPTENLRFRDESLTFKVAETPQESAEEIQSYARYKYPTMSKTQGNFKLRVLEGEFTDSQIIVMLGENGTGKTTFIRMLAGLLKPDEVESSDAEIPEFNVSYKPQKISPKFQASVRALLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGQPSIDCTANAPQSLLTGMNLFLSQLDITFRRDPTNFRPRINKMNSTKDREQKNAGSYYYLDD

SEQ ID NO: 19267 - protein, 605 aa, Solanum phureja
MSDRLTRIAIVSADKCKPKKCRQECKKSCPVVKTGKLCIEVTVGSKIAFISEELCIGCGICVKKCPFEAIQIINLPKDLDKDTTHRYGPNTFKLHRLPVPRPGQVLGLVGTNGIGKSTALKVLAGKLKPNLGRFTNPPDWQEILTHFRGSELQNYFTRILEDNLKAIIKPQYVDHIPKAVQGNVGQVLDQKDERDVKEKLCFDLELNQVLDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQEAAEEIESYARYRYPTMTKTQGNFKLKVAEGEFTDSQIVVMLGENGTGKTTFIRMLAGLLKPDVVEGSDIDIPEFNVSYKPQKISPKFQSTVRHLLHQKIRDSYQHPQFCSDVMKPLQIEQLMDQEVVNLSGGELQRVALALCLGKPADIYLIDEPSAYLDSEQRIVASKVIKRFILHAKKTAFVVEHDFIMATYLADRVIVYEGTPSIDCNANAPQSLLTGMNLFLSHLNITFRRDPTNFRPRINKLESTKDREQKSAGSYYYLDD

SEQ ID NO: 19268 - protein, 605 aa, Abies balsamea
MSDRLTRIAIVSSDRCKPKKCRQECKKSCPVVKTGKLCIEVSSASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDIKAELCTDLDLNQVMDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAESPQESAEEIKSYARYKYPTMAKTQGNFKLNVKEGEFTDSQIIVMLGENGTGKTTFIRMLAGLLKPDTIDNSDVEIPEFNVSYKPQKISPKFQSSVRHLLHQKIRDSYTHPQFTSDVMKPLQIEQLMDQEVVNLSGGELQRVALCLCLGKPADIYLIDEPSAYLDSEQRIVAAKVIKRFILHAKKTAFVVEHDFIMATYLADRVIVYEGRPSIDCVANTPQSLQTGMNLFLSQLDITFRRDPTNYRPRINKLDSTKDREQKNAGSYYYLDD

SEQ ID NO: 19269 - protein, 606 aa, Nicotiana benthamiana
MSDQRLTRIAIVSADKCKPKKCRQECKKSCPVVKTGKLCIEVTPAAKIAFISEELCIGCGICVKKCPFEAIQIINLPKDLDKDTTHRYGPNTFKLHRLPVPRPGQVLGLVGTNGIGKSTALKVLAGKLKPNLGRFSNPPDWQEILTHFRGSELQNYFTRILEDNLKAIIKPQYVDHIPKAVQGNVGQVLDQKDERDVMSQLCVDLELNQVLDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFREESLTFKVAETPQEAAEEIETYARYRYPTMTKTQGNFKLKVAEGEFTDSQIVVMLGENGTGKTTFIRMLAGLLKPDVVEGSDTDIPEFNVSYKPQKISPKFPSTVRHLLHQKIRDSYMHPQFCSDVMKPLQIEQLMDQEVVNLSGGELQRVALALCLGKPADIYLIDEPSAYLDSEQRIVASKVIKRFILHAKKTAFIVEHDFIMATYLADRVIVYEGTPSIDCVANAPQSLLTGMNLFLSHLNITFRRDPTNFRPRINKLESTKDREQKSAGSYYYLDD

SEQ ID NO: 19270 - protein, 605 aa, Solanum tuberosum
MSDRLTRIAIVSADKCKPKKCRQECKKSCPVVKTGKLCIEVTVGSKIAFISEELCIGCGICVKKCPFEAIQIINLPKDLDKDTTHRYGPNTFKLHRLPVPRPGQVLGLVGTNGIGKSTALKVLAGKLKPNLGRFTNPPDWQEILTHFRGSELQNYFTRILEDNLKAIIKPQYVDHIPKAVQGNVGQVLDQKDERDVKEKLCVDLELNQVLDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVRERINIFLAGFVPTENLRFRDESLTFKVAETPQEAAEEIESYARYRYPTMTKTQGNFKLKVGEGEFTDSQIVEMLGENGTGKTTFIRMLAGLLKPDVVEGSDIDIPEFNVSYKPQKISPKFQSTVRHLLHQKIRDSYQHPQFCSDVMKPLQIEQLMDQEVVNLSGGELQRVALALCLGKPADIYLIDEPSAYLDSEQRIVASKVIKRFILHAKKTAFVVEHDFIMATYLADRVIVYEGTPSIDCVANAPQSLLTGMNLFLSHLNITFRRDPTNFRPRINKLESTKDREQKSAGSYYYLDD

SEQ ID NO: 19271 - protein, 605 aa, Pseudotsuga menziesii
MSDRLTRIAIVSSDRCKPKKCRQECKKSCPVVKTGKLCIEVSSASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDIKAELCTDLDLNQVMDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIKSYARYKYPTMSKTQGNFKLRVTEGEFTDSQIIVMLGENGTGKTTFIRMLAGLLKPDTIENADMEIPEFNVSYKPQKISPKFQSTVRHLLHQKIRDTYTHPQFISDVMKPLQIEQLMDQEVVNLSGGELQRVALCLCLGKPADIYLIDEPSAYLDSEQRIVAAKVIKRFILHAKKTAFVVEHDFIMATYLADRVIVYEGQPSVDCVANTPQSLQTGMNLFLSQLDITFRRDPTNYRPRINKLDSTKDRDQKNAGSYYYLDD

SEQ ID NO: 19272 - protein, 605 aa, Eutrema parvulum
MADRLTRIAIVSSDRCKPKKCRQECKKSCPVVKTGKLCIEVTVGSKLAFISEELCIGCGICVKKCPFEAIQIINLPRDLEKDTTHRYGPNTFKLHRLPVPRPGQVLGLVGTNGIGKSTALKILAGKLKPNLGRFTNPPDWQEILTHFRGSELQNYFTRILEDNLKAIIKPQYVDHIPKAVRGNVGEVLDQKDERDKKAELCADLELNQVIDRDVENLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIQSYARYKYPTMTKTQGNFRLKVTEGEFTDSQIIVMLGENGTGKTTFIRMLAGLLKPDDTEGSDIEIPEFNVSYKPQKISPKFQNSVRHLLHQKIRDSYMHPQFVSDVMKPLQIEQLMDQEVVNLSGGELQRVALALCLGKPADIYLIDEPSAYLDSEQRIVASKVIKRFILHAKKTAFVVEHDFIMATYLADRVIVYEGQPSIDCIANCPQSLLSGMNLFLSHLNITFRRDPTNFRPRINKLESTKDREQKSAGSYYYLDD

SEQ ID NO: 19273 - protein, 606 aa, Triphysaria pusilla
MSDQRLTRIAIVSSDKCKPKKCRQECKKSCPVVKTGKLCIEVTPLTKIAFISEELCIGCGICVKKCPFEAIQIINLPKDLDKDTTHRYGPNTFKLHRLPVPRPGQVLGLVGTNGIGKSTALKVLAGKLKPNLGRFTNPPDWQEILTYFRGSELQNYFTRILEDNLKAIIKPQYVDHIPKAVQGNVGQVLTQKDEREMKESLGVDLELNQVMDRNVGDLSGGELQRFAIAVVAIQNAEIYMFDEPSSYLDVKQRLKAARVIRSLLRPNSYVIVVEHDLSVLDYLSDFICCLYGKPGVYGVVTLPFSVREGINIFLAGFVPTENLRFRDESLTFKVAETPQESAEEIQSYARYKYPTMTKTQGNFRLRVAEGEFTDSQIVVMLGENGTGKTTFIRMLAGLLKPDSVEGSDVEIPEFNVSYKPQKISPKFQNTVRNLLHSKIRDSYMHPQFMSDVMKPLLIEQLMDQEVVNLSGGELQRVALTLCLGKPADIYLIDEPSAYLDSEQRIVASKVIKRFILHAKKTAFVVEHDFIMATYLADRVIVYEGRPSIDCTANSPQSLLTGMNLFLSHLDITFRRDPTNFRPRINKLDSTKDREQKNAGSYYYLDD

SEQ ID NO: 19274 - protein, 605 aa, Brassica napus
  Sequence also found in Organisms: Brassica oleracea
MADRLTRIAIVSSDRCKPKKCRQECKKSCPVVKTGKLCIEVTVGSKLAFISEELCIGCGICVKKCPFEAIQIINLPRDLEKDTTHRYGANTFKLHRLPVPRPGQVLGLVGTNGIGKSTALKILAGKLKPNLGRFTNPPDWQEILTHFRGSELQNYFTRILEDNLKAIIKPQYVDHIPKAVRGNVGEVLDQKDERDKKAELCADLELNQVIDRAVENLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIQSYARYKYPTMTKTQGNFRLKVTEGEFTDSQIIVMLGENGTGKTTFIRMLAGLLKPDETEESDIEIPEFNVSYKPQKISPKFQNSVRHLLHQKIRDSYMHPQFVSDVMKPLQIEQLMDQEVVNLSGGELQRVALALCLGKPADIYLIDEPSAYLDSEQRIVASKVIKRFILHAKKTAFIVEHDFIMATYLADRVIVYEGQPSIDCIANCPQSLLSGMNLFLSHLNITFRRDPTNFRPRINKLESTKDREQKSAGSYYYLDD

SEQ ID NO: 19275 - protein, 605 aa, Brassica oleracea
MADRLTRIAIVSSDRCKPKKCRQECKKSCPVVKTGKLCIEVTVGSKLAFISEELCIGCGICVKKCPFEAIQIINLPRDLEKDTTHRYGANTFKLHRLPVPRPGQVLGLVGTNGIGKSTALKILAGKLKPNLGRFTNPPDWQEILTHFRGSELQNYFTRILEDNLKAIIKPQYVDHIPKAVRGNVGEVLDQKDERDKKAELCADLELNQVIDRDVENLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIQSYARYKYPTMTKTQGNFRLKVTEGEFTDSQIIVMLGENGTGKTTFIRMLAGLLKPDETEESDIEIPEFNVSYKPQKISPKFQNSVRHLLHQKIRDSYMHPQFVSDVMKPLQIEQLMDQEVVNLSGGELQRVALALCLGKPADIYLIDEPSAYLDSEQRIVASKVIKRFILHAKKTAFIVEHDFIMATYLADRVIVYEGQPSIDCVANCPQSLLSGMNLFLSHLNITFRRDPTNFRPRINKLESTKDREQKSAGSYYYLDD

SEQ ID NO: 19276 - protein, 606 aa, Phaseolus vulgaris
MADRLTRIAIVSNDRCKPKKCRQECKKSCPVVRTGRLCIEVTSASKIAYISEELCIGCGICVKKCPFEAIQIINLPKDLDKDTTHRYGPNTFKLHRLPVPRPGQVLGLVGTNGIGKSTALKVLAGKLKPNLGRFTNPPDWQEILTYFRGSELQNYFTRILEDDLKAIIKPQYVDHIPKAVQGNVGQVLDQKDERDMKAELCADLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDDSLTFKVAETPQESAEEAQTYARYKYPTMTKTQGNFKLRVVEGEFTDSQIIVMLGENGTGKTTFIRMLAGLLKPDSIEGGSEAEMPEFNVSYKPQKISPKFQSTVRHLLHQKIRDAYTHPQFVSDVMKPLLIEQLMDQEVVNLSGGELQRVALCLCLGKPADIYLIDEPSAYLDSEQRIHAAKVIKRFILHAKKTAFVVEHDFIMATYLADRVIVYAGQPSIDCIANSPQSLLSGMNLFLSHLDITFRRDPTNFRPRINKLDSTKDREQKSAGSYYYLDD

SEQ ID NO: 19277 - protein, 605 aa, Sciadopitys verticillata
MADRLTRIAIVSSDRCKPKKCRQECKKSCPVVKTGKLCIEVSSASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLSQKDEREMKSELCTDLDLNQVIDRNVGDLSGGELQRFAIAVVAIQTAEIYMFDEPSSYLDVKQRLKAAQVVRSLLKPNSYVIVVEHDLSVLDYLSDFICCLYGKPGAYGVVTLPFSVREGINIFLAGFIPTENLRFRDESLTFKVAETPQESAEEIKSYARYRYPSMSKTQGNFKLSVKEGEFTDSQIVVMLGENGTGKTTFIRMLAGLLKPDIVENSEVEIPEFNVSYKPQKISPKFQSTVRHLLHQKIRDSYTHPQFNTDVMKPLQIEQLMDQEVVNLSGGELQRVALCLCLGKPADIYLIDEPSAYLDSEQRIVAAKVIKRFILHAKKTAFVVEHDFIMATYLADRVIVYEGQPSVDCIANAPQSLQTGMNLFLSHLDITFRRDPTNYRPRINKLDSTKDREQKNAGSYYYLDD

SEQ ID NO: 19278 - protein, 605 aa, Brassica rapa
MADRLTRIAIVSSDRCKPKKCRQECKKSCPVVKTGKLCIEVTVGSKLAFISEELCIGCGICVKKCPFEAIQIINLPRDLEKDTTHRYGANTFKLHRLPVPRPGQVLGLVGTNGIGKSTALKILAGKLKPNLGRFTNPPDWQEILTHFRGSELQNYFTRILEDNLKAIIKPQYVDHIPKAVRGNVGEVLDQKDERDKKAELCADLELNQVIDRAVENLSGGELQRFAIAVVAIQNAEIYMFDEPSSYLDVKQRLKAAQVVRSLLRPNSYVIVEEHDLSVLDYLSDFICCLYGKPGAYGVVTLPFSVREGINIFLAGFVPTENLRFRDESLTFKVAETPQESAEEIQSYARYKYPTMTKTQGNFRLKVTEGEFTDSQIIVMLGENGTGKTTFIRMLAGLLKPDETEESDIEIPEFNVSYKPQKISPKFQNSVRHLLHQKIRDSYMHPQFVSDVMKPLQIEQLMDQEVVNLSGGELQRVALALCLGKPADIYLIDEPSAYLDSEQRIVASKVIKRFILHAKKTAFIVEHDFIMATYLADRVIVYEGQPSIDCIANCPQSLLSGMNLFLSHLNITFRRDPTNFRPRINKLESTKDREQKSAGSYYYLDD

SEQ ID NO: 19279 - protein, 605 aa, Brassica napus
MADRLTRIAIVSSDRCKPKKCRQECKKSCPVVKTGKLCIEVTVGSKLAFISEELCIGCGICVKKCPFEAIQIINLPRDLEKDTTHRYGANTFKLHRLPVPRPGQVLGLVGTNGIGKSTALKILAGKLKPNLGRFTNPPDWQEILTHFRGSELQNYFTRILEDNLKAIIKPQYVDHIPKAVRGNVGEVLDQKDERDKKAELCADLELNQVIDRDVENLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFREESLTFKVAETPQESAEEIQSYARYKYPTMTKTQGNFRLKVTEGEFTDSQIIVMLGENGTGKTTFIRMLAGLLKPDETEESDIEIPEFNVSYKPQKISPKFQNSVRHLLHQKIRDSYMHPQFVSDVMKPLQIEQLMDQEVVNLSGGELQRVALALCLGKPADIYLIDEPSAYLDSEQRIVASKVIKRFILHAKKTAFIVEHDFIMATYLADRVIVYEGQPSIDCVANCPQSLLSGMNLFLSHLNITFRRDPTNFRPRINKLESTKDREQKSAGSYYYLDD

SEQ ID NO: 19280 - protein, 605 aa, Populus trichocarpa
MADRLTRIAIVTSDRCKPKKCRQECKKSCPVVKTGKLCIEVTPISKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPRAVQGNVGQVLDQKDESHRKAELCRDLDLNQVIDRNVGDLSGGELQRFAIAVVAIQNAEIYMFDEPSSYLDVKQRLKAAQVIRSLLRANSYVIVVEHDLSVLDYLSDFICCLYGKPGAYGVVTLPFSVREGINIFLSGFVPTENLRFRDESLTFKVAETPQDNAEEIQTYARYKYPTMSKTQGNFKLSVVEGEFTDSQIVVMLGENGTGKTTFIRMLAGLLKPDTIEDSESEIPEFNVSYKPQKISPKFQHSVRQLLHSKIRDSYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGQPSVDCTANSPQSLLTGMNLFLSHLDITFRRDPTNFRPRINKLDSTKDREQKTAGSYYYLDD

SEQ ID NO: 19281 - protein, 605 aa, Arabidopsis lyrata
MADRLTRIAIVSSDRCKPKKCRQECKKSCPVVKTGKLCIEVTVGSKLAFISEELCIGCGICVKKCPFEAIQIINLPRDLEKDTTHRYGPNTFKLHRLPVPRPGQVLGLVGTNGIGKSTALKILAGKLKPNLGRFTSPPDWQEILTHFRGSELQNYFTRILEDNLKAIIKPQYVDHIPRAVKGNVGEVLDQKDERDKKAELCADLELNQVIDRDVENLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIQSYARYKYPTMTKTQGNFRLRVSEGEFTDSQIIVMLGENGTGKTTFIRMLAGLLKPDDAEGEDREIPEFNVSYKPQKISPKFQNSVRHLLHQKIRDSYMHPQFMSDVMKPLQIEQLMDQEVVNLSGGELQRVALTLCLGKPADIYLIDEPSAYLDSEQRIVASKVIKRFILHAKKTAFVVEHDFIMATYLADRVIVYEGQPSIDCTANCPQSLLSGMNLFLSHLNITFRRDPTNFRPRINKLESTKDREQKSAGSYYYLDD

SEQ ID NO: 19282 - protein, 605 aa, Podocarpus macrophillus
MADRLTRIAIVSSDRCKPKKCRQECKKSCPVVKTGKLCIEVSSASKIAFISEELCIGCGICVKKCPFEAIQIINLPKDLEKDTTHRYGPNTFKLHRLPVPRPGQVLGLVGTNGIGKSTALKVLAGKLKPNLGRFNSPPDWQEILTYFRGSELQNYFTRILEDNLKAIIKPQYVDHIPKAVQGNVGQVLSQKDERDKKSELCSDLDLNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFIPTENLRFRDESLTFKVAETPQESAEEIKSYARYKYPSMTKNQGNFKLAVKEGEFTDSQIVVMLGENGTGKTTFIRMLAGLLKPDTVENSEVEIPEFNVSYKPQKISPKFQSSVRHLLHQRIRDSYTHPQFTTDVMKPLQIEQLMDQEVVNLSGGELQRVALCLCLGKPADIYLIDEPSAYLDSEQRIVAAKVIKRFILHAKKTAFVVEHDFIMATYLADRVIVYEGQASVDCVANAPQSLQTGMNLFLSHLDITFRRDPTNYRPRINKLDSTKDRDQKNAGSYYYLDD

SEQ ID NO: 19283 - protein, 605 aa, Valeriana officinalis
MSDRLTRIAIVSSDRCKPKKCRQECKKSCPVVRTGKLCIEVTSAAKIAYISEELCIGCGICVKKCPFEAIQIINLPKDLDKDTTHRYGANTFKLHRLPVPRPGQVLGLVGTNGIGKSTALKVLAGKLKPNLGRFNNPPDWQEILTYFRGSELQNYFTRILEDNLKAIIKPQYVDHIPKAVNGNVGEVLDQKDERGKKEELCHDLQLNQVIDRKVEQLSGGELQRFAIAVVAIQNAEIYMFDEPSSYLDVKQRLKAAQVIRSLLRPNSYVIVVEHDLSVLDYLSDFICCLYGRPGAYGVVTLPFSVREGINIFLAGFVPTENLRFRDESLTFKVAETPQESAEEIETYARYKYPTMTKTQGGFTLKVAEGEFTDSQIIVMLGENGTGKTTFIRMLAGLLKPDSVEDSDVEIPEFNVSYKPQKISPKFQNSVRHLLHQKIRDSYMHPQFVSDVMKPLLIEQLMDQEVVNLSGGELQRVALCLCLGKPADIYLIDEPSAYLDSEQRIVASKVIKRFILHAKKTAFIVEHDFIMATYLADRVIVYEGNPSIDCTANAPQSLLTGMNLFLSHLDITFRRDPTNFRPRINKLESTKDREQKNAGSYYYLDD

SEQ ID NO: 19284 - protein, 606 aa, Glycine max
MADRLTRIAIVSNDRCKPKKCRQECKKSCPVVRTGRLCIEVTSSSKIAFISEELCIGCGICVKKCPFEAIQIINLPKDLDRDTTHRYGPNTFKLHRLPVPRPGQVLGLVGTNGIGKSTALKVLAGKLKPNLGRFTNPPDWQEILTYFRGSELQNYFTRILEDDLKAIIKPQYVDHIPKAVQGNVGQVLDQKDEREKKEELCADLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDDSLTFKVAETPQETAEEAQTYARYKYPTMSKTQGNFRLRVAEGEFTDSQIIVMLGENGTGKTTFIRMLAGLLKPDTIEGGSEVEMPEFNVSYKPQKISPKFQSTVRHLLHQKIRDAYTHPQFVSDVMKPLLIEQLMDQEVVNLSGGELQRVALCLCLGKPADIYLIDEPSAYLDSEQRIIAAKVIKRFILHAKKTAFVVEHDFIMATYLADRVIVYEGQPSIDCIANTPQSLLSGMNLFLSHLDITFRRDPTNFRPRINKLDSTKDREQKSAGSYYYLDD

SEQ ID NO: 19285 - protein, 605 aa, Arabidopsis thaliana
MADRLTRIAIVSSDRCKPKKCRQECKKSCPVVKTGKLCIEVTVGSKLAFISEELCIGCGICVKKCPFEAIQIINLPRDLEKDTTHRYGANTFKLHRLPVPRPGQVLGLVGTNGIGKSTALKILAGKLKPNLGRFTSPPDWQEILTHFRGSELQNYFTRILEDNLKAIIKPQYVDHIPRAVKGNVGEVLDQKDERDKKAELCADLELNQVIDRDVENLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIQSYARYKYPTMTKTQGNFRLRVSEGEFTDSQIIVMLGENGTGKTTFIRMLAGLLKPDDTEGPDREIPEFNVSYKPQKISPKFQNSVRHLLHQKIRDSYMHPQFMSDVMKPLQIEQLMDQEVVNLSGGELQRVALTLCLGKPADIYLIDEPSAYLDSEQRIVASKVIKRFILHAKKTAFVVEHDFIMATYLADRVIVYEGQPSIDCTANCPQSLLSGMNLFLSHLNITFRRDPTNFRPRINKLESTKDREQKSAGSYYYLDD

SEQ ID NO: 19286 - protein, 605 aa, Brassica napus
  Sequence also found in Organisms: Brassica oleracea
MADRLTRIAIVSSDRCKPKKCRQECKKSCPVVKTGKLCIEVTVGSKVAFISEELCIGCGICVKKCPFEAIQIINLPRDLEKDTTHRYGPNTFKLHRLPVPRPGQVLGLVGTNGIGKSTALKILAGKLKPNLGRFTNPPDWQEILTHFRGSELQNYFTRILEDNLKAIIKPQYVDHIPKAVRGNVGEVLDQKDERNMKAELCADLELNQVIDRDVVNLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVSETPQESAEEIQSYARYKYPTMTKTQGNFRLKVSEGEFTDSQIIVMLGENGTGKTTFIRMLAGLLKPDETEGSDIEIPEFNVSYKPQKISPKFENSVRHLLHQKIRDSYMHPQFVSDVMKPLQIEQLMDQQVVNLSGGELQRVALALCLGKPADIYLIDEPSAYLDSEQRIVASKVIKRFILHAKKTAFVVEHDFIMATYLADRVIVYEGQPSIDCTANCPQSLLTGMNLFLSHLNITFRRDPTNFRPRINKLESTKDREQKSAGSYYYLDD

SEQ ID NO: 19287 - protein, 605 aa, Brassica napus
MADRLTRIAIVSADRCKPKKCRQECKKSCPVVKTGKLCIEVTVGSKVAFISEELCIGCGICVKKCPFEAIQIINLPRDLEKDTTHRYGPNTFKLHRLPVPRPGQVLGLVGTNGIGKSTALKILAGKLKPNLGRFTNPPDWQEILTHFRGSELQNYFTRILEDNLKAIIKPQYVDHIPKAVRGNVGEVLDQKDERNMKAELCADLELNQVIDRDVVNLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVSETPQESAEEIQSYARYKYPTMTKTQGNFRLKVSEGEFTDSQIIVMLGENGTGKTTFIRMLAGLLKPDETEGSDIEIPEFNVSYKPQKISPKFENSVRHLLHQKIRDSYMHPQFVSDVMKPLQIEQLMDQQVVNLSGGELQRVALALCLGKPADIYLIDEPSAYLDSEQRIVASKVIKRFILHAKKTAFVVEHDFIMATYLADRVIVYEGQPSIDCTANCPQSLLTGMNLFLSHLNITFRRDPTNFRPRINKLESTKDREQKSAGSYYYLDD

SEQ ID NO: 19288 - protein, 605 aa, Chrysanthemum coronarium
MADRLTRIAILREDRCKPKKCRQECKKSCPVVKTGKLCIEVSSASKVATISEELCIGCGICVKKCPFEAIDIINLPKDLEKDTTHRYGVNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERGAKAELCADLELNQVIDRNVGDLSGGELQRFAIAVVAIQMAEIYMFDEPSSYLDVKQRLKAAQVIRSLLRPNSYVIVVEHDLSVLDYLSDFICCLYGKPGAYGVVTLPFSVREGINIFLDGFVPTENLRFREVALTFRVSETTQESAEEIETYAQYRYPTMTKTQGGFKLKVVAGEFTDSQIVVMLGENGTGKTTFIRMLAGLLKPDTVEGTDVEIPEFNVSYKPQKISPKFPHSVRHLLHSKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGQPSVDCVANSPQSLLTGMNLFLSHLTITFRRDPGNYRPRINKLNSTKDREQKLAGSYYYLDD

SEQ ID NO: 19289 - protein, 604 aa, Distylium racemosum
MDRLTRIAIVSSDRCKPKKCRQECKKSCPVVKTGKLCIEVSSASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLSQKDERDVKAELCTDLDLNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFIPTENLRFRDESLTFKVAETPQESAEEIKSYARYRYPSMSKTQGGFKLHVKEGEFTDSQIVVMLGENGTGKTTFIRMLAGLLKPDTAENSEVDIPEFNVSYKPQKISPKFQSTVRHLLHQKIRDSYTHPQFNTDVMKPLQIEQLMDQEVINLSGGELQRVALCLCLGKPADIYLIDEPSAYLDSEQRIVASKVIKRFILHAKKTAFVVEHDFIMATYLADRVIVYEGQSSVECTANPPQSLQTGMNLFLSHLDITFRRDPTNYRPRINKLDSTKDREQKNAGSYYYLDD

SEQ ID NO: 19290 - protein, 606 aa, Eschscholzia californica
MSSDRLTRIAIVSSDRCKPKKCRQECKKSCPVVKTGKLCIEVSSLSKIAFISEELCIGCGICVKKCPFEAIQIINLPKDLDKDTTHRYGPNTFKLHRLAVPRPGQVLGLVGTNGIGKSTALKILAGKLKPNLGRFNNPPDWQEILTYFRGSELQNYFTRILEDNLKAIIKPQYVDHIPKAVQGNVGQVLDQKDERGVKAELCHDLELNQVIDRNVGDLSGGELQRFAIAVVAIQNADIFMFDEPSSYLDVRQRLKAAQVIRSLLRPNSYVIVVEHDLSVLDYLSDFICCLYGKPGAYGVVTLPFSVREGINIFLAGFVPTENLRFREESLTFKVAETPQESAEELQSYARYKYPTMSKTQGNFKLRVTEGEFTDSQIIVMLGENGTGKTTFIRMLAGLLKPDEVESSDAEIPEFNVSYKPQKISPKFQASVRHLLHQKIRDSYQHPQFISDVMKPLQIEQLMDQEVVNLSGGELQRVALALCLGKPADIYLIDEPSAYLDSEQRIVASKVIKRFILHAKKTAFVVEHDFIMATYLADRVIVYDGQPSIDCTANAPQSLLTGMNLFLSHLDITFRRDPTNYRPRINKLESTKDREQKSAGSYYYLDD

SEQ ID NO: 19291 - protein, 605 aa, Eutrema halophilum
MADRLTRIAIVSQDRCKPKKCRQECKKSCPVVKTGKLCIEVTVGSKIAFISEELCIGCGICVKKCPFEAIQIINLPRDLEKDTTHRYGPNTFKLHRLPVPRPGQVLGLVGTNGIGKSTALKILAGKLKPNLGRFTNPPDWQEILTHFRGSELQNYFTRILEDNLKAIIKPQYVDHIPKAVRGNVGEVLDQKDERNKKAELCADLELNQVIDRDVMNLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIQSYARYKYPSMTKTQGNFRLRVSEGEFTDSQIIVMLGENGTGKTTFIRMLAGLLKPDDTEGSDIEIPEFNVSYKPQKISPKFQHSVRQLLHQKIRDSYMHPQFVSDVMKPLQIEQLMDQEVVNLSGGELQRVALTLCLGKPADIYLIDEPSAYLDSEQRIVASKVIKRFILHAKKTAFVVEHDFIMATYLADRVIVYEGQPSIDCTANCPQSLLSGMNLFLSHLNITFRRDPTNFRPRINKLESTKDREQKSAGSYYYLDD

SEQ ID NO: 19292 - protein, 605 aa, Brassica rapa
MADRLTRIAIVSSDRCKPKKCRQECKKSCPVVKTGKLCIEVTVGSKLAFISEELCIGCGICVKKCPFEAIQIINLPRDLEKDTTHRYGVNTFKLHRLPVPRPGQVLGLVGTNGIGQSTALKILAGKLKPNLGRFTNPPDWQEILTHFRGSELQNYFTRILEDNLKAIIKPQYVDHIPKAVRGNVGEVLDQKDERDKKAELCADLELNQVIDRDVENLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFREESLTFKVAETPQESAEEIQSYARYKYPTMTKTQGNFRLKVTECEFTDSQIIVMLGENGTGKTTFIRMLAGLLKPDETEESDIEIPEFNVSYKPQKISPKFQNSVRHLLHQKIRDSYMHPQFVSDVMKPLQIEQLMDQEVVNLSGGELQRVALALCLGKPADIYLIDEPSAYLDSEQRIVASKAIKRFILHAKKTAFIVEHDFIMATYLADRVIVYEGQPSIDCVANCPQSLLSGMNLFLSHLNITFRRDPTNFRPRINKLESTKDREQKSAGSYYYLDD

SEQ ID NO: 19293 - protein, 605 aa, Chrysanthemum coronarium
MADRLTRIAILREDRCKPKKCRQECKKSCPVVKTGKLCIEVSSASKVATISEELCIGCGICVKKCPFEAIDIINLPKDLEKDTTHRYGVNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERGAKAELCADLELNQVIDRNVGDLSGGELQRFAIAVVAIQMAEIYMFDEPSSYLDVKQRLKAAQVIRSLLRPNSFVIVVEHDLSVLDYLSDFICCLYGKPGAYGVVTLPFSVREGINIFLDGFVPTENLRFREVALTFRVSETTQESAEEIETYAQYRYPTMTKTQGGFKLKVVAGEFTDSQIVVMLGENGTGKTTFIRMLAGLLKPDTVEGTDVEIPEFNVSYKPQKISPKFPHSVRHLLHSKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGQPSVDCVANSPQSLLTGMNLFLSHLTITFRRDPGNYRPRINKLNSTKDREQKLAGSYYYLDD

SEQ ID NO: 19294 - protein, 604 aa, Fragaria vesca
MSDRLTRIAIVSSDRCKPKKCRQECKKSCPVVKTGKLCIEVTTASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVHGNVGEVLNQKNERGVKEVLCHDLELNQVIDRNVGDLSGGELQRFAIAVVCIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQETAEEIETYARYKYPTMSKTQGNFRLRVMEGEFTDSQIIVMLGENGTGKTTFIRMLAGLLKPDESDSEVEIPEFNVSYKPQKISPKFQNTVRHLLHSKIRDSYTHPQFMSDVMKPLLIEQLMDQEVVNLSGGELQRVALCLCLGKPADIYLIDEPSAYLDSEQRIVASKVIKRFILHAKKTAFVVEHDFIMATYLADRVIVYEGKPSIDCTANCPQSLLTGMNLFLSHLDITFRRDPTNFRPRINKMNSTKDREQKNAGSYYYLDD

SEQ ID NO: 19295 - protein, 606 aa, Cicer arietinum
MSDRLTRIAIVSNDRCKPKKCRQECKKSCPVVRTGRLCIEVTSASKIAYISEELCIGCGICVKKCPFEAIQIINLPKDLDKDTTHRYGPNTFKLHRLPVPRPGQVLGLVGTNGIGKSTALKVLAGKLKPNLGRFTNPPDWQEILTYFRGSELQNYFTRILEDDLKAIIKPQYVDHIPKAVQGNVGQVLDQKNERDMKEELCADLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLSGFVPTENLRFREDSLTFKVAETPQESAEEAQTYARYKYPTMTKTQGNFRLHVVEGEFTDSQIIVMLGENGTGKTTFIRMLAGLLKPDTVEGGADVDMPEFNVSYKPQKISPKFQSTVRHLLHQKIRDAYTHPQFISDVMKPLLIEQLMDQEVVNLSGGELQRVALCLCLGKPADIYLIDEPSAYLDSEQRIIAAKVIKRFILHAKKTAFIVEHDFIMATYLADRVIVYEGKPSIDCIANSPQSLLTGMNLFLSHLDITFRRDPTNFRPRINKLDSTKDREQKNAGSYYYLDD

SEQ ID NO: 19296 - protein, 605 aa, Chrysanthemum coronarium
MADRLTRIAILNEDRCKPKKCRQECKKSCPVVKTGKLCIEVSSASKVAVISEELCIGCGICVKKCPFDAIDIINLPKDLEKDTTHRYGVNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLEQKNERDVKAELCAELELNQVIDRNVGDLSGGELQRFAIAVVAIQMAEIYMFDEPSSYLDVKQRLKAAQVIRSLLRPNSYVIVVEHDLSVLDYLSDFICCLYGKPGAYGVVTLPFSVREGINIFLEGFVPTENLRFRDERLTFRVAETAQETAEEIQTYAQYRYPTMSKTQGGFKLKAVEGEFTDSQIIVMLGENGTGKTTFIRMLAGLLKPDTVEGSEVEIPEFHVSYKPQKISPKFPHSVRHLLHSKIRDSYMHPQFVSDVMKPLQIEQLMDQEVVNLSGGELQRVALTLCLGKPADIYLIDEPSAYLDSEQRIIASKVIKRFILHAKKTAFVVEHDFIMATYLADRVIVYEGQPSVDCVANAPQSLLTGMNLFLSHLTITFRRDPGNYRPRINKLNSTKDREQKLAGSYYYLDD

SEQ ID NO: 19297 - protein, 605 aa, Picea glauca
MADRLTRIAIVSSDRCKPKKCRQECKKSCPVVRTGKLCIEVSSASKIAYISEELCIGCGICVKKCPFDAIQIINLPKDLEKDTTHRYGPNTFKLHRLPVPKPGQVLGLVGTNGIGKSTALKVLAGKLKPNLGRFNNPPDWQEILTHFRGSELQNYFTRILEDNLKAIIKPQYVDHIPKAVQGNVGQVLSQKDERDMKSKLCTDLELNQVIDRNVDELSGGELQRFAIAVVAVQHAEIYMFDEPSSYLDVRQRLKAALVIRSLLRPNSYVIVVEHDLSVLDYLSDFICCLYGKPGVYGVVTLPFSVREGINIFLAGFVPTENLRFREESLMFKVAEIPQESAEEIKSYARYKYPSMSKTQGNFKLHVEEGEFTDSQIVVMLGENGTGKTTFIRMLAGLLKPDTVENSEVEIPEFNVSYKPQKISPKFQNTVRILLHQKIRDSYTHPQFTSDVMKPLQIEQLLDQEVVNLSGGELQRVAICLCLGKPADIYLIDEPSAYLDSEQRIVAAKVIKRFILHAKKTAFVVEHDFIMATYLADRVIVYDGKPSVDCSAHAPQSLQTGMNLFLSHLDITFRRDPTNYRPRINKLDSTKDREQKNAGTYYYLDD

SEQ ID NO: 19298 - protein, 605 aa, Pinus taeda
MADRLTRIAIVSSDRCKPKKCRQECKKSCPVVRTGKLCIEVSSSSKIAFISEELCIGCGICVKKCPFDAIQIINLPKDLEKDTTHRYGPNTFKLHRLPVPKPGQVLGLVGTNGIGKSTALKVLAGKLKPNLGRFNNPPDWQEILTYFRGSELQNYFTRILEDNLKAIIKPQYVDHIPKAVQGNVGQVLSQKDERDMKSELCADLELNQVIDRNVDELSGGELQRFAIAVVAVQHAEIYMFDEPSSYLDVRQRLKAALVIRSLLRPNSYVIVVEHDLSVLDYLSDFICCLYGKPGVYGVVTLPFSVREGINIFLSGFVPTENLRFRDESLTFKVAEIPQESAEEIKSYARYKYPSMSKTQGNFKLDVEEGEFTDSQIVVMLGENGTGKTTFIRMLAGLLKPDTIENSEVEIPEFNVSYKPQKISPKFQHSVRTLLHQKIRDSYTHPQFTSDVMKPLQIEQLLDQEVVNLSGGELQRVAICLCLGKPADIYLIDEPSAYLDSEQRIVAAKVIKRFILHAKKTAFVVEHDFIMATYLADRVIVYDGKPSVECTAHAPQSLQTGMNLFLSHLDITFRRDPTNYRPRINKFDSTKDREQKNAGTYYYLDD

SEQ ID NO: 19299 - protein, 605 aa, Malus domestica
MTDRLTRIAIVSSDRCKPKKCRQECKRSCPVVITGKLCVEVTPASKIAFISEELCIGCGICVKKCPFEAIQIINLPKDLDKDTTHRYGPNTFKLHRLPVPRPGQVLGLVGTNGIGKSTALKVLGGKLKPNLGRFKNPPDWQEILTYFRGSELQNFFTRILEDNLKAIIKPQYVDHIPKAVQGNVGEVLSQKDERDMKEKLCADLELNQVIERKVGDLSGGELQRFAIAVVAIQHAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIETYARYKYPSMTKTQGNFRLRAVEGEFTDSQIIVMLGENGTGKTTFIRMLAGLLKPDSVEDSDVEIPEFNVSYKPQKISPKFPSTVRALLHSKIRDSYTHPQFMSDVMKPLLIEQLMDQEVLNLSGGELQRVALCLCLGKPADIYLIDEPSAYLDSEQRIVASKVIKRFILHAKKTAFIVEHDFIMATYLADRVIVYEGQASIDCTANAPQSLLTGMNLFLSHLDITFRRDPTNYRPRINKLESTKDREQKAAGSYYYLDD

SEQ ID NO: 19300 - protein, 605 aa, Prunus mume
MADRLTRIAIVSSDRCKPKKCRQECKKSCPVVMTGRLCIEVTPASKIAYISEELCIGCGICVKKCPFEAIQIINLPKDLDRDTTHRYGPNTFKLHRLPVPRPGQVLGLVGTNGIGKSTALKVLAGKLKPNLGRFNNPPDWQEILTHFRGSELQNYFTRILEDNLKAIIKPQYVDHIPKAVQGNVGEVLNQKDERDMKEKLCADLDLNQVIERNVGDLSGGELQRFAIAVVAIQNAEIYMFDEPSSYLDVKQRLKAAQVVRSLLRANSYVIVVEHDLSVLDYLSDFICCLYGKPGAYGVVTLPFSVREGINIFLAGFVPTENLRFRDESLTFKVAETPQESAEEIESYARYRYPSMTKTQGNFRIRVVEGEFTDSQIIVMLGENGTGKTTFIRMLAGLLKPDTVEDSDVEIPEFNVSYKPQKISPKFASTVRHLLHSKIRDSYTHPQFMSDVMKPLLIEQLMDQEVVNLSGGELQRVALCLCLGRPADIYLIDEPSAYLDSEQRIVASKVIKRFILHAKKTAFVVEHDFIMATYLADRVIVYEGKPSIDCTANAPQSLLTGMNLFLSHLDITFRRDPTNYRPRINKLESTKDREQKAAGSYYYLDD

SEQ ID NO: 19301 - protein, 605 aa, Silene vulgaris
MSDRLTRIAIVSSDRCKPKKCRQECKKSCPVVKTGKLCIEVTTLAKVAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDNIPKAVQGNVGQVLDQKDERDIKAEMLTDLELNKVLDRNVGDLSGGELQRFAIAVVAMQNAEIYMFDEPSSYLDVKQRLKAAQVVRSLLRPNSYVIVVEHDLSVLDYLSDFICCLYGKPGAYGVVTLPFSVREGINIFLSGFVPTENLRFRDESLTFKVAETPQDNAEEIETYARYKYPAMTKTQGGFRLRVSEGEFTDSQIVVMLGENGTGKTTFIRLLAGLLKPDNVGDSDVEVPEFNVSYKPQKISPKFQHSVRHLLHQKIRDSYMHPQFVSDVMKPLQIEQLMDQEVVNLSGGELQRVALALCLGKPADIYLIDEPSAYLDSEQRIVASKVIKRFILHAKKTAFIVEHDFIMATYLADRVIVYEGSPSVDCTANSPQSLLTGMNLFLSHLDITFRRDPTNYRPRINKLESTKDREQKSAGTYYYLDD

SEQ ID NO: 19302 - protein, 606 aa, Lupinus angustifolius
MSDRLTRIAIVSNDRCKPKKCRQECKKSCPVVRTGRLCIEVTQASKIAFISEELCIGCGICVKKCPFEAIQIINLPKDLDKDTTHRYGPNTFKLHRLPVPRPGQVLGLVGTNGIGKSTALKVLAGKLKPNLGRFTNPPDWQEILTYFRGSELQNYFTRILEDDLKAIIKPQYVDHIPKAVQGNVGQVLDQKDERDAKAELCADLDLNQVIDRNVGDLSGGELQRFAIAVVAIQHAEIYMFDEPSSYLDVKQRLKAAQVIRSLLRPNSYVIVVEHDLSVLDYLSDFICCLYGKPGAYGVVTLPFSVREGINIFLAGFVPTENLRFREESLTFKVAETPQETAEEAQSYSRYKYPTMTKTQGNFRLRVAEGEFTDSQIVVMLGENGTGKTTFIRMLAGLLKPDAIEGGSDVEMPEFNVSYKPQKISPKFQSTVRSLLHQKIRDAYTHPQFISDVMKPLLIEQLMDQEVVNLSGGELQRVALCLCLGKPADIYLIDEPSAYLDSEQRIHAAKVIKRFILHAKKTAFVVEHDFIMATYLADRVIVYEGQPSIDCTANSPQSLLSGMNLFLSHLNITFRRDPTNFRPRINKLDSTKDREQKNAGSYYYLDD

SEQ ID NO: 19303 - protein, 589 aa, Triticum aestivum
CKPKKCRQECKKSCPVVKTGKLCIEVGPASKVSFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRLLEDNLKAIIKPQYVDHIPKAVHGNVGQVLELKDERDMKAELCVDLELNQVIDRNVGDLSGGELQRFAIAVVAVQSAEIYMFDEPSSYLDVKQRLKAAQVIRSLLRSNSYVIVVEHDLSVLDYLSDFICCLYGKPGAYGVVTLPFSVREGINIFLAGFVPTENLRFRDESLTFKIVDTQDNAEEIETYQRYKYPTMSKTLANFKLTVMEGEFTDSQIVVMLGENGTGKTTFIRMLAGHLKPDTVDGVEIEIPEFNVSYKPQKISPKFPGSVRQLLHKKIRDSYTHPQFISDVMKPLQIEQLMDQEVLNLSGGELQRVALCLCLGQPAEIYLIDEPSAYLDSEQRIVASKVIKRFILHAKKTAFIVEHDFIMAAYLADKVVVYEGRPSVECTACTPQSLVSGMNRFLSHLDITFRRDPTNYRPRINKMDSTKDREQKAAGSYYYLDD

SEQ ID NO: 19304 - protein, 605 aa, Ceratodon purpureus
MSNRLTRIAIVSSDRCKPKKCRQECKKSCPVVKTGKLCIEVSSASKIAFISEELCIGCGICVKKCPFEAIQIINLPKDLDKDTTHRYGPNTFKLHRLPVPRPGQVLGLVGTNGIGKSTALKVLAGKLKPNLGRFLNPPDWQEILTYFRGSELQNYFTRILEDNLKAIIKPQYVDHIPKAVKGNVGEVLAQKDEREMRFVLAKDLDLNQVLDRDVGDLSGGELQRFAIAVVATQHAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEISTYARYKYPQMTKTQGGFKLAVKEGEFTDSQIIVMLGENGTGKTTFIRMLAGLLKPDEAGDANVEVPEFNVSYKPQKISPKFASTVRHLLHQKIRDSYMHPQFNSDVMKPLQIEALMDQEVVHLSGGELQRVALCLCLGKPADIYLIDEPSAYLDSEQRIVAAKVIKRFILHAKKTAFVVEHDFIMATYLADRVIVYEGRPSIDCVANTPQSLLTGMNLFLSHLDITFRRDPTNYRPRINKLDSTKDREQKNAGSYYYLDD

SEQ ID NO: 19305 - protein, 606 aa, Trifolium pratense
MSDRLTRIAIVSNDRCKPKKCRQECKKSCPVVRTGRLCIEVSSASKIAYISEELCIGCGICVKKCPFEAIQIINLPRDLDKDTTHRYGPNTFKLHRLPVPRPGQVLGLVGTNGIGKSTALKVLAGKLKPNLGRFTQPPDWQEILTHFRGSELQNYFTRILEDDLKAIIKPQYVDHIPKAVQGNVGQVLDQKNERDMKEELCADLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLSGFVPTENLRFREDSLTFKVAETPQETAEEAQSYARYKYPTMTKTQGNFRLRVVEGEFTDSQIVVMLGENGTGKTTFIRMLAGLLKPDTIEGGSDVEMPEFNISYKPQKISPKFQSTVRHLLHQKIRDSYTHPQFISDVMKPLLIEQLMDQEVVNLSGGELQRVALCLCLGKPADIYLIDEPSAYLDSEQRIIAAKVIKRFILHAKKTAFVVEHDFIMATYLADRVIVYEGQPSIDCTANCPQSLLTGMNLFLSHLDITFRRDPTNFRPRINKLDSTKDREQKHAGSYYYLDD

SEQ ID NO: 19306 - protein, 605 aa, Physcomitrella patens
MSNRLTRIAIVSSDRCKPKKCRQECKKSCPVVKTGKLCIEVTSQSKIAFISEELCIGCGICVKKCPFEAIQIINLPKDLDKDTTHRYGPNTFKLHRLPVPRPGQVLGLVGTNGIGKSTALKVLAGKLKPNLGRFLSPPDWQEILTYFRGSELQNYFTRILEDNLKAIIKPQYVDHIPKAVKGNVGEVLAQKDEREMRFELAKDLDLNQVLDRDVGDLSGGELQRFAIAVVATQHAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIRTYARYKYPQMSKTQGGFKLMVKEGEFTDSQIIVMLGENGTGKTTFIRMLAGLLKPDEATDSDVEVPEFNVSYKPQKISPKFTSTVRHLLHQKIRDSYMHPQFNTDVMKPLQIEALMDQEVVHLSGGELQRVALCLCLGKPADIYLIDEPSAYLDSEQRIVAAKVIKRFILHAKKTAFVVEHDFIMATYLADRVIVYEGQPSIDCIANTPQSLLTGMNLFLSHLDITFRRDPTNYRPRINKLDSTKDREQKNAGSYYYLDD

SEQ ID NO: 19307 - protein, 605 aa, Ceratodon purpureus
MSDRLTRIAIVSSDRCKPKKCRQECKKSCPVVKTGKLCIEVSSASKIAFISEELCIGCGICVKKCPFEAIQIINLPKDLDKDTTHRYGPNTFKLHRLPVPRPGQVLGLVGTNGIGKSTALKVLAGKLKPNLGRFLNPPDWQEILTYFRGSELQNYFTRILEDNLKAIIKPQYVDHIPKAVKGNVGEVLAQKDEREMRFELANDLDLKQVLDRDVGDLSGGELQRFAIAVVATQQAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIQTYARYKYPGMSKTQGGFKLAVKEGEFTDSQIIVMLGENGTGKTTFIRMLAGLLKPDEAGDSNVEVPEFNVSYKPQKISPKFTSKVRHLLHQKIRDSYMHPQFNTDVVKPLQIEALMDQEVVHLSGGELQRVALCLCLGKPADIYLIDEPSAYLDSEQRIVASKVIKRFILHAKKTAFVVEHDFIMATYLADRVIVYEGQPSIDCLANTPQSLLTGMNLFLSHLDITFRRDPTNYRPRINKLDSTKDREQKNAGSYYYLDD

SEQ ID NO: 19308 - protein, 605 aa, Ceratodon purpureus
MSDRLTRIAIVSSDRCKPKKCRQECKKSCPVVKTGKLCIEVSSASKIAFISEELCIGCGICVKKCPFEAIQIINLPKDLDKDTTHRYGPNAFKLHRLPVPRPGQVLGLVGTNGIGKSTALKVLAGKLKPNLGRFLNPPDWQEILTYFRGSELQNYFTRILEDNLKAIIKPQYVDHIPKAVKGNVGEVLAQKDEREMRFELAKDLDLNQVLGRDVGDLSGGELQRFAIAVVATQHAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIRTYARYKYPVMSKTQGGFKLAVKEGEFTDSQIIVMLGENGTGKTTFIRMLAGLLKADEADDSNVEVPEFNVSYKPQKISPKFTSTVRHLLHQKIRDSYMHPQFNTDVMKPLQIEALMDQEVVHLSGGELQRVALCLCLGKPADIYLIDEPSAYLDSEQRIVASKVIKRFILHAKKTAFVVEHDFIMATYLADRVIVYEGEPSIDCVANTPQSLLTGMNLFLSHLDITFRRDPTNYRPRINKLDSTKDREQKNAGSYYYLDD

SEQ ID NO: 19309 - protein, 598 aa, Lotus japonicus
MSDRLTRIAIVSNDRCKPKKCRQECKKSCPVVRTGRLCIEVSSASKIAYISEELCIGCGICVKKCPFEAIQIINLPKDLDKDTTHRYGPNTFKLHRLPVPRPGQVLGLVGTNGIGKSTALKVLAGKLKPNLGRFTNPPDWQEILTYFRGSELQNYFTRILEDDLKAIIKPQYVDHIPKAVQGNVGEVLEQKDERDVKAELCTDLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQETAEEAQTYARYKYPAMSKTQGNFRLRVAEGEFTDSQIIVMLGENGTGKTTFIRMLAGLLKPDSVEGGSDVDMPEFNVSYKPQKISPKFQSTVRHLLHQKIRDAYTHPQFVSDVMKPLLIEQLMDQEVVNLSGGELQRVALCLCLGKPADIYLIDEPSAYLDSEQRIHAAKVIKRFILHAKKTAFVVEHDFIMATYLADRVIVYEGRPSIDCTANCPQSLLSGMNLFLSHLDITFRRDPTNFRPRINKIDSTKDREQRRI

SEQ ID NO: 19310 - protein, 606 aa, Solanum phureja
MSDQRLSRIAVLNSDRCKPKKCGLLCKKCCPVVKTGKLCIEVTATSKIAFISEELCIGCGICVKKCPFEAIMIINLPKDLDKDTTHRYGPNTFKLHRLPVPRPGQVLGLVGTNGIGKSTALKILAGKLKPNLGRFSNPPDWQEILTHFRGSELQNYFTRILEDNLKAIIKPQYVDHIPRAVQGNVGQVLDQKDERGVKEKLCVDLELNQVLDRNVGDLSGGELQRFAIAVVAIQNAEIYMFDEPSSYLDVRQRLKAAQVVRSLLRPDSYVIVVEHDLSVLDYLSDFICCLYGKPGAYGVVTLPFSVREGINIFLAGFVPTENLRFRDESLTFKVAEIPQEAAEEIESYARYRYPTMTKTQGNFKLKVAEGEFTDSQIVVMLGENGTGKTTFIRMLAGLLKPDVVEGSNVEIPEFNVSYKPQKISPKFQSTVRHLLHQKIRDSYMHPQFCSDVMKPLQIEQLMDQEVVNLSGGELQRVALTLCLGKPADIYLIDEPSAYLDSEQRIVASKVIKRFILHAKKTAFIVEHDFIMATYLADRVIVYEGTPSIDCVANAPQSLLTGMNLFLSHLNITFRRDPTNFRPRINKLESTKDREQKSAGSYYYLDD

SEQ ID NO: 19311 - protein, 606 aa, Trigonella foenum-graecum
MSDRLTRIAIVSNDRCKPKKCRQECKKSCPVVRTGRLCVEVTSASKIAYISEELCIGCGICVKKCPFEAIQIINLPKDLDKDTTHRYGPNTFKLHRLPVPRPGQVLGLVGTNGIGKSTALKVLAGKLKPNLGRFTEPPDWQEILTHFRGSELQNYFTRILEDDLKAIIKPQYVDHIPKAVQGNVGQVLDQKNERDMKEKLCADLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLSGFVPTENLRFREVSLTFKVAETPQESAEEAQTYARYKYPTMTKTQGNFRLHVVEGEFTDSQIIVMLGENGTGKTTFIRMLAGLLKPDTIEGGSDVEMPEFNVSYKPQKISPKSQLSVRHLLHQRIRDFYTHPQFISDVMKPLLIEQLMDQEVQNLSGGELQRVALCLCLGKPADIYLIDEPSAYLDSEQRIVAAKVIKRFILHAKKTAFIVEHDFIMATYLADRVIVYEGQPSIDCTANCPQSLLTGMNLFLSHLDITFRRDPTNFRPRINKLESTKDREQKNAGSYYYLDD

SEQ ID NO: 19312 - protein, 606 aa, Medicago truncatula
MSDRLTRIAIVSNDRCKPKKCRQECKKSCPVVRTGRLCVEVTSASKIAYISEELCIGCGICVKKCPFEAIQIINLPKDLDKDTTHRYGPNTFKLHRLPVPRPGQVLGLVGTNGIGKSTALKVLAGKLKPNLGRFTEPPDWQEILTHFRGSELQNYFTRILEDDLKAIIKPQYVDHIPKAVQGNVGQVLDQKNERDMKERLCADLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLSGFVPTENLRFREVSLTFKVAETPQETAEEAQTYARYKYPTMTKTQGNFRLHVVEGEFTDSQIIVMLGENGTGKTTFIRMLAGLLKPDTIEGGSDVEMPEFNVSYKPQKISPKSQLSVRHLLHQRIRDAYTHPQFISDVMKPLLIEQLMDQEVQNLSGGELQRVALCLCLGKPADIYLIDEPSAYLDSEQRIVAAKVIKRFILHAKKTAFIVEHDFIMATYLADRVIVYEGQPSIDCTANCPQSLLTGMNLFLSHLDITFRRDPTNFRPRINKLESTKDREQKNAGSYYYLDD

SEQ ID NO: 19313 - protein, 605 aa, Physcomitrella patens
MSDRLTRIAIVSSDRCKPKKCRQECKKSCPVVKTGKLCIEVTSQAKLAFISEELCIGCGICVKKCPFEAIQIINLPKDLDKDTTHRYGPNTFKLHRLPVPRPGQVLGLVGTNGIGKSTALKVLAGKLKPNLGRFLSPPDWQEILTYFRGSELQNYFTRILEDNLKAIIKPQYVDHIPKAVKGNVGEVLAQKDEREMRFELAKDLDLNQVLDRDVGDLSGGELQRFAIAVVATQHAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIRTYARYKYPQMTKTQGGFKLQVKEGEFTDSQIIVMLGENGTGKTTFIRMLAGLLKPDDVGDSDVEVPEFNVSYKPQKISPKFTSTVRHLLHQKIRDSYMHPQFNTDVMKPLQIEALMDQEVIHLSGGELQRVALCLCLGKPADIYLIDEPSAYLDSEQRIVAAKVIKRFILHAKKTSFVVEHDFIMATYLADRVIVYEGQPSIDCIANTPQSLLTGMNLFLSHLDITFRRDPTNYRPRINKRDSTKDREQKNAGSYYYLDD

SEQ ID NO: 19314 - protein, 582 aa, Rosmarinus officinalis
ECKKSCPVVKTGKLCIEVTPLSRIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDMKEELCVDLELNQVLDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESGEEVETYARYKYPTMTKTQGNFKLKVIEGEFTDSQIVVMLGENGTGKTTFIRMLAGLLKPDLVEGSDVEIPEFNVSYKPQKISPKFQSSVRHLLHQKIRDSYTHPQFISDVMKPLQIEQLMDQEVVNLSGGELQRVALALCLGKPADIYLIDEPSAYLDSEQRIVASKVIKRFILHAKKTAFVVEHDFIMATYLADRVIVYEGKPSVDCVANAPQSLLTGMNLFLSHLDITFRRDPTNFRPRINKLDSTKDREQKSAGSYYYLDD

SEQ ID NO: 19315 - protein, 591 aa, Chrysanthemum coronarium
MADRLTRIAILKEDRCKPKKCRQECKKSCPVVKTGKLCIEVSSASKVAYISEELCIGCGICVKKCPFDAIEIINLPKDLEKDTTHRYGVNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLEQKDERDAKAELCADLELNQVIDRNVGDLSGGELQRFAIAVVAIQMAEIYMFDEPSSYLDVKQRLKAAQVIRSLLRPNSFVIVVEHDLSVLDYLSDFICCLYGKPGAYGVVTLPFSVREGINIFLEGFVPTENLRFRDERLTFRVAETAQETAEEIQTYAQYRYPTMSKTQGGFKLKAVEGEFTDSQIIVMLGENGTGKTTFIRMLAGLLKPDTVEGSEVEIPEFHVSYKPQKISPKFPHSVRHLLHSKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGQPSVDCVANAPQSLLTGMNLFLSHLTITFRRDPGNYRPRINKLNSTKD

SEQ ID NO: 19316 - protein, 606 aa, Trifolium pratense
MADRLTRIAIVSNDRCKPKKCRQECKKSCPVVRTGKLCIEVTSASKIAYISEELCIGCGICVKKCPFEAIQIINLPKDLDKDTTHRYGPNTFKLHRLPVPRPGQVLGLVGTNGIGKSTALKVLAGKLKPNLGRFTQPPDWQEILTHFRGSELQNYFTRILEDDLKAIIKPQYVDHIPKAVEGNVGQVLDQKNERDMKEELCADLELNQVIDRNVGDLSGGELQRFAIAVVAIQNAEIYMFDEPSSYLDVKQRLKAARVVRSLLRPNSYVIVVEHDLSVLDYLSDFICCLYGKPGAYGVVTLPFSVREGINIFLSGFVPTENLRFREESLTFKVAETPQESAEETDTYARYKYPTMTKTQGNFRLRAVEGEFTDSQIIVMLGENGTGKTTFIRMLAGLLKPDAIEGGSDVEMPEFNVSYKPQKISPKSRLSVRQLLHQKIRDAYTHPQFNSDVMKPLLIEQLMDQEVMNLSGGELQRVALCLCLGKPADIYLIDEPSAYLDSEQRIVAAKVIKRFILHAKKTAFIVEHDFIMANYLADRVIVYEGQPSIDCTANCPQSLVTGMNLFLSHLDITFRRDPTNFRPRINKHGSTKDREQKNARSYYYLDD

SEQ ID NO: 19317 - protein, 605 aa, Spinacia oleracea
MSDRLTRIAIVSSDRCKPKKCRQECKKSCPVVKTGKLCIEVTPLTKLAFISEELCIGCGICVKKCPFEAIQIINLPKDLSKDTTHRYGPNTFKLHRLPVPRPGQVLGLVGTNGIGKSTALKVLAGKLKPNLGRFNNPPDWQEILTYFRGSELQNYFTRILEDNLKANIKPQYVDNIPKAVQGNVGEVLDKKDERDMKLVLCEDLELNKVLDRKVGDLSGGELQRFAIAVVAMQSGEIYMFDEPSSYLDVKQRLKAARVIRSLLSPKSYVIVVEHDLSVLDYLSDFICCLYGKPGAYGVVTLPFSVREGINIFLAGFVPTENLRFREESLTFKVAETPQDNAEEIETYARYKYPTMSKVLGNFKMRVVEGEFTDSQIIVMLGENGTGKTTFIRMLAGLLKPDNVETGDVEIPEFNVSYKPQKISPKFLGSVRALLHQKIRDSYTHPQFNSDVMKPLQIEQLMDQEVVNLSGGELQRVALTLCLGKPADIYLIDEPSAYLDSEQRIVASKVIKRFILHAKKTAFVVEHDFIMATYLADRVVVYEGIPSVDCTANSPQSLLNGMNLFLSHLDITFRRDPTNYRPRINKLESAKDREQKSAGTYYYLDD

SEQ ID NO: 19318 - protein, 581 aa, Castanea mollissima
MQKSCPVVKTGKLCIEVAPASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDMKSELCADLQLNQVIDRNVGDLSGGELQRFAIAVVAVQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIETYARYKYPTMTKTQGNFRLRVVEGEFTDSQIIVMLGENGTGKTTFIRMLAGLLKPDSVEGSDVEIPEFNVSYKPQKISPKFPSTVRHLLHSKIRDSYMHAQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGRPSLDCIANSPQSLLTGMNLFLSHLDITFRRDPTNFRPRINKLESTKDREQKSAGSYYYLDD

SEQ ID NO: 19319 - protein, 606 aa, Trifolium pratense
MSDRLTRIAIVSNDRCKPKKCRQECKKSCPVVRTGRLCIEVSSASKIAYISEELCIGCGICVKKCPFEAIQIINLPKDLDKYTTYRYGPNTCKLHRLPVPRPGQVLGLVGTIGIGKSTALKVLAGKLKPNLGRFTNPPDWQEILTYFRGSELQNYFTRILEDDLKAIIKPQYVDHIPKAVQGNVGQVLDQKNERDMKEELCADLELNQVIDRNVGDLSGGELQRFAIAVVAIQNAEIYMFDEPSSYLDVKQRLKAARVVRSLLRPNSYVIVVEHDLSVLDYLSDFICCLYGKPGAYGVVTLPFSVREGINIFLSGFVPTENLRFREESLTFKVAETPQESAEETDTYARYKYPTMTKTQGNFRLRAVEGEFTDSQIIVMLGENGTGKTTFIRMLAGLLKPDAIEGGSDVEMPEFNVSYKPQKISPKSRLSVRQLLHQKIRDAYTHPQFNSDVMKPLLIEQLMDQEVMNLSGGELQRVALCLCLGKPADIYLIDEPSAYLDSEQRIVAAKVIKRFILHAKKTAFIVEHDFIMATYLADRVIVYEGQPSIDCTANCPQSLLTGMNLFLSHLDITFRRDPTNFRPRINKLESTKDREQKNAGSYYYLDD

SEQ ID NO: 19320 - protein, 603 aa, Selaginella moellendorffii
MDRLTRIAIVSSDRCKPKKCRQECKKSCPVVKTGKLCIEVSSASKIAFISEELCIGCGICVKKCPFEAIQIINLPKDLDKDTTHRYGANTFKLHRLPVPRPGQVLGLVGTNGIGKSTALKVLAGKLKPNLGKFANPPDWQEILTYFRGSELQNYFTRILEDHLKAIIKPQYVDHIPKAVKGNVGEVLSQKDEKDLKTDLCHDLDLNNVLDRDVGDLSGGELQRFAIAVVAVQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAESAQESVEEVQTYARYKYPSMSKTQGGFKLQIKEGEFTDSQIIVMLGENGTGKTTFIRMLAGLLKPDEVDDSVDIPEFNVSYKPQKISPKFQSTVRHLLHSKIRDSYMHPQFNTDVMKPLQIEALMDQDVVNLSGGELQRVALCLCLGKPADIYLIDEPSAYLDSEQRIVASKVIKRFILHAKKTAFVVEHDFIMATYLADRVIVYEGRPSVDCIANPPQSLLTGMNLFLSHLDITFRRDPTNFRPRINKLDSTKDREQKAAGSYYYLDD

SEQ ID NO: 19321 - protein, 563 aa, Avena sativa
SPAVKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGQVLEQKDERDMKNELCVDLELNQVIDRNVGDLSGGELQRFAIAVVAVQSAEIYMFDEPSSYLDVKQRLKAARVIRSLLRSNSYVIVVEHDLSVLDYLSDFICCLYGKPGAYGVVTLPFSVREGINIFLAGFVPTENLRFRDESLTFKIAETQENAEEVASYQRYKYPTMTKTQGNFKLCVAEGEFTDSQIVVMLGENGTGKTTFIRMLAGLLKPDTVEGTEIEIPEFNVSYKPQKISPKFQHPVRHLLHSKIRDSYTHPQFVSDVMKPLQIEALMDQEVINLSGGELQRVALCLCLGKPADIYLIDEPSAYLDSEQRIVASKVIKRFILHAKKTAFIVEHDFIMATYLADKVIVYEGRASIDCTANAPQSLVSGMNKFLSHLDITFRRDPTNYRPRINKLESTKDREQKNAGSYYYLDD

SEQ ID NO: 19322 - protein, 606 aa, Trifolium pratense
MADRLTRIAIVSNDRCKPKKCRQECKKSCPVVRTGKLCIEVTSASKIAYISEELCIGCGICVKKCPFEAIQIINLPKDLDKDTTHRYGPNTFKLHRLPVPRPGQVLGLVGTNGIGKSTALKVLSGNLKPNLGRFTDPPDWQEILTHFRGSELQNYFTRMLEDDSKAIIKPQYVDNIPKNVQGNVGQVLDQYNERDMKESLCADLELNQVIDRNVGDLSGGELQRFAIAVVAIQNAEIYMFDEPSSYLDVKQRLKAARVVRSLLRPNSYVIVVEPDLSVLDYLSDFICCLYGKPGAYGVVTLPFSVREGINIFLSGFVPTENLRFREDSLTFKVAETPQETAEEAHSYARYKYPTMTKTQGNFRLRVVEGEFTDSQIVVMLGENGTGKTTFIRMLAGLLKPDAIEGGSDVEMPEFNISYKPQKISPKFRLSVRHLLHQKIRDSYTHPQFISDVMKPLLIEQLMDQEVVNLSGGELQRVALCLCLGKPADIYLIDEPSAYLDSEQRIVAAKVIKRFILHAKKTAFVVEHDFIMANYLADRVIVYEGQPSIDCIANCPQSLLTGMNLFLSHLDITFRRDPTNFRPRINKLDSTKDREQKHAGSYYYLDD

SEQ ID NO: 19323 - protein, 607 aa, Medicago truncatula
MSDERLTRIAIVNNDKCKPKKCRQECKKSCPVVGTGKLCVEVTSASKIAYISEELCIGCGICVKKCPFGAIEIINLPKNLDKDTTHRYGPNTFKLHRLPVPRPGQVLGLVGTNGIGKSTALKVLAGKLKPNLGRFTEPPDWQEILTHFRGSELQNYFTRILEDDLKAIIKPQYVDHIPKAVQGNVGQTLDSKNERDMKEKLCADLELNQVIDRNVGDLSGGELQRFAIAVVAIQNAEIYMFDEPSSYLDVKQRLKAAQVVRSLLRPNSFVIVVEHDLSVLDYLSDFICCLYGKPGVYGVVTLPFSVREGINIFLSGFVPTENLRFREVSLTFKVAENPQETAEEAQTYARFKYPTMTKTQGNFRLHAVEGEFTDSQIIVMLGENGTGKTTFIRMLAGLLKPDTTEGVSDVEMPEFNVSYKPQKISPKSQLPVRYMLHQKIRDAYTHPQFISDVMKPLLIEQLMDQEVQNLSGGELQRVALCLCLGKPADIYLIDEPSAYLDSEQRIVAAKVIKRFILHAKKTAFIVEHDFIMATYLADKVIVYEGQPSINCTANCPQSLLTGMNLFLSHLDITFRRDPTNFRPRINKLESTKDREQKNAGSYYYLDD

SEQ ID NO: 19324 - protein, 559 aa, Pennisetum glaucum
MADRLTRIAIVSEDKCKPKKCRQECKKSCPVVKTGKLCIEVTSASKLAFISEELCIGCGICVKKCPFDAIEIINLPKDLEKDTTHRYGPNTFKLHRLPVPRPGQVLGLVGTNGIGKSTALKVLAGKLKPNLGRFKNPPDWQEILTYFRGSELQNYFTRILEDNLKAIIKPQYVDHIPKAVQGNVGEVLAQKDERDMKTELCVDLELNQVIDRNVGDLSGGELQRFAIAVVAVQNAEIYMFDEPSSYLDVRQRLKAAQVIRSLLRPNSYVIVVEHDLSVLDYLSDFICCLYGKPGAYGVVTLPFSVREGINIFLAGFVPTENLRFRDESLTFKIAETQESAEEIETYQRYKYPTMSKTQGNFKLTVVEGEFTDSQIVVMLGENGTGKTTFIRMLAGLLKPDTVEGTDIEIPEFNVSYKPQKISPKFQNTVRHLLHQKIRDSYMHPQFVSDVMKPLQIEQLMDQEVINLSGGELQRVAICLCLGKPADIYLIDEPSAYLDSEQRIVASKVIKRFILHAKKTAFIVEHDFIMATYLADKVIVMRGGLPLTVLPMHHSLWYLG

SEQ ID NO: 19325 - protein, 633 aa, Capsicum annuum
MSDQRLTRIAIVSADKCKPKKCRQECKKSCPVVKTGKLCIEVSAASKIAFISEELCIGCGICVKKCPFEAIQIINLPKDLDKDTTHRYGPNTFKLHRLPVPRPGQVLGLVGTNGIGKSTALKVLAGKLKPNLGRFSVLISAIFIICQFLPYGCLCFLYSFLWQNPPDWQEILTHFRGSELQNYFTRILEDNLKAIIKPQYVDHIPKAVQGNVGQVLDQKDERDVKEKLCVDLELNQVLDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQEAAEEIESYARYRYPTMTKTQGNFKLKVAEGEFTDSQIVVMLGENGTGKTTFIRMLAGLLKPDMVEGSDVEIPEFNVSYKPQKISPKFQSTVRHLLHQKIRDSYTHPQFCSDVMKPLQIEQLMDQEVVNLSGGELQRVALALCLGKPADIYLIDEPSAYLDSEQRIVASKVIKRFILHAKKTAFVVEHDFIMATYLADRVIVYEGKPSIDCVANAPQSLLTGMNLFLSHLNITFRRDPTNYRPRINKLESTKDREQKAAGSYYYLDD

SEQ ID NO: 19326 - protein, 606 aa, Solanum lycopersicum
MSNQKLSRIAILNSDRCKPKKCGLQCKKCCPVVKTGKLCIEVTATSKIAFISEELCIGCGICVKKCPFEAIMIINLPKDLDKDTTHRYGANTFKLHRLPVPRPGQVLGLVGTNGIGKSTALKVLAGKLKPNLGRFSNPPDWQEILTHFRGSELQNYFTRILEDNLKAIIKPQYVDHIPRAVQGNVGQVLDQKDERDIKEKLCVDLELNQVLDRNVGDLSGGELQRFAIAVVAIQNAEIYMFDEPSSYLDVRQRLKAAHVVRSLLRPDSYVIVVEHDLSVLDYLSDFICCLYGKPGAYGVVTLPFSVREGINIFLAGFVPTENLRFRDESLTFKVAEIPQEVAEEIESYARYRYPTMTKTQGNFKLKVAEGEFTDSQIIVMLGENGTGKTTFIRMLAGLLKPDVVEGSNVEIPEFNVSYKPQKISPKFQSTVRQLLHQKIRDSYMHPQFCSDVMKPLQIEQLMDQEVVNLSGGELQRVALTLCLGKPADIYLIDEPSAYLDSEQRIVASKVIKRFVLHTKKTAFVVEHDFIMAAYLADRVIVYEGTPSMDCVANAPQSLLTGMNLFLSHLNITFRRDPTNFRPRINKLESAKDREQKLAGSYYYLDD

SEQ ID NO: 19327 - protein, 566 aa, Musa acuminata
MADRLTRIAIVSSDRCKPKKCRQECKKSCPVVKTGKLCIEVTPASKIAFISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDEREMKAELCNDLELNQVIDRNVGDLSGGELQRFAIAVVAIQNAEIYMFDEPSSYLDVKQRLKAAQVIRSLLRRNSYVIVVEHDLSVLDYLSDFICCLYGKPGAYGVVTLPFSVREGINIFLAGFVPTENLRFRDESLTFKVAETPQESAEEIQTYQRYKYPTMSKTQGNFKLKVIEGEFTDSQIIVMLGENGTGKTTFIRMLAGLLKPDSVEDSDFEMPEFNVSYKPQKISPKFPSTVRHLLHQKIRDSYMHPQFVTDVMKPLQIEQLMDQEVVNLSGGELQRVALCLCLGKPADIYLIDEPSAYLDSEQRIVASKVIKRFILHAKKTAFVVEHDFIMATYLADKVIVYEGRPSIDCTANAPQSLVSGMNLFLS

SEQ ID NO: 19328 - protein, 586 aa, Papaver somniferum
SAARSAKRVAPSSKTGKLCIEVTVAAKIAYISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLEQKDERGVKEDLCRDLELNQVIERNVGDLSGGELQRFAIAVVAIQNAEIYMFDEPSSYLDVRQRLKAAQVIRSLLRANSYVIVVEHDLSVLDYLSDFICCLYGKPGAYGVVTLPFSVREGINIFLAGFVPTENLRFRDESLTFKVAETPQESAEEIQSYARYKYPTMSKTQGNFKLRVLEGEFTDSQIVVMLGENGTGKTTFIRMLAGLLKPDEVESSDAEIPEFNVSYKPQKISPKFQASVRALLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGQPSIDCTANAPQSLLTGMNLFLSQLDITFRRDPTNFRPRINKMNSTKDREQKNAGSYYYLDD

SEQ ID NO: 19329 - protein, 576 aa, Lactuca sativa
HFLLAGKLCIEVTSASKVAYISEELCIGCGICVKKCPFDAIEIINLPKDLDKDTTHRYGVNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDVKAELCADLELNQVIDRNVGDLSGGELQRFAIAVVAIQNAEIYMFDEPSSYLDVKQRLKAAQVIRSLLRPNSYVIVVEHDLSVLDYLSDFICCLYGKPGAYGVVTLPFSVREGINIFLEGYVPTENLRFRDESLTFKVAETPQETAEEIETYARYKYPSMAKTQGGFTLKVVEGEFTDSQIIVMLGENGTGKTTFIRMLAGLLKPDTVEDSDVEIPEFNVSYKPQKISPKFPHSVRHLLHQKIRDSYMHPQFVSDVMKPLQIEQLMDQEVVNLSGGELQRVALCLCLGKPADIYLIDEPSAYLDSEQRIVASKVIKRFILHAKKTAFVVEHDFIMATYLADRVIVYEGKPSIDCVANSPQSLLTGMNLFLSHLNITFRRDPTNYRPRINKLNSTKDREQKFAGSYYYLDE

SEQ ID NO: 19330 - protein, 587 aa, Conyza canadensis
KKCRQECKKSCPVVMTGKQCIEVTSASKVAYISEELCIGCGICIKKCPFDAIEIINIPKDLDKDTTHRYGVNTFKLHRLPVPRPGQVLGLVGTNGIGKSTPLKVLAGKLKPNLGRFNNPPDWSEILQHFRGSELQNYFTRILEDNLKAIIKPQYVDHIPKAVQGNVGQVLDQKDERDAKAELCADLELNQVIDRNVGDLSGGELQRFAIAVVAIQMAEIYMFDEPSSYLDVKQRLKAAQVIRSLLRPSSYVIVVEHDLSVLDYLSDFICCLYGKPGAYGVVTLPFSVREGINIFLEGFVPTENLRFREESLTFKVAETPQDSAEETETYARYRYPTMSKTQGGFKLKVVGGEFTDSQIIVMLGENGTGKTTFIRMLAGLLKPDTVEDSEVEIPEFNISYKPQKISPKYKHSVRHLFHDKIRDSYMHPQFVSDVMKPLQMDQLIDQEVLTLSGGELQRVALVLCLGKPADIYLIDEPSAYLDSEQRIVASKVIKRFILHAKKTAFVVEHDFIMATYLADRVIVYEGKPSIDCVANSPQSLLTGMNLFLSHLTITFRRDPTNFRPRINKLNSTKDREQKLAGSYYYLDD

SEQ ID NO: 19331 - protein, 619 aa, Ricinus communis
MCVMCSINCLLILLAVLLCLGREKGVIEMADRLTRIAIVSSDRCKPKKCRQECKKSCPVVKTGRLCIEVTPASKIAFISEELCIGCGICVKKCPFEAIQIINLPKDLDKDTTHRYGPNTFKLHRLPVPRPGQVLGLVGTNGIGKSTALKNPPDWQEILTYFRGSELQNYFTRILEDNLKAIIKPQYVDHIPKAVQGNVGQVLDQKDEREMKAELCHDLQLNQVIDRNVGDLSGGELQRFAIAVVAIQNAEIYMFDEPSSYLDVKQRLKAARVIRSLLKPNSYVIVVEHDLSVLDYLSDFICCLYGKPGAYGVVTLPFSVREGINIFLAGFVPTENLRFREESLTFRVAETPQESAEEIETYARYRYPTMTKTQGNFKLQVIEGEFTDSQIIVMLGENGTGKTTFIRMLAGLLKPDTMEGSDIEIPEFNVSYKPQKISPKFQSTVRHLLHQKIRDSYMHPQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGKPSLDCTANSPQSLLTGMNLFLSHLDITFRRDPTNFRPRINKLDSTKDRDQKAAGSYYYLDD

SEQ ID NO: 19332 - protein, 600 aa, Brachypodium distachyon
MATTRIAILNEDRCKPKKCRQECKKSCPVVKTGKHCIEVNPTSKSAFISEELCIGCGICVKKCPFDAIQIINLPKDLDKDTTHRYGANTFKLHRLPVPRPGQVLGLIGANGIGKSTALKVLQGKIKPNLGRFKNPPDWQEILTYFRGSELQNYFTRMLEDNLKAIIKRQDVERIPEKVQGNVGKLLERLDQRGMIDQLCIDLELNQLLDRNIQDLSGGELQRFAIAGIAAQSAEIYMFDEPSVYLDVKQRLKAAQVIRSLLRTNSYVIVVEHDLSVLDYMSDFICCLYGKPGAYGVVTLPFSVREGINVFLAGFVPTENLRFRNESLTFKIAEVQENAEEIETYQRYKYPTMTKTYDNFKLTVMEGEFTDSQIVVMLGENGTGKTTFIKMLAGLEKPDTVEGTDTEIPKFYVSHKPQKLKPKFQGTVRQLLHLKIRDSYTYPQFTSDVMKPLQIEQLMDQEIINLSGGERQRVALCLCLGKPADIYLIDEPSASLDSEQRIVASKVIKRFILHAKKTAFVVEHDFIMATYLADKVVVFEGRPSVDCTANAPQSLQSGMNKFLSHLDITFRRDPTNYRPRINKLGSTKDREQKSEGSYYYL

SEQ ID NO: 19333 - protein, 557 aa, Castanea mollissima
FISEELCIGCGICVKKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGQVLDQKDERDMKSELCADLQLNQVIDRNVGDLSGGELQRFAIAVVAVQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIETYARYKYPTMTKTQGNFRLRVVEGEFTDSQIIVMLGENGTGKTTFIRMLAGLLKPDSVEGSDVEIPEFNVSYKPQKISPKFPSTVRHLLHSKIRDSYMHAQFVSDVMKPLLIEQLMDQEVVNLSGGELQRVALCLCLGKPADIYLIDEPSAYLDSEQRIVASKVIKRFILHAKKTAFVVEHDFIMATYLADRVIVYEGRPSLDCIANSPQSLLTGMNLFLSHLDITFRRDPTNFRPRINKLESTKDREQKSAGSYYYLDD

SEQ ID NO: 19334 - protein, 559 aa, Picea glauca
IAFISEELCIGCGICVKKCPFEAIQIINLPKDLDKDTTHRYGPNTFKLHRLPVPRPGQVLGLVGTNGIGKSTALKVLAGKLKPNLGRFHNPPDWQEILTYFRGSELQNYFTRILEDNLKAIIKPQYVDHIPKAVQGNVGQVLEQKDERDIKSELCTDLDLNQVMDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIKSYARYKYPTMSKTQGNFKLNVKEGEFTDSQIIVMLGENGTGKTTFIRMLAGLLKPDTVDNTDVEIPEFNVSYKPQKISPKFQSTVRHLLHQKIRDSYTHPQFTSDVMKPLQIEQLMDQDVVNLSGGELQRVALCLCLGKPADIYLIDEPSAYLDSEQRIVAAKVIKRFILHAKKTAFVVEHDFIMATYLADRVIVYEGRPSVDCVANTPQSLQTGMNLFLSHLDITFRRDPTNYRPRINKLDSTKDREQKNAGSYYYLDD

SEQ ID NO: 19335 - protein, 599 aa, Secale cereale
MAARIAIINEDRCKPKKCRQECRKSCPVVKTGKHCIEVTPASKTAFISEELCIGCGICVKKCPFGAIQIINLPKDLDKDTTHRYGPNTFKLHRLPVPRPGQVLGLVGANGIGKSTALKVLCGKLKPNLGKFDNPPDWQEILTYFRGSELQNYFTRLLEDNLKAIIKRQDIESIPKAVQGNVGQLLDKLDQRGVKAQLCIDLELNQVLDRNVEDLSGGELQRFAIAGTAAQSAEIYMFDEPSVYLDVKQRLKAAQVIRSLLKANSYVIVVEHDLSVLDYMSDFICCSYGKPGAFGVVTLPFSVREGINVFLAGFVPTENLRFRDESLTFKIVEAQENAEEIETYQRYKYPTMSKTIGNFKLTVMEGEFTDSQIVVMLGENGTGKTTFIKMLAGRLKPDTVEGAEIEIPKFYVSHKPQQLATKFQGTVSQLLHQKIPDSCAHPQFRSDVIKPLQIEQLMDRQVTNLSGGERQRVALCLCLGKPADIYLIDEPSASLDSEQRIVASKVIKRFILHAKKTAFVVEHDFIMATYLADKVIVYEGRPSVDCTANAPQTLLSGMNKFLSQLDITFRRDPTNYRPRINKLDSTKDKEQKSVGSYYYL

SEQ ID NO: 19336 - protein, 599 aa, Triticum aestivum
MAARIAIINEDRCKPKKCRQECRKSCPVVKTGKHCIEVTPASKTAFISEELCIGCGICVKKCPFGAIQIINLPKDLDKDTTHRYGANTFKLHRLPVPRPGQVLGLVGANGIGKSTALKVLCGKLKPNLGKFNNPPDWQEILTYFRGSELQNYFTRLLEDNLKAIIKRQDVESIPKAVQGNVGQLLDKLDQRGVKAQLCIDLELNQVLDRNVEDLSGGELQRFAIAGTAAQSADIYMFDEPSVYLDVKQRLKAAQVIRSLLRANSYVIVVEHDLSVLDYMSDFICCSYGKPGAFGVVTLPFSVREGINVFLAGFVPTENLRFRDESLTFKIVEAQENAEEIETYQRYKYPTMSKIIGNFKLTVMEGEFTDSQIVVMLGENGTGKTTFIKMLAGRLKPDTVEGAEIEIPKFYVSHKPQELETKFQGTVSQLLHQKIPDSCAHPQFRSDVIKPLQIEQLMDRQVTNLSGGERQRVALCLCLGKPADIYLIDEPSASLDSEQRIVASKVIKRFILHAKKTAFVVEHDFIMATYLADKVIVYEGRPSVDCTANAPQTLLSGMNKFLSQLDITFRRDPTNYRPRINKLDSTKDKEQKSVGSYYYL

SEQ ID NO: 19337 - protein, 556 aa, Cyclamen graecum
MSDRLTRIAIVSSDRCKPKKCRQECKKSCPVVKTGKLCIEVTPATKIAFISEELCIGCGICVKKCPFEAIQIINLPKDLDKDTTHRYGPNTFKLHRLPVPRPGQVLGLVGTNGIGKSTALKVLAGKLKPNLGRFDNPPDWQEILTYFRGSELQNYFTRILEDNLKAIIKPQYVDHIPKAVVGNVGQVLDQKDERELKESLCVDLDLNQVLDRNVGDLSGGELQRFAIAVVAIQNAEIFMFDEPSSYLDVKQRLKAAQVIRSLLRPNSYVIVVEHDLSVLDYLSDFICCLYGKPGAYGVVTLPFSVREGINIFLAGFVPTENLRFRDESLTFKVAETPQESAEEIETYARYKYPTMCKTMGNFKIRVVEGEFTDSQIVVMLGENGTGKTTFIRMLAGLLKPDTVEGSDMDIPEYNVSYKPQKISPKFQSSVRHLLHQKIRDSYMHPQFVSDVMKPLMIEQLMDQEVVNLSGGELQRVALCLCLGKPADIYLIDEPSAYLDSEQRIVASKVIKRFILHAKKTAFVVEHDFIMATYLADRVIVYEGRPSVDCIANAPQS

SEQ ID NO: 19338 - protein, 599 aa, Triticum aestivum
MAARIAIINEDRCKPKKCRQECRKSCPVVKTGKHCIEVTPASKSAFISEELCIGCGICVKKCPFGAIQIINLPKDLDKDTTHRYGPNTFKLHRLPVPRPGQVLGLVGANGIGKSTALKVLCGKLKPNLGKFDNPPDWQEILTYFRGSELQNYFTRLLEDNLKAIIKRQDVESIPKAVQGNVGQLLDKLDQRGVKAQLCIDLELNQVLDRNVEDLSGGELQRFAIAGTAAQSADIYMFDEPSVYLDVKQRLKAAQVIRSLLRANSYVIVVEHDLSVLDYMSDFICCSYGKPGAFGVVTLPFSVREGINVFLAGFVPTENLRFRDEALTFKIVEAQENAEEIETYQRYKYPTMSKTIGNFKLTVMEGEFTDSQIVVMLGENGTGKTTFIKMLAGRLQPDTVEGAEIEIPKFYVSHKPQQLETKFQGTVSQLLHQKIPESCAHPQFRSDVIKPLQIEQLMDRVVTNLSGGERQRVALCLCLGKPADIYLIDEPSASLDSEQRIVASKVIKRFIFHAKKTAFVVEHDFIMATYLADKVIVYEGRPSVDCTANAPQTLLSGMNKFLSQLDITFRRDPTNYRPRINKLDSTKDKEQKSVGSYYYL

SEQ ID NO: 19339 - protein, 605 aa, Amborella trichopoda
MADQRLNRIAIVNADRCKPKECRQECKKSCPVVRTGKLCIEVSPASKIAYISEELCIGCGICVKKCPFDAIQIINLPKDLDKDTTHRYGPNTFKLHRLPVPRPGQVLGLVGTNGIGKSTALKVLAGRLKPNLGRFRNPPDWEEILTYFRGSELQDYFIRLLEDNLKPAIKPQYVDHIPKAARGTVREVLAQKDERGMMTEICCDLELNEVMDHDIGDLSGGELQRFAIAVVAVQNADIYMFDEPSSYLDVKQRIKAAQVIRSLLRPNSYVIVVEHDLSVLDYLSDFICCLYGKPGVYGVVTLPFSVREGINIFLAGFVPTENLRFRDNHLTFKIASNHQENAEEMKSYARHRYPTMSKTQGKFKLTVIEGEFTDSQIIVMLGENGTGKTTFIRMLAGHLRADEVDGGLGVEVPEFNVSYKPQKISPKYPSKVRHLLHQKIQDSYMHPQFMTDVMKPLQIEQLMNQEVVNLSGGELQRVALCLCLGKPADIYLIDEPSAYLDSEQRIVASKVIKSFILHSKKTAFVVEHDFIMATYLADKVIVYAGKPSVECTANAPEELLTGMNRFLSHLDVTLRRDTTSYRPRINKLDSTKDREQKAAGTYYYN

SEQ ID NO: 19340 - protein, 545 aa, Prunus mume
MMQKCPFEAIQIINLPKDLDKDTTHRYGPNTFKLHRLPVPRPGQVLGLVGTNGIGKSTALKVLAGKLKPNLGRFNNPPDWQEILTYFRGSELQNYFTRILEDNLKAIIKPQYVDHIPKAVQGNVGEVLNQKDERDMKEELCADLELNQVIDRNVGDLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIETYARYKYPSMTKTQGNFRLRVVEGEFTDSQIIVMLGENGTGKTTFIRMLAGLLKPDIVEDSNVEIPEFNVSYKPQKISPKFQSTVRHLLHSKIRDSYTHPQFMSDVMKPLLIEQLMDQEVVNLSGGELQRVALCLCLGKPADIYLIDEPSAYLDSEQRIVASKVIKRFILHAKKTAFVVEHDFIMATYLADRVIVYEGKPSIDCVANSPQSLLTGMNLFLSHLDITFRRDPTNYRPRINKLESTKDREQKAAGSYYYLDD

SEQ ID NO: 19341 - protein, 537 aa, Plantago ovata
MSDQRLTRIAIVSSDKCKPKKCRQECKKSCPVVKTGKLCIEVSSASKIAFISEELCIGCGICVKKCPFEAIQIINLPKDLEKDTTHRYGPNTFKLHRLPVPRPGQVLGLVGTNGIGKSTAIKVLAGKLKPNLGRFKNPPDWQEILTYFRGSELQNYFTRILEDNLKAIIKPQYVDHIPKAVQGNVGEVLTLKDERDMKEELGIELELNQVMDRNVGDLSGGELQRFAIAVVCIQNAEIYMFDEPSSYLDVRQRLKAAQVIRSLLRPNSYVIVVEHDLSVLDYLSDFICCLYGKPGVYGVVTLPFSVREGINIFLAGFVPTENLRFRDESLTFKVAETPQESAEEIETYARYRYPGMCKTQGNFKLQVKEGEFTDSQIIVMLGENGTGKTTFIRMLAGLLKPDSVEGSDVEIPEFNVSYKPQKISPKFQYNVRTLLHQKIRDSYMHPQFVSDVMKPLQIEQLMDQEVVNLSGGELQRVALTLCLGKPADIYLIDEPSAYLDSEQRIVASKVIKRFILHAKKTAFIVEHDFIMATYLAD

SEQ ID NO: 19342 - protein, 600 aa, Medicago truncatula
MTRIAIVNEDRCKPKKCRQECKKSCPVVKTGKLCIEVNSASKIAYLSEELCNGCGICVKKCPFEAIKIINLPENLDKETTHRYGPNTFKLHRLPIPRPGKVLGLVGKNGIGKSTALKVLAGELEPNLGRFTNPPKWPEILTFFRGSELQNYFTRFRGEGLKAIIKPQYVDDFRRKEQVNVGQALDQKNERDMKEELCAALELNQVIDRNVVDLSGGELQRFAIAGIAIQNAEIYMFDEPSSYLDVKQRLKAAQVVRSLLRHNSYVIVVEHDLSVLDYLSDFICCLYGTPGVYGVVTLPFSVREGINIFLSGFVPTENLRFREDSLTFKVAETPHETDEAQTYARYKYPTMTKTQGKFRLRVAGGEFTDSQIVVMIGENGTGKTTFIRMLVGSLKPDTIGGSDLEMPEFNISYKPQTITPKFKSTVRHLLHERIHKSYTDPQFISDVMKPLLIEQLMDKEVLNLSGGELQRVYLCLCLGKPADIYLIDEPSAYLDSEQRIIAAKVIKRFILHAKKTAFVVEHDFIMATYLADRVIVYEGQPSIDCTANSPQSLLTGMNLFLSHLDITFRRDPTNFRPRINKLDSTKDREQKLAGTYYYLDD

SEQ ID NO: 19343 - protein, 601 aa, Prunus persica
MENRSTRIAIVNTDKCKPKKCNQECKRTCPVVRTGKLCIEVKPVSKVARISEELCIGCGICVKKCPFGAIEIINLPKALDKDTTYRYGSNSFKLHRLPVPRPGEVLGLVGTNGIGKSTALKILAGKLKPNLGRFNNPPNWQEILTYFRGSELQSYFIRLLEDKLKAVIKPQYVDYIPKVAEGNVGELLKQKDERGVMEEVIVDLELNQVLDRKVVNLSGGELQRFAIAFLALQKADIYMFDEPSSYLDVKQRLKAAKVIRSLIRPDSYVIVVEHDLSVLDYLSDHICCLYGKPGAYGVVTLPFSVREGINIFLAGFVPTENLRFRDESLTFKVSETPQESGEEIETYARYGYPSMTKTLGDFKLQVIEGEFSNSQIIVMLGENGSGKTTFMRMLVGLLKPDSDVEIPELCVSYKTQKINTKRAIKVKDMLHEKIRDSCTHPQFVTDVMKPLQIGQLMDQDVTKLSGGELQRVALCLCLGKPADIYLIDEPSAYLDSEQRIVAAKVIKRFILHAKKTAFVVEHDFIMATYLADKVIVYEGKPSVDCIANSPQSLLTGMNLFLSQLDITFRRDPTNYRPRINKLNSTKDREQKAAGSYYYLDD

SEQ ID NO: 19344 - protein, 603 aa, Brassica rapa
MADRLTRIAIVSEDRCKPKKCRQECKKSCPVVKTGRLCIEVTPTSKTAFLSEELCIGCGICVKKCPFEAIQIINLPKDLEKDTTHRYRSNAFKLHRLPVPRPGQVLGLVGTNGIGKSTALKILAGKLKPNLGRFDNPPDWQEILAHFRGSELQSYFTRVVEENLKTAIKPQHVDQIKKIVQGDLGKMLEKLDERGMMEQIVADLELNPVLDRRAKDVSGGELQRFAIAAVFIKKAEIYMFDEPSSFLDVRQRLKAAQVIRSLLRPDSYVIVVEHDLSVLDYLSDFICCLYGKPTAYGVVTLPFSVREGINVFLAGFIPTENLRFRDESLTFKVSETPQESDGEVKSYARYKYPNMSKTLGSFKLEVMEGDFTDSQIVVMLGENGTGKTTFIRMLAGALKPDEGVEEDMPVFNVSYKPQTYDAQRECSVRQLLHERIRDAYMHPQFVSDVMKPLQIEQLLDQAICTLSGGESQRVGITLCLGKPADIYLIDEPSAYLDSEQRITASKVIKRFILHAKKTAFIVEHDFIMATYLADRVIVYEGQPSIKCMAHSPQSLLSGMNLFLSHLNITFRRDPTNFRPRINKLESTKDREQKSAGSYYYLDD

SEQ ID NO: 19345 - protein, 601 aa, Prunus mume
MENRSTRIAIVNIDKCKPKKCNQECKRTCPVVRTGKLCIEVKPVSKVARISEELCIGCGICVKKCPFGAIEIINLPKALDKDTTYRYGSNSFKLHRLPVPRPGEVLGLVGTNGIGKSTALKILAGKLKPNLGRFNNPPNWQEILTYFRGSELQSYFIRLLEDKLKAVIKPQYVDHIPKVAEGNVGELLKQKDERGVMEEVIVDLELNQVLDRKVVNLSGGELQRFAIAFLALQKADIYMFDEPSSYLDVKQRLKAAKVIRSLIGPDSYVIVVEHDLSVLDYLSDHICCLYGKPGAYGVVTLPFSVREGINIFLAGFVPTENLRFRDESLTFKVSETQQETGEEIETYARYRYPSMTKTLGEFKLQVIEGEFSNSQIIVMLGENGSGKTTFMRMLVGLLKPDSDVEIPELCVSYKTQKINTKRAIKVKDMLHEKIRDSCTHPQFVTDVMKPLQIGQLMDQDVTKLSGGELQRVALCVCLGKPADIYLIDEPSAYLDSEQRIVAAKVIKRFILHAKKTAFVVEHDFIMATYLADKVIVYEGKPSVDCIANSPQSLLTGMNLFLSQLDITFRRDPTNYRPRINKLNSTKDREQKAAGSYYYLDD

SEQ ID NO: 19346 - protein, 606 aa, Eutrema parvulum
MADRLTRIAIVSEDRCKPKKCRQECKKSCPVVKTGRLCIEVTPASKTAFLSEELCIGCGICVKKCPFEAIQIINLPKDLEKDTTHRYRSNAFKLHRLPVPRPGQVLGLVGTNGIGKSTALKILAGKLKPNLGRFNNPPDWQEILAHFRGSELQSYFTRVVEENLKTAIKPQHVDQIKKVVKDDLGEMLEKLDERGMMAQICVDLELDPILDRRAKDVSGGELQRFAIAAVFVKKAEIYMFDEPSSFLDVRQRLKAAQVIRSLLRPDSYVIVVEHDLSVLDYLSDFVCCLYGKPTAYGVVTLPFSVREGINVFLAGFIPTENLRFRDESLTFKVSETPQESDGEVKSYARYKYPNMSKTLGTFKLEVMEGDFTDSQIVVMLGENGTGKTTFIRMLAGALKPDGGVEDEEADMPVFNVSYKPQTYDAQRECTVRQLLHERIRDAYMHPQFVSDVMKPLQIEQLLDQAICTLSGGESQRVGITLCLGKPADIYLIDEPSAYLDSELRITASKVIKRFILHAKKTAFIVEHDFIMATYLADRVIVYEGQPSIKCMAHSPQSLLSGMNLFLSHLNITFRRDPTNFRPRINKLESTKDREQKVAGSYYFLDD

SEQ ID NO: 19347 - protein, 533 aa, Brassica napus
DFAFISEELCIGCGICVKKCPFEAIQIINLPRDLEKDTTHRYGANTFKLHRLPVPRPGQVLGLVGTNGIGKSTALKILAGKLKPNLGRFTNPPDWQEILTHFRGSELQNYFTRILEDNLKAIIKPQYVDHIPKAVRGNVGEVLDQKDERDKKAELCADLELNQVIDRAVENLSGGELQRFAIAVVAIQNAEIYMFDEPSSYLDVKQRLKAAQVVRSLLRPNSYVIVVEHDLSVLDYLSDFICCLYGKPGAYGVVTLPFSVREGINIFLAGFVPTENLRFRDESLTFKVAETPQESAEEIQSYARYKYPTMTKTQGNFRLKVTEGEFTDSQIIVMLGENGTGKTTFIRMLAGLLKPDETEESDIEIPEFNVSYKPQKISPKFQNSVRHLLHQKIRDSYMHPQFVSDVMKPLQIEQLMDQEVVNLSGGELQRVALALCLGKPADIYLIDEPSAYLDSEQRIVASKVIKRFILHAKKTAFIVEHDFIMATYLADRVIVYEGQPSIDCIANCPQSLLSGMNLFLSHLNITFKKRLPT

SEQ ID NO: 19348 - protein, 722 aa, Zea mays
MDDESKSAPKSDVNTDAGAEAAAAAAPLPPSSSETAETEARVEAADGESQVVERLVELVSEIAAISDFRNSYRRQFCNLSRRIRLLVPMLEEAKEAPTPLTVASEAALRRLREALHAARDLLQLGSSGSKIFLVLDREKIMKTFQDVTARLEQALAGISFDELNISDEVREQVELVHTQFKRAKERSDSSDDDLFNELMSLCNSSSSDSVDPDTLRRLSEKLQLVTIYDLNHESLTLHEMASGGDPGAVVEKMSMLLKRIKDFVQTEDPEMGAQASTATISTKDNSACPVIPDDFRCPISLDLMKDPVIVATGQTYERGYIEMWLEAGHDTCPKTQQKLANKSLTPNYVLRSLITQWCEANGIEPPKRPAQLRDAPLSCSAAEHSNVLELLQKLSSQNLEDQRGSAGMLRQLAKRSAENRACIGDAGAIPILVSLLSTTDVSTQEHVVTALLNLSIYEENKARIISSGAVPGIVHVLKRGSMEARENSAATLFSLSIVDENKVTIGCSGAIPALVQLLSNGSQRGKKDAATALFNLCIYQGNKGKAVRAGLVPILLELLMETESGMVDEALAILAILSGHPEGKTAIGAASAIPVLVGVIRNGSPRNKENAAAVMVHLCSGEQQQQHLAEAQEQGIVSLLEELAESGTDRGKRKAVQLLERMNRFLKQQSQAEAEAEAMAQAHAQAQAQAQAQPQILVQAQAHADMQAERSLLPTSSDISDR

SEQ ID NO: 19349 - protein, 714 aa, Panicum virgatum
MDEEAKAGPKPDSNANAAAAVEAAAAAPLPPSSSEAAEREAKAEGAAEEEGEVVERLVELVGEIAAISDFRNSYRRQFCNLSRRIRLLVPMLEEAKEAPAPLPAASEAALRRLRDALHGAGELLRLGSSGSKIFLVLEREKIMKSFQDITARLEQALAGISFDELNISDEVREQVELVHAQFKRAKERSDSSDDDLFNDLISVYNSSSSANVDPDILRRLSEKLQLVTIHDLNQESLTLHEMASGGDPGAIVEKMSMLLKRIKDFVQTQDPEMGAQASATDISPKDNSTCPVIPDDFRCPISLDLMKDPVIVATGQTYERGCIERWLEAGHDTCPKTQQKLPSKSLTPNYVLRSLITQWCEANGIEPPKRSAQLSNAPVSCTAAEHNNVFELLQKLSSQNLEDQRGAAGMLRQLAKRSAENRACIGDAGAIPVLVSLLSTTDVSTQEHVVTALLNLSIYEENKARIITSGAVPGIVHVLKRGSMEARENSAATLFSLSIVDENKVTIGASGAIPALVLLLSNGSQRGKKDAATALFNLCIYQGNKGKAVRAGLVPILLELLTETESGMVDEALAILAILSGHPEGKAAIGAASAIPVLVRVIRNGSARSKENAAAVMVHLCNGEQQQQHLAEAQEQGIVSLLEELAESGTDRGKRKAIQLLERMNRFLKQQSQAQAQAEAMAQAQAQAQAQALVQAQGQADMRSLLPTSSHIPD

SEQ ID NO: 19350 - protein, 706 aa, Panicum virgatum
MDEEAKAGPKSDANANAADAVEAAAAAPLPPSSSEAAEREAKAEEEGELVERLVELVGEIAAISDFRNSYRRQFCNLSRRIRLLVPMLEEAKEAPTPLPAASEAALRRLRDALHGAGELLRLGSSGSKIFLVLETEKIMKSFQDITARLEQSLAGISFDELNISDEVREQVELVHAQFKRAKERSDSSDDDLFNDLMSVYNSSSSANVDPDILRRLSEKLQLVTIHDLNQESLTLHEMASGGDPGAIVEKMSMLLKRIKDFVQTQDPEMGAQASATDISPNDNSTCPIIPDDFRCPISLDLMKDPVIVATGQTYERGCIERWLEAGHDTCPKTQQKLPNKSLTPNYVLRSLITQWCEANGIEPPKRSAQLSNAPVSCTAAEHNNVVELLQKLSSQNLEDQRGAAGMLRQLAKRSAENRACIGDAGAIPILVSLLSTTDVSTQEHVVTALLNLSIYEENKARIITSGAVPGIVHVLKRGSMEARENSAATLFSLSIVDENKVTIGASGAIPALVQLLSNGSQRGKKDAATALFNLCIYQGNKGKAVRAGLVPILLELLTETESGMVDEALAILAILSGHPEGKAAIGAASAIPVLVGVIRNGSARSKENAAAVMVHLCNGEQQQQHLAEAQEQGIVSLLEELAESGTDRGKRKAIQLLERMNRFLKQQSQAQAQAEAMAQAQAQALVQAQGQADMRSLLPTSSHIPD

SEQ ID NO: 19351 - protein, 463 aa, Zea mays
MEIVRSQRQVAAAASGGGGGGAGALPTYKAAPQLEVRLEEFELFAIDRLRVLKGISDGLSRGKRPEEMEKLVSELWKTHMRHQDPAENLNKDIISHFVLRLVYCRTEELRKWFLSMETTLFRYRFRLESPETQRMLMTEFQLPYKALPYSEFEAVKDKLSQVARSIGQSASVEHVFFKVPFEEVPDLVAGRRVFLSKGYAYVAMSQVVSLVVTQFRCNISKALALTNRKWTATIKEQEKDRLTPIVEALSNAYFGPDYSQPKDAVDISLKDIDQLAKSSFPLCMRHMLDKLRENHHLKHGGRMQFGLFLKGAGLKLEDALAFWRAEFSQKIGSERFDKEYAYAIRHNYGKEGKRTDYTPYSCQKIISATPGVGDHHGCPFRHFGEENLRAALNKMGVGGHALEEVMDKVKNRHYQVACTLTFEATHGVSCDSGINHPNQYFSESQKVLRAKNQTMESQSQSAT

SEQ ID NO: 19352 - protein, 460 aa, Setaria italica
MEIVPSRRQLDAAAAAGSGGTGALPTYRAAPQLEVRLEEFELFAIDRLRVLKGISDGLSRGKRPEEMEKLVSELWKTHMRHQDPAETLNKDIISHFVLRLVYCRTEELRKWFLSMETTLFRYRFRLETSESQKKLMTDFQLPYKALPRSEFEVVKDKLSQVARSIGQSANVESVFFKVPFEEVPDLVSSRRVFLSKGYAYVAMSQVVSLVVTQFRCNISKALVLTNRKWMATIKEQEKDRLTPIVEALSNAYFGPDYSQPKDAVEISLKDIDQLAKSSFPLCMRHMLDKLRENHHLKHGGRMQFGLFLKGAGLKLEDALAFWRAEFSQKVGSERFDKEYAYSIRHNYGKEGKRTDYTPYSCQKIISATPGVGDHHGCPYRHFGEENLRAALNKMGVSGHALEEIMDKVKNRHYQLACTLTFEATHGVSCDSGINHPNQYFSESQRVLRAKNQTVESKSAT

SEQ ID NO: 19353 - protein, 463 aa, Oryza sativa
MEIVRSHRQIAAEAAAGVGCGGGAGGLPTYRVAPQLEVRLEEFELFAIDRLRVLKGIADGLSRGKRPEEMEKLVKELWKAHMRHQDPTETLNKDIISHFVLRLVYCRTEELRKWFLSMETTLFRYRFRLESPESQRMLMSEFQLPYKALPHSEFEAVKDKLSQVARTIGQSAAVESVFFKVPFEEVPDLVASRRVFLSKGYAYVAMSQVVSLVVTQFRCNISKALVLTNRKWTATIKEQEKDRLTPIVEALSNAYFGPDYSQPKDAVEISLKDIDQLAKTSFPLCMRHMLEKLRENHHLKHGGRMQFGLFLKGAGLKLEDALAFWRAEFSQKVGSERFDKEYAYSIRHNYGKEGKRTDYTPYSCQKIISATPGVGDHHGCPYRHFGEDNLRAALNKMGISGHPLEEIMDKVKNRHYQLACTMTFEAEHGVSCDTGINHPNQYFSESQKVLKAKNQAVQSQGTT

SEQ ID NO: 19354 - protein, 463 aa, Oryza sativa
MEIVRSHRQIAAEAAAGVGCGGGAGGLPTYRVAPQLEVRLEEFELFAIDRLRVLKGIADGLSRGKRPEEMEKLVKELWKAHMRHQDPTETLNKDIISHFVLRLVYCRTEELRKWFLSMETTLFRYRFRLESPESQRMLMSEFRLPYKALPHSEFEAVKDKLSQVARTIGQSAAVESVFFKVPFEEVPDLVASRRVFLSKGYAYVAMSQVVSLVVTQFRCNISKALVLTNRKWTATIKEQEKDRLTPIVEALSNAYFGPDYSQPKDAVEISLKDIDQLAKTSFPLCMRHMLEKLRENHHLKHGGRMQFGLFLKGAGLKLEDALAFWRAEFSQKVGSERFDKEYAYSIRHNYGKEGKRTDYTPYSCQKIISATPGVGDHHGCPYRHFGEDNLRAALNKMGISGHPLEEIMDKVKNRHYQLACTMTFEAEHGVSCDTGINHPNQYFSESQKVLKAKNQAVQSQGTT

SEQ ID NO: 19355 - protein, 463 aa, Secale cereale
MEIVRSQRQLAAAAAAASGGGSGTGGLPTYRVAPQLEVRLEEFELFAIDRLRVLKGISDGLSRGKRPEEMEKLVSELWKAHMRHQDPAETLNKDIISHFVLRLVYCRTEELRKWFLSMENTLFRYRFRLESPESQRLLMSEFQLPYKALPHSEFEAVKDKLSQVARSIGQSASVESVFFKVPFEEVPDLVASRRVFLSKGYAYVAMSQVVSLVVTQFRCNISKALVLTNRKWTATIKEQEKDRLTPIVEALSNAYFGPDYSQPNDATEISPKDIDQLARASFPLCMRHMLEKLRENHHLKHGGRMQFGLFLKGAGLKLEDALTFWRSEFSQKVGSERFDKEYAYSIRHNYGKEGKRTDYTSYSCQKIISATPGVGDHHGCPYRHFGEENLRAALNNMGVGGNALERILDKVKNRHYQLACTMTFEATHGVSCDTGINHPNQYFSESQKVLQAKNQTVQSQLST

SEQ ID NO: 19356 - protein, 462 aa, Brachypodium distachyon
MEIVRSQRQLAAEAAAATGGGGAGALPTYRVAPQLEVRLEEFELFAIDRLRVLKGISDGLSRGKRPEEMEKLVSELWKAHMRHQDPAETLNKDIISHFVLRLVYCRTEELRKWFLSMEMTLFRYRFRLESPESQRLLMSEFQLPYKALPHSEFEAVKDKLSQVARSIGQSASVESVFFKVPFEEVPDLVASRRVFLSKGYAYVAMSQVVSLVVTQFRSNISKALVLTNRKWTSTIKEQEKDRLTPIVEALSNAYFGPDYSQPNDAAEISPKDIDQLARTSFPLCMRHMLEKLRENHHLKNGGRMQFGLFLKGAGLKLEDALTFWRAEFSQKVGSERFDKEYAYSIRHNYGKEGKRTDYTPYSCQKIISATPGVGDYHGCPYRHFGEENLRAALNNMGVSGNALEGILDKVKNRHYQLACTLTFEATHNVSCDTGINHPNQYFSESQKVLQAKNQTVQNQSST

SEQ ID NO: 19357 - protein, 463 aa, Hordeum vulgare
MEIVRSQRQLAAAAAAASGGGSGAGALPTYRVAPQLEVRLEEFELFAIDRLRVLKGISDGLSRGKRPEEMEKLVSELWKAHMRHQDPAETLNKDIISHFVLRLVYCRTEELRKWFLSMENTLFRYRFRLESPESQRLLMSEFQLPYKALPHSEFEAVKDKLSQVARSISQSTSVESVFFKVPFEEVPDLVANRRVFLSKGYAYVAMSQVVSLVVTQFRCNISKALVLTNRKWTATIKEQEKDRLTPIVEALSNAYFGPDYSQKTDAAEISPKDIDQLARTSFPLCMRHMLEKLRENHHLKHGGRMQFGLFLKGAGLKLEDAVTFWRSEFSQKVGSERFDKEYAYGIRHNYGKEGKRTDYTPYSCQKIISATPGVGDHHGCPYRHFGEENLRAALNNMGVSGNALEGILDKVKNRHYQLACTMTFEATHGVSCDTGINHPNQYFSESQKVLQAKNQTVQSQLST

SEQ ID NO: 19358 - protein, 446 aa, Triticum aestivum
SGGGSGAGALPTYRVAPQLEVRLEEFELFAIDRLRVLKGISDGLSRGKRPEEMEKLVSELWKAHMRHQDPAETLNKDIISHFVLRLVYCRTEELRKWFLSMENTLFRYRFRLESPESQRLLMSEFQLPYKALPHSEFEAVKDKLSQVARSIGQSASVESVFFKVPFEEVPDLVASRRVFLSKGYAYVAMSQVVSLVVTQFRCNISKALVLTNRKWTATIKEQEKDRLTPIVEALSNAYFGPDYSQPNDATEISPKDIDQLARTSFPLCMRHMLEKLRENHHLKHGGRMQFGLFLKGAGLKLEDALTFWRSEFSQKVGSERFDKEYAYSIRHNYGKEGKRTDYTSYSCQKIISATPGVGDHHGCPYRHFGEENLRAALNNMGVGGNALEGILDKVKNRHYQLACTMTFEATHGVSCDTGINHPNQYFSESQKVLQAKNQTVQSQLST

SEQ ID NO: 19359 - protein, 456 aa, Avena sativa
MEIVRSQRQLAAAAAASSGGGSGAGGLPTYRVAPQLEVRLEEFELFAIDRLRVLKGISDGLSRGKRQEEMEKLVTELWKAHMRHQDPAETLNKDIISHFVLRLVYCRTEELRKWFLSMETTLFRYRFRIESPDTQRLLMSEFQLPYKALPHSEFEAVKEKLSQVARSIGQSASVESVFFKVPFEEVPDLVGSRRVFISKGYAYVAMSQVVSLVVTQFRCNISKALVLTNRKWTTSIKEQEKDRLTPIVEALSNAYFGPDYSQPSDSAEISSKDIDQLSKTSFPLCMRHMLEKLRENHHLKNGGRMQFGLFLKGAGLKLEDALAFFRAEFSQKVGSERFDKEYAYSIRHKYGKEGKRTDYTPYSCQKIICATPGVGDHHGCPYRHFGDENLRAALNNMGISGNALEGILDKVKNRHYQLACTLTFEATHNVSCDTGINHPNQYFSESQKVLQAKNQT

SEQ ID NO: 19360 - protein, 417 aa, Panicum virgatum
MEIVRSHRQLAAAAAAAAAGGAGALPTYRAAPQLEVRLEEFELFAIDRLRVLKGISDGLSRGKRPEEMEKLVCELWKTHMRHQDPAETLNKDIISHFVLRLVYCRTEELRKWFLSMETTLFRYRFRLESPESQRMLMTEFQLPYKALPHSEFEVVKDKLSQVARSIGQSANVESVFFKVPFEEVPDLVASRRVFLSKGYAYVAMSQVVSLVVTHFRCNISKALVLTNRKWTATIKEQEKDRLTPIVEALSNAYFGPDYSQPKDAVEISLKDIDQLAKSSFPLCMRHMLDKLRENHHLKHGGRMQFGLFLKGAGLKLEDALAFWRAEFSQKVGSERFDKEYAYSIRHNYGKEGKRTDYTPYSCQKIISATPGVGDHHGCPYRHFGDENLRAALNKMGVGGHALEEIMDKVKNRHYQVL

SEQ ID NO: 19361 - protein, 1881 aa, Zea mays
MAPPRVTRKKGKGAGGKTDLRPDRKQFKRHHKEDAAAEQGDGNGERQQSAAPGSAALLAAASDEADFPRGGHSLLSKDEMAEARAEAEQDFEREAKKGKGKRKRSGGESSGFGVDDDLGILFGGATTGKLPRFANRITVKNISPNMKLWGVVIEVNQKDIVLSLPGGIRGFVRSEDVCDIALQENRKDSGNNLCAEVVHVGQLVPCIVLRVDDDSREGKVNKRVWLSLRLSLLYKGLALDGLQEGMVLTAQVKSIEDHGYILHFGVSSFSGFMQKDDKEDVKTERRQLMQCVVKAIDKTRAIVHLSSDEDLLSKSTIKDLKGLSIDHLIPGMMVNARVHSFLENGLMLSFLTYFSGTVDIFNLLNSFPSGNWKDDYSKNKKVNARILFVDPSTRAVGLTLNKHLLHLEVPPINLKAGDIYDKSKVLRVDKKAGLFLEIPSPTPSPGFISIRDVSDKDAKNLEKFKEGSSLRVRILGVRNLEGVAIGTIKDSAFEGSVFTHDDVKPGMLVRAKVATVEPFGAIVQFSSGVKALCPLPHMSELEHVVKPPKKFKVGAELLFRVLGCKSKRVTVTYKKSLVKSKLDVLSSYADAKIGLVTHGWITHIEKHGCFVKFYNGVQGFVSRSDLGLEAGTEAENVYHVGQVVKCRIINVIPASRKLNVSFVISHNRIAPIDTPKLGSIVSGVVERLTPAAVVVSVNGFSKGTILNEHLADHHDTEGQNLVLSAKHSLINCANDIPSEISQMHPGVVVHGYICNIIEAGCFVRFLGHLTGFSPKDKAVDRWIEKLSDAFYVGQSVRSHILSVNAETARVKLALQQSMCSSMDSSFIQGYFLLDQKIAALKYSSNDWARHFGIGSLVEAEVGAIEEYGIILNFKDHLDTVGLIEHHQLGGSSVEVGSSVKGLVLDLSDGVVNLSVKPELIDSVRIVGKKKKRQRAVVADLELHEEVNAVVEIIKDSYMVLSIPEYNYAIGFSPLMDYNSQLLPHHHYDNGQRITVVVGNIPSSDSSGRLILLPKASAQYSSLSDSKRAKKKSGYKIGSLVEAEIIDIKPLELLLKFGGNLHGRIHITEILEEDSAEHPFSELRIGQKLTARIVSEAEPSGKSGKKFKWELSIRPCIVNGEFAQKEQNHTTNGIVRAYVVKVDKEWVWLTVSRNVMAHLFLLDSSSEPSELKEFQQRFSVGQAVKGRVISVNQEKRLLRLKALDNQCTQPNIDETQEPKSSVFGQTKQGDIIGGRVQKILPGVGGLVVQIGPHLHGRVHYTEIVDSWVSEPLSGFHEGQFVKCKVLSVSRSSEGSLRVDLSLRSSNLIRDSNNSRLDDLETCTSRIEKIKDLLPGTEIKGYVKNVNSKGCFIMLSRMVDARITLSNLSDEYVENPQKDFPVGMLVHGRILSTDPSSGRVEASLRKTTGSKLEKLDDISYSDLHVGDIVDGQVKRVESFGLFVTIRRSELVGLCHVSELSDEPVVDINSCYKAGDMVKAKILKIDETRHRVSLGMKKSYFDSDLTADTNDDESALMDISVAPQMVEYHNRNLVHRKAEPRASVLPLQVSLDESEGSDLEDNISNTCLEIANGTEANAKKSDKQLKKEARKQRELEISAMEERALQEDIPQTPDDFEKLVRSSPNSSFIWIKYMATLLDLADVEKARAVAERALKTIIPREEEEKLNVWVAYFNLENEYGSPREDAVKKVFQRALQYCDPKKLHLALLAMYERTEQYELADELLDRMTKRFKTSCKIWLCRIQFALKQGKDVEYIKAIVNRALLSLPHRKRIKFLSQTAILEFKCGVPEEGRSRFELILREYPKRTDLWSVYLDQEIRLGDVEVIRALFERVTCLTLPPKKMQFLFKKYLNFEKSLGKDNERIQLVQQKAIEYVQSSLPSQDNS

SEQ ID NO: 19362 - protein, 1904 aa, Setaria italica
MAPPRGDRKKGKGGGGGKTDLRPDRKQFKKHRKEEAASEQGDCDGEHQQPGSAALLAAASDEADFPRGGRSFLSKDEVAEARAEAEEDFEREGKKGKRKRKAGESSGFGADDDLGTLFGGATTGKLPRFANRITLKNVSPNMKLWGVVIEVNQKDIVLSLPGGMRGFVRSEDVCDIALHENRKDSENSICAEVVHVGQLVPCIVLRVDDDRKEGKVNRRVWLSLRLSQLYKGLSLDALQEGMVLAAQVKSVEDHGYILHFGVPSFSGFMQKADKENVKIEPRQLIQCVVKAIDKTRAIVHLSSDEDLVSKSIIKDLKGLSIDHLIPGMMVNARVHSVLENGVMLSFLTYFSGTVDIFNLSNPFPSGNWKDGYSKNKKVNARILFVDPSTRAVGLTLNKHLLHLEVPPINLKAGDIYDKSKVLRIDKKAGLFLEIPSSTPSPGFISIHDVSDKDVKNLEKKFKEGSSLRVRILGVRNLEGVAIGTVKDSAFEGSVFTHDDVKPGMLVRAKVVTVEPFGAIVQFSSGVKALCPLPHMSELEHVVKPPKKFKAGAELLFRVLGCKSKRVTVTCKKSLVKSKLDVLASYADAKVGLVTHGWIAKIEKHGCFVKFYNGVQGFVSRSELGLEAGTEAENVYHVGQVIKCRIISVLPASRRINVSFVISHNRIIPADIAKLGSIVSGVVERLTPAAVVVSVNGFSKGTILNEHLADHHGQAAQLKNLLKPGHEFNQLLVLDIEGQNLVLSAKHSLINSSNDIPSEILQMHPGALVHGYICNIIEAGCFVRFLGHLTGFSPKDKAVDRRVEKLSDAFYVGQSVRSHILSVNAETARVKLSLQQSMCSSTDSSFIQGYFLLDQKISALKYSSHDWAHAFGIGSLVEGEVGAIEEYGIVLNFNDHPDVVGLIEHHQLSDSTLEVGSSVKGLVLDLSDGVVNLSLKPELISSVRIGGTKKKRQRPTVADLELHEEVNAVVEIVKESYVVLSIPEYNYAIGFASLMDYNSQLLATHRYDNGQRITVVVGNIPSSDPSGRLILLPKASAQDSGLSGSKRAKKKSEYKVGSLVEAEIIDIKPLELILKFGANLHGRIHITEVLEEDSAERPFSKLRIGQKLTARIVAEAEPSGKNGKNFKWELSIRPSMLKGEFEESTAHKEEFNHTTNVVVCGYVVRVDKEWVWLTVSRNVMAHLFILDSSSDPSELKQFQQRFSVGQAVKGCVISVNREKRLLRVKALDNQCAQHNIDKIQQSESSLVEQTKQGDVIGGRVQKILPGVGGLVVQIGPHLHGRVHYTEIVDSWVADPLSGFHEGQFVKCKVLSVSRSSEGSLRVDLSLRSSNIRTDSSNSRLFDEGATCIPRIEKIEDLLPGTEIKGYVKNVNPKGCFIMLSRMVEARITLSNLSDEYVENPQKDFPVGMLVHGRVLSTDPSSGRVEASLRKNTGSKLEKPDDINYSDLHVGDIIDGQVKRVESYGLFVTIRSSELVGLCHVSELSDEPVLDINSRYKAGDMVKAKILKIDEKRHRVSLGMKKSYFDCGLTAGTNDDDEIAPMDISIASQVAGYHNKVHSAAEPRASVLPLQVSLDESEGSDLEDNSNEGHEIANGSEANAKKSDKRLKKEARKQRELEISALEERALQGDIPRTPDDFEKLVRSSPNSSFVWIKYMACLLDLADVEKARAIAERALKTIIPREEEERLNVWVAYFNLENEYGSPREDAVKKVFQRALQYCDHKKLHLALLAVYERTEQYELADELLDRMTKRFKTSCKIWLCRIQFALKQGKDVEYIKAVVNRALLSLPQRKRIKFLSKTAILEFKCGAPEEGRSRFELILREYPKRTDLWSVYLDQEIRLGDIEIIRGLFDKATCLTLPPKKMQFLFKKYLKFEKSLGEDNERIQHVQQIAMKYVQSSLPSESHP

SEQ ID NO: 19363 - protein, 221 aa, Zea mays
MGEEASCNAASAMEAATNARPAKENGRAPAVAEVVAQEAAADPRLQGISDAIRVVPHFPKHGIMFNDITTLLLRPRVFKDAVDLFVERYRGMRIDAVAGIEARGFIFGPAVALAIGAKFIPLRKPRKLPGEVISEKYVLEYGTDCLEMHVGAIERPGERVLITDDLVATGGTLCAAIRLLERAEADVVECACLIGLPKFKDFYKLNGKPVYVLVESRESDK

SEQ ID NO: 19364 - protein, 235 aa, Saccharum officinarum
MGEEASCNAVSAMEAATNAKPAKENGCAPAVTEAAAEAVAAVVAQEEAAPVAAAADPRLQGISDAIRVVPHFPKQGIMFNDITTLLLRPGVFKDAVDLFVERYRGMRIDAVAGIEARGFIFGPAIALAIGAKFIPLRKPRKLPGEVISEKYVLEYGTDCLEMHVGAIERPGERVLIVDDLVATGGTLCAGIRLLERAEADVVECACLIGLPKFKDFYKLNGKPVYVLVESRESDK

SEQ ID NO: 19365 - protein, 229 aa, Setaria italica
MGEEASCNTVSVMEAATNAKPQPQQPKENGRAAAAAVAAEATAPVAEAAADPRLQGISDAIRVVPHFPKEGIMFNDITTLLLRPGVFKDAVDLFVERYRGMGIDAVAGIEARGFIFGPAIALAIGAKFIPLRKPRKLPGEVISEKYVLEYGTDCLEMHVGAIEPAEHVIIVDDLVATGGTLCAAIRLLERAGAEVVECACLIGLPKFKNFYKLNGKPVYVLVESRESDK

SEQ ID NO: 19366 - protein, 217 aa, Panicum virgatum
MGEEASGNAVSVMEAAKQQQPPPKENGLAAAGEAAAAADPRLQGISDAIRVVPHFPKEGIMFNDITTLLLRPGVFKDAVDLFVERYRGMGIDAVAGIEARGFIFGPAIALAIGAKFIPLRKPRKLPGEVISEKYVLEYGTDCLEMHVGAIVPAERVIIVDDLVATGGTLCAAIRLLERAGADVVECACLIGLPKFKNLYKLNGKPVYVLVESRESDK

SEQ ID NO: 19367 - protein, 226 aa, Pennisetum glaucum
MGEEASCNTVSVMEAAKQQPKENGCAAAAGEVVPVAVAEEEAAAPAADPRLQGISDAIRVVPHFPKEGIMFNDITTLLLRPGVFKDAVDLFVERYRGMGIDAVAGIEARGFIFGPAIALSIGAKFIPLRKPRKLPGEVISEKYVLEYGTDCLEMHVGAIEPVERVIIVDDLVATGGTLCAAIRLLERAGADVVECACLIGLPKFKNFYKLNGKPVYVLVESRESDK

SEQ ID NO: 19368 - protein, 215 aa, Zea mays
MGEEASCDAVSLTEAGTNAKPVGKEVGREPAAAPAAAADPRLQGISDAIRVVPHFPKQGIMFNDITTLLLRPRVFKDAVDLFVERYRGMGIDAVAGIEARGFVFGPAIALAIGAKFIPLRKPRKLPGEVISEKYVLEYGTDCLEMRVGAIERSGERVLVIDDLVATGGTLCAAIRLLERAGADVVECACVIGLPKFKDLYKLNGKPVYVLVESRE

SEQ ID NO: 19369 - protein, 222 aa, Cenchrus ciliaris
SCNTASVMEAATNGKPQAKENGCAAAGEAVAVAVAEAAAPAARDPRLQGISDAIRVVPHFPKEGIMFNDITTLLLRPGVFKDALDLFVERYRGMGIDAVAGIEARGFIFGPAIALAIGAKFIPLRKPRKLPGEVISEKYVLEYGTDCLEMHVGAIEPAERVIIVDDLVATGGTLCAAIRLLERAGADVVECACLIGLPKFQNFYKLNGKPVYVLVESRESDK

SEQ ID NO: 19370 - protein, 224 aa, Triticum aestivum
MGEEANCDAVMEAGNGNGKAKENGHATAVLAMPDVKADDAVVAPADPRLQGISDAIRVVPHFPKQGIMFNDITTLLLRPGVFKDAVDMFVERYRGMGIAAVAGIEARGFIFGPAIALAIGAKFIPLRKPKKLPGEVISETYVLEYGTDCLEMHVGAIEPRERVLIVDDLVATGGTLCAAINLLERAGADVVECACLIGLPKFKDFYKLNGKPVYVLVESLEYEK

SEQ ID NO: 19371 - protein, 224 aa, Hordeum vulgare
MGEEANCNAVMEAANGNGNGKVKENGHAVVAMPDVKADDAVVAPADPRLQGISDAIRVVPHFPKPGIMFNDITTLLLRPGVFKDAVDIFVERYRGMDIAAVAGIEARGFIFGPAIALAIGAKFIPLRKPKKLPGEVISETYVLEYGTDCLEMHVGAIEPRERVLIVDDLVATGGTLCAAINLLERAGADVVECACLIGLPKFKDFYKLNGKPVYVLVESLEYEK

SEQ ID NO: 19372 - protein, 227 aa, Brachypodium distachyon
MGEEASCNTVMEVTTKAKENGHAVPVPVPVPDDDAKAKAADAVAAPAETTTDPRLQGISDAIRVVPHFPKQGIMFNDITTLLLRPGVFKDAVDIFVERYRGMGIAAVAGIEARGFIFGPAIALAIGAKFIPLRKPKKLPGEVISETYVLEYGTDCLEMHVGAIEHGERVLIVDDLVATGGTLCAAINLLERAGADVIECACLIGLPKFKDFYKLNGKPVYVLVESLE

SEQ ID NO: 19373 - protein, 490 aa, Zea mays
MPTLRSATANASPVATPSPAAASTPRSVKRRLTPGRAGESPKASRHTSPHRSPHAGTGTVCIPKLLSASPKSSRKRLYGDLVAAEKPKWNPRDAAQIRAVKEALHVATVPSSELVCRDNELRRVLEFCKVCVQQEKAGSLYVCGCPGTGKTLSINKVKDSLVCWADEMGMETPDALAINCTNLANTSEIFGKILGKLQNQKKGSSKLLPLQQLQSMFSNKDLAPRRMMLVIVDEMDYLITRDRAVLHDLFMLTTYPFSRCILIGIANAIDLADRFLPKLESLNCKPLVVTFRAYSKDQITDIVKHRLKVLEYDVFEPLALEFCARKVAAASGDMRKALGVCRSAVEVLEARLHDSPDQELGIVTFDHMDMALSKAFKSAVVDSILCLPQHQQMVLCALANTFQHCKKKATTLGELNKSYIEICRSTQVPAVGMLEFSNMCMVLSDQGFMKLGQSKEDKLRRVTLQIDSSDITFAFKGNRFFQKCLEQPRC

SEQ ID NO: 19374 - protein, 489 aa, Setaria italica
MPTLRSATASASPAATPSPAAASTPRSVKRRLTPGRAGESPKASRHTSPHRSPHAGAGTACTPKLLSASPKSSRKRLYGDLVAAEKPKWNPRDPAQMRAVKEALHVATVPSCELVCRDNEQRRVFEFCKACIEQEKAGSLYICGCPGTGKTLSVNKVKESLGRWADEMGMETPDSLAINCTNLANTSEIFSKILGQFQNRKKGSSKLSPLQQLQSMFSNEESAPRRMMLVIVDEMDYLITRDRAVLHDLFMLTTCPYSRCILIGIANAIDLADRFLPKLESLNCKPFAVTFRAYSKDQISDIIKHRLKVLEYDVFEPLALEFCARKVAAATGDMRKALGVCRSAVEVLETRLQDSDQELGIVTFDHMDIALSKAFKSPIVDSILCLPQHQQMVLCALANTFQHCKKKATTLGELNKSYIEICRSTQVPAVGMLEFSNMCMVLSDQGFMKLGQSKEDKLRRVTLQIDISDIGFAFKGNRFFQKCLKQPRC

SEQ ID NO: 19375 - protein, 489 aa, Panicum virgatum
MPTLRSATASSSPAATPSPGTASTPRSVKRRLTPGRAGKSPDASRHTSPHRSPHAGAGTVCSPKLLSASPKSSRKRLYGDLVAAEKPKWNPRDPAQMRAIKEALHVATVPSCELVCRDNEQRRVFEFCKSCVEQEKAGSLYICGCPGTGKTLSINKVKESLMRWADEMGMEAPDSLAINCTNLSNTSEIFSKILGQFQNRKKGSNKLSPLQQLQSMFSNKESAPRRMMLVIVDEMDYLITRDRAVLHDLFMLTTCPYSRCILIGIANAIDLADRFLPKLESLNCKPLVVTFRAYSKDQISDIIKHRLKVLEYDVFEPLALEFCARKVAAATGDMRKALGVCRSAVEVLEARLQDSDQELGIVTFDHMDIALSKAFKSPIVDTIMCLPQHQQMVLCALANTFQHCKKKATTLGELNKSYIGICRSTQVPAVGMLEFSNMCMVLSDQGFMKLGQSKEDKLRRVTLQIDISDIGFAFKGNRFFQKCLEQPRC

SEQ ID NO: 19376 - protein, 478 aa, Panicum virgatum
MPTLRSATAGASPAAASTPRSVKRRLTSPDAPRHTSPHRSPHAGAGTVCTPKLLSTSPKSSRKRLYGDLVAAEKPKWHPRDPAQMRAVKEALHVATVPSCELVCRDNEQRRVFEFCKACVQQAKAGSLYVCGCPGTGKTLSINKVKESLVCWADELGMETPDSLAINCTNLANTSEIFSKILGQFQNRKKVTSKLSPLQQLQSMFSNKESAPRRMMLVIVDEMDYLITRDRAVLHDLFMLMTCPYSRCILIGIANAIDLADRFLPKLESLNCKPLVVTFRAYCKDQICDIIKHRLKVLEYDVFEPLALEFCARKVAAATGDMRKALGVCRSAVEVLEARLQDSSDQELGIVTFDHMDIALSKAFKSAVVDSILPLPQQQQMVLCALANTFQHCKRKAITLGELNKSYIEICRSTQVPAVGMLEFSNMCMILSDQGFMKLGQSKEDKLRRVTLQIDISDIGFAFKGNRFFQKCLEQPRC

SEQ ID NO: 19377 - protein, 490 aa, Brachypodium distachyon
MPTLRSATSSPVKAATVSPTAVTTPRSAKRRLTSRRAAESPDSPQFTSPGISPLAGFGTICTPKMLSASPKSSRKRLYGDLVAAEKPKWNPRDPAQMQAVKEALHVGTVPSCGLVCRDDEQMRVFDFCKACVEQERAGSLYVCGCPGTGKTLSINKVKESVSCWADKMGIETPDDLSINCTSLGKTSDIFIKILEKLHVRKKASGKLSPLQQLQRMFSHKESAPRRMLLVIVDEMDYLITRDRAVLHDLFMLTTQQFSRCILIGIANAIDLADRFLPKLESLNCKPLVVTFRAYSKDQISNIINHRLKVLEYNVFEPLALEFCARKVAAASGDMRKALGVCRSAVEIFESKLQDSSDQEFGVVTFDHMDIALSKVFKSPVVDSILCLPQHQQMVLCALANTFQHCKKKVTTLGELNKSYIEICRSTQVPGIGMLEFSNMCMILSDQGYLKLGQSKEDKLRRVTLQIDISDITFAFKGNRFFQKCLEQPKF

SEQ ID NO: 19378 - protein, 411 aa, Zea mays
MGIKGLTKLLAQHAPTAAVQRRVEDYRGRVIAVDASVSIYQFLAVVGRKGSELLTNEAGEITSHLQGMLNRTIRMLEAGIKPVFVFDGEPPEMKKKELAKRSLKRDDAIKDLNRAMEIGDENAIEKFSKRTVKVTGRHNDDCKRLLRLMGVPVVEAPGEAEAQCAALCENHQVYAVASEDMDTLTFGARRFLRHLTDLGYKKSPVTEFDVSKVLEELGLTMDQFIDLCILSGCDYCENIRGIGGQRALKLIRQHGCIEEVLQNLNQTRFSVPEDWPYQEVRTLFKEPNVCAGIPDFTWTSPDPEGLMDFLSTENSFSPDRVTKAVEKIKVARDRYSPGRMKHLTPVASLRGSHTEKEPQCILGSPGQTLKVMSSPQVCKSPSSGFRYGSSKPFMLGRQSGFHGMPYALSFI

SEQ ID NO: 19379 - protein, 410 aa, Setaria italica
MGIKGLTKLLAEHAPRAAVQRRVEDYRGRVISVDASLSIYQFLIVVGRKGSELLTNEAGEVTSHLQGMLNRTVRMLEAGIKPVFVFDGEPPEMKKKELAKRSLKRNDATKDLNRAMEIGDEDSIEKFSKRTVKVTKKHNDDCKKLLRLMGVPVVEAPGEAEAQCAALCETHQVYAVASEDMDSLTFGARRFLRHLTDLGYKKSPVTEFEVSKVLEELGLTMDQFIDLCILSGCDYCENIKGIGGQRALKLIRQHGCIEEVLQNLKQTRFSVPEDWPYQEVRTLFKEPNVCTGIPDFMWTSPDSKGLMDFLSTENSFSPDRVAKAVEKIKAARDRYSPGRLKLLTPVASLPGSHTEKEPTCTLGSTGQSLKVRSAQVCKSSGPGFRYGSSKPFMLGMQSGFHGRPCAFSFI

SEQ ID NO: 19380 - protein, 418 aa, Panicum virgatum
GLTKLLAEHASRAAVQRRVEDYRGRVIAVDASLSIYQFLIVVGRKGSELLTNESSEVTRQEISLALFMVCHLQGMLNRTVRMLEAGIKPVFVFDGEPPEMKKKELAKRSLKRNDATKDLNRAIEIGDEDLVEKFSKRTVKVTKKHNDDCKRLLRLMGVPVVEAPGEAEAQCAALCENHQVYAVASEDMDSLTFGARRFLRHLTDLGYKKSPVTEFEVSKVLEELGLSMDQFIDLCILSGCDYCENIKGIGGQRALKLIRQHGCIEEVVQNLKQTRFNVPEDWPYQEVRTLFKEPNVCTEIPDFMWTSPDSQGLMDFLSTENSFSPDRVAKAVEKITVARDKYSPGRLKLLTPVSSLPGSYTEKEPTCILGSPGQGLKIRSAPQVCNSSSSGLRYASSKPFMLGMQSGFHGRPYAFSSL

SEQ ID NO: 19381 - protein, 413 aa, Brachypodium distachyon
MGIKGLTKLLAEHAPRAAAQRRVEDYRGRVIAIDASLSIYQFLVVVGRKGTEVLTNEAGEVTSHLQGMLNRTVRLLEAGIKPVFVFDGEPPDLKKRELAKRSLRRDDASEDLNRAIEVGDEDSIEKFSKRTVKITKKHNDDCKKLLRLMGVPVVEAPGEAEAQCASLCKNHKAYAVASEDMDSLTFGSLRFLRHITDLSFKRSPVTEFEVPKVLEELGLTMDQFIDLCILSGCDYCENIKGIGGQRALKLIRQHGCIEEVVQNLNNRFTVPEDWPYQEVRTLFKEPNVCTEIPDFQWTSVDKEGIVNFLAIENSFSSDRVEKAVQKIKAARDRYSPGRVKLLTPVANLSGSITKKEPECVLGSSGQGLKSWSALQVCRSSSSDFRYRSYYSSKPLVLGRQSGFHGIPHAFSLI

SEQ ID NO: 19382 - protein, 412 aa, Secale cereale
MGIKGLTKLLSEHAPRAAVQRRVEDYRGRVIAIDASLSIYQFLVVVGRKGTEVLTNEAGEVTSHLQGMLNRTVRLLEAGIKPVFVFDGEPPDLKKKELAKRSLKRDDASKDLHRAIEGGDEDSVEKFSKRTVKITKEHNDGCKRLLRLMGVPIVEAPGEAEAQCASLCKNHKAYAVASEDMDTLTFGAPRFLRHVTDLSFKKSPVTEFEVPKVLEELGLTMDQFIDLCILSGCDYCENIKGIGGQRALKLIRQHGCIEEVVQNLHKRYTVPEDWPYQEVRTLFKQPNVCTEIPDFQWTSADKEGLVNFLAFENSFSSDRVEKAVEKIKAASDKYSPAGRAKLLTPVANLSGSTEKESKCVLGASGQGLRSRTAVQVCSSSSSGFRYGSSSSKPLVLGRQSGVHVKPPTFSFI

SEQ ID NO: 19383 - protein, 412 aa, Triticum aestivum
MGIKGLTKLLAEHAPRAAVKRRVEDYRGRVIAIDASLSIYQFLVVVGRKGTEVLTNEAGEVTSHLQGMLNRTVRLLEAGIKPVFVFDGEPPDLKKKELAKRSLKRDDASKDLHSAIEVGDEDSVEKFSKRTVKITKEHNDGCKRLLRLMGVPIVEAPGEAEAQCASLCKNHKAYAVASEDMDTLTFGAPRFLRHVTDLSFKKSPVTEFEVPKVLEELGLTMDQFIDLCILSGCDYCENIKGIGGQRALKLIRQHGCIEEVVQNLHKRYTVPEDWPYQEVRTLFKQPNVCTEIPDFQWTSADKEGLVNFLAFENSFSSDRVEKAVEKIKAASDKYSPAGRAKLLTPVANLSGSTEKESKCVLGASGQGLRSRTAVQVCSSSSSGFRYGSSSSKPLVLGRQSGVHVKPPTFSFI

SEQ ID NO: 19384 - protein, 1485 aa, Glycine max
MSWEDEIVMRDVTNAGLVISDRIGREVSSQLDLEEALEASRYASHPYSTHPREWPPLVEVVNTWELPPVLIERYNAAGGEGTAFCGIFPEIRRAWASVDNSLFLWRFDKWDGQCPEFSGEEQAICAVGLAKSKPGVFVEAIQYLLVLATPVELILVGVCCSGGADGSDPFAEVTLQPLPEHTIPSDGVTMTCVACTNKGRIFLAGRDGHIYEILYSTGSGWQKRCRKICITAGLGSVISRWVIPNVFSFGAVDPIVEMVFDNERQILYARTEEMKLQVYVLGPNGDGPLKKVAEERNLVNQRDAHYGARQSTGSRVSSRSPKPSIVCISPLSTLESKWLHLVAVLSDGRRMYLSTSPSSGSLTGFNTNHHKPSCLKVVTTRPAPPWGVSGGLTFGAMALAGRPPNEDLSLKVEAAYYSAGTLILSDASPSTMSSLLVLNRDSSSQSSPSGNLGTSTRSSRALRESVSSLPVEGRMLSVADVLPLPDTAATVQSLYSEIEFGGYESSMESCERVSGKLWARGDLATQHILPRRRIVVFSTMGMMEIVFNRPLDIIRRLLESNSPRSVLEDFFNRFGAGEAAAMCLMLAARIVHSENLISNVIAEKAAEAFEDPRVVGMPQLEGSNALSNTRSAAGGFSMGQVVQEAEPVFSGAHEGLCLCSSRLLFPLWELPVMVVKGSLGPSGTLSENGVVVCRLSVGAMQVLEQKLRSLEKFLRSRRNQRRGLYGCVAGLGDLSGSILYGNGSALGAGDRNMVRNLFGAYSRNMESNGGRTSNKRQRLPYSPAELAAMEVRAMECIRQLLLRSGEALFLLQLLSQHHVTRLIQGFDSNLQQALVQLTFHQLVCSEEGDHLATRLISVLMEYYTGPDGRGTVDDISRRLRDGCPSYYKESDYKFFLAVEALERAAMTIDAKDKENLAREAFNSLSKVPESVDLRTVCKRFEDLRFYEAVVRLPLQKAQAIDPAGDAYNDEIDATVREQALAQRGQCYEIIIGALRSLKGDTLQREFGTPIRSTASQSALDPASRKKYICQIVQLGVQSPDRIFHEYLYQAMIDLGLENELLEYGGPDLLPFLQSAGRNSLHEVRAVTATISPVGQSGAPMSSNQVKYYELLARYYVLKRQHMLAAHALLRLAERRSIDGVPTLELRCQYLSNAVLQAKNATNSDGLVGSGRSSIDSGFLDLLEGKLAVLRFQIKIKEELESVASRSDVLPATPDSAENGVVPEGSSTADANFANATREKAKELASDVKSITQLYNEYAVPFGLWEICLEMLYFANFSSDTDSSIVRETWARLIDQAISRGGIAEACSVLKRVGPRIYPGDGAVLPLDIICLHLEKAGLERLNSGVEAVGDEDVARALVSACKGAAEPVLNAYDQLLSNGAILPSASVRLRMLRSVLVVLREWAMSVYSQRMGSSAAGHSLILGGGFSSERTIASQGIRDKITSAANRYMTELRRLALPQNQTEHVYRGFRELEESFISQHSFDRF

SEQ ID NO: 19385 - protein, 1484 aa, Cajanus cajan
MSWEDEIVMRDVTNAGLVVSDRIGREVSSQLDLEEALEASRYASHPYSTHPREWPPSVEVVNTWELPPVLIERYNAAGGEGTAFCGIFPEIRRAWASVDNSLFLWRFDKWDGQCPEYSGEEQAICAVGLAKSKPGVFVEAIQYLLVLATPVELILVGVCCSGGADGSDPFSEVTLQPLPEHTIPSDGVTMTCVACTDKGRIFLAGRDGHIYEVLYSTGSGWQKRCRKICITAGLGSVISRWVIPNVFNFGAVDPIVELVFDNERQILYARTEEMKLQVYVLGPNGDGPLKKVAEEKNLVNLKDAHYGARQSTGSRVSSRSPKPSIVCISPLSTLESKWLHLVAVLSDGRRMYLSTSPSSGSLTGFNTNHHKPSCLKVVTSRPAPPWGVSGGLTFGTMALAGRPQNEDLSLKVEAAYYSAGTLILSDASPSTMPSLLVLNRDSSTQSPSGNLGTSTRSSRALQESVSSLPVEGRMLSVADVLPFPDTASTVHSLYSEIEFGGYESSMESCERVSGKLWARGDLSTQHILPRRRIVVFSTMGMMEIVFNRPLDILRRLLESTSPRSVLEDFFNRFGAGEAAAMCLMLAARIVHSENIISNVIAEKAAEAFEDPRVVGMPQLEGSSALSNTRSAAGGFSMGQVVQEAEPVFSGAHEGLCLCSSRLLFPLWELPVMVVKGNLGPSGTLSENGVVVCRLSVGAMQVLEQKLRSLEKFLRSRRNQRRGLYGCVAGLGDVSGSILYGNGSALGAGDRNMVRNLFGAYSRHMESNGSITTNKRQRLPYSPAELAAMGVRAMECIRQLLLRSGEALFLLQLLSQHHVTRLIQGFDSNLQQALVQLTFHQLVCSEEGDHLATRLISALMEYYTGPDGRGTVDDISRRLRDGCPSYYKESDYKFFLAVEALERAAMTIDAEDKENLAREAFNSLSKVPESVDLRTVCKRFEDLRFYEAVVRLPLQKAQALDPAGDAYNDEIDETVREQALAQREQCYEIIISALRSLKGDTLQKEFGSPIRSSVSQSALDPASRKKYICQIVQLGVQSPDRIFHEYLYQAMIDLGLENELLEYGGPDLLPFLQSAGRKPIQEVRAVTATTSPVGQSGAPMSSNQVKYYELLARYYVLKRQHMLAAHALLRLAERRSTEGVPTLEQRCQYLSNAVLQAKNASNGDGLVGSARSSIDSGFLDLLEGKLAVLRFQIKIKEELESMASRSDALPSTSDSAQNGMVLEGSSTVDTNFANATREKAKELASDVKSITQLYNEYAVPFGLWEICLEMLYFANYSGDTDSSIVRETWVRLIDQAISRGGIAEACSVLKRVGPRIYPGDGAVLPLDIICLHLEKAGLERLNSGVESVGDEDVARALVSACKGAAEPVLNAYDQLLSNGAILPSPSVRLRMLRSVLVVLREWAMSVNSQRMGTSAAGHSLILGGGFSSERAVASQRARDKITSLANRYMTEVRRLALPQNQTEHVYRGFKELEESFISQHSFDRF

SEQ ID NO: 19386 - protein, 1485 aa, Phaseolus vulgaris
MSWEDEIVMRDVTNAGLVVSDRIGREVSSQLDLEEALEASRYTSHPYSTHPREWPPSVEVVNTWELPPVLIERYNAAGGEGTAFCGIFPEIRRAWASVDNSLFLWRFDKWDGQCPEFSGEEQAICAVGLAKSKPGVFVEAIQYLLVLATPVELILVGVCCSGGADGSDPFAEVTLQPLPEHTISSDGVTMTCVACTDKGRIFLAGRDGHIYEVLYSTGSGWQKRCRKICITAGFGSVISRWVIPNVFNFGAVDAIVEMVFDSERQILYARTEEMKIQVYVIGPNGDGPLKKVAEEKNLVNQRDAHYGARQSTGSRVSSRSPKPSIVCISPLSTLESKWLHLVAVLSDGRRMYLSTSPSSGSLTGFNTNHHKPSCLKVVTTRPAPPWGVSGGLTFGAMALGGRPQNEDLSLKIEASYYSAGTLILSDASSSTMPSLLVLNRDSSTQSLPSGNLGTGTRSSRALRESVSSLPVEGRMLSVADVLPLPDTAATVQSLYSEIEFGGYESSMESCEKVSGKLWARGDLSTQHILPRRRIVVFSTMGMMEIAFNRPLDILRRLLESNTPRSVLEDFFNRFGAGEAAAMCLMLAARVVHSENLISNVIAEKAAEAFEDPRVVGMPQLEGSNALSNTRSAAGGFSMGQVVQEAEPVFSAAHEGLCLCSSRLLFPLWELPVMVVKGNLGPSGALTENGVVVCRLSVGAMQVLEQKLRSLEKFLRSRRNQRRGLYGCVAGLGDLSGSILYGNGSTLGAGDRNMVRNLFGAYSRNMESNGNRTTNKRQRLPYSPAELAAMEVRAMECIRQLLLRSGEALFLLQLLSQHHVTRLIHGFDSSLQQTLVQLTFHQLVCSEEGDQLATRLISALMEYYTGPDGRGTVDDISRRLRDGCPSYYKESDYKFFLAVEALERAATTIDSEDKENLAREAFNSLSKVPESVDLRTVCKRFEDLRFYEAVVRLPLQKAQALDPAGDAYNDEIDAPVREQALARREQCYEIIINALRSLKGDTLQKEFGSPIRSTVSQSALDPSSRKKYICQIVQLGVQSPDRIFHEYLYQAMIDLGLENELLEYGGPDLLPFLQSAGRKPIHEVRAVTATTSPMGQSGAPMSTNQVKYYELLARYYVLKRQHMLAAHALLRLAERRSIDGVPTLEQRCQYLSNAVLQAKNATNSDGLLGSGRSSIDSGFLDLLEGKLAVLRFQIKIKEELESMASRSDVLPSTSGSTENGVIPEGSSTDVDIVNATREKAKELASDVKSITQLYNEYAVPLGLWEICLEMLYFANYSGDTNSSIVRETWARLIDQAISRGGIAEACSVLKRVGPRLYPGDGAVLPLDIICLHLEKAGLERLNSGVEAVGDEDVARALVSACKGAAEPVLNAYDQLLSNGAILPSPSVRLRMLRSVLVVLREWAMSVYSQRIGSSVAGHSSLILGGGFSSERAVASQGIRDKITSAANRYMTEVRRLALPQNQTEHVYRGFRELEESFISQHSFDRF

SEQ ID NO: 19387 - protein, 1485 aa, Cicer arietinum
MSWEDEIVIRDVTNAGLVVSDRIGREVSSQHDLEEALEASRYASHPYSTHPREWPPLVEVANTWELPPVLIERYNAAGGEGTAFCGIFPEIRRAWASVDNSLFLWRFDKWDGQCPEYSGEEQAICAVGLAKSKPGVFVEAIQYLLILATPVELIIVGVCCSGGADGSDPFAEVSLQPLPDYTIPSDGVTMTSVACTDKGRIFLAGRDGHIYELLYSTGSGWQKRCRKICVTAGLGSVISRWVIPNVFNFGAVDPVVEMVFDNERQILYARTEEMKLQVYVLGPIGDGPLKKVAEERNLINQKDAHHGGRQSNGSRVSSRSPKASIVCISPLSTLESKWLHLVAVLSDGRRMYLSTSPSSGSLTGFNTTHPKPSCLKVVTTRPAPPWGVSGGLTFGTMALAGRPQNDDLSLKVEAAYYSSGTLILSDASPPTMPSLLLLNRDSTTQSSASGNLGTGTRSSRALRESVSSLPVEGRMLAVADVLPLPDTSATVQSLYSEIEFGGYESSMESCERASGKLWARGDLSTQHILPRRRIVIFSTMGMMEIVFNRPLDILRRLLESNSPRSVLEDFFNRFGAGEAAAMCLMLAARIVHSENLISNVIAEKAAEAFEDPRLVGMPQLEGSNALSNTRTAAGGFSMGQVVQEAEPVFSGAHEGLCLCSSRLLFPLWELPVMVVKGSLGASGTSYENGVVVCRLSIGAMQVLELKLRSLEKFLRSRRNQRRGLYGCVAGLGDLSGSILYGTGSALGADDRSMVRNLFGAYSRNMESNGGGATNKRQRLPYSPAELAAMEVRAMECIRQLLLRSGEALFLLQLLSQHHVTRLIQGFDANLQQALVQLTFHQLVCSEEGDRLATRLISALMEYYTGPDGRGTVEDISKRLREGCPSYYKESDYKFFLAVEALERAAVTIDDEEKENLAREALNSLSKVPESADLRTVCKRFEDLRFYEAVVCLPLQKAQAIDPAGDAYNDEIDATVREQALARREQCYEIIISALRSLKGDTLRKEFGSPIRSASQSALDPASRKKYISQIVQLGVQSPDRIFHEYLYQAMIDLGLENELLEYGGPDLLPFLQSAGRKTIHEVRAVTATTSPMGQSGAPMSSNQVKYYELLARYYVLKRQHMLAAHALLRLAGRPSIDGVPTLEQRCQYLSNAVLQAKNASNSDGLVASTRGSSDSGLLDMLEGKLAVLRFQIKIKEELEAMASSSEVLHSTPGSVENGLGPETSSAVDADFANATREKAKELSSDLKSITQLYNEYAVPFKLWETCLEMLYFANYSGDSDSSIVRETWARLIDQAISRGGIAEACSVLKRVGPRLYPGDGTVLQLDIICLHLEKAGLERLNSGVESVGDEDVARALVSACKGAAEPVLNAYDQLLSNGAILPSPNLRLRMLRSVLVVLREWAMSVYSQRMGTGATGSSLILGGGGFSLERTVASQGIRDKITSVANRYMTEVRRLALPQSQTEVVYRGFKELEESLISPHSFGRF

SEQ ID NO: 19388 - protein, 1484 aa, Medicago truncatula
MSWEDEIVIRDVTNAGLVVSDRIGREISSQLDLEESLEASRYASHPYSTHPREWPPLVEVANTWELPPVLIERYNAAGGEGTAFCGIFPEIRRAWASVDNSLFLWRFDKWDGQCPEYSGEEQAICAVGLAKSKHGVFVEAIQYLLILATPVELILVGVCCSGGADGSDPFAEVSLQPLPDYTIPSDGVTMTSVACTDKGRIFLAGRDGHIYELIYSTGSGWQKRCRKVCVTAGLGSVISRWVIPNVFNFGAVDPVVEMVFDNERQILYARTEEMKLQVYVLGPIGDGPLKKIAEERNLVNHKDAHHGGRQSSGSRVSSRSPKPSIVCISPLSTLESKSLHLVAVLSDGRRMYLSTSPSSGSLNGFNTSHHKPSCLKVVTTRPSPPWGVSGGLTFGTMALAGRPQNEDLSLKVEAAYYSAGTLILSDASPPTMPSLLVLNRDSSTQSSPSGNLGTGTRSSRALRETVSSLPVEGRMLSVADVLPLPDTSATVQSLYSEIEFGGYESSMESCERASGKLWARGDLSTQHILPRRRIVIFSTMGMMEIVFNRPLDILRRLLESSSPRSVLEDFFNRFGAGEASAMCLMLASRIVHSENFISNVIAEKAAEAFEDPRLVGMPQLEGSNALSNTRTAAGGFSMGQVVQEAEPVFSGAHEGLCLCSSRLLFPLWELPVMVIKGSLSASGTSFENGVVVCRLSIEAMQVLEHKLRSLEKFLRSRRNQRRGLYGCVAGLGDVSGSILYGGGSALGAGDRSMVRTLFGAYSKNMESNGGGAANKRQRLPYSPAELAAMEVRAMECIRQLLLRSGEALFLLQLLSQHHVTRLIQGFDANLQQALVQLTFHQLVCSEEGDHLATRLISALMEYYTGTDGRGTVDDISKRLREGCPSYYKESDYKFFLAVEALERAAVTIDDEEKETLAREALNALSKVPESADLRTVCKRFEDLRFYEAVVCLPLQKAQAIDPAGDAYNDEIDATVREQALAQREQCYEIIISALRSLKGDPSRKEFGSPIGSASQSALDPASRKKYISQIVQLGVQSPDRIFHEYLYQAMIDLGLENELLEYGGPDLLPFLKSAGRTPIHEVRAVTATTSPMGQSGAPMSSNQVKYFELLARYYVLKRQHMLAAHALLRLAGRPSTDGVPTLEQRCQYLSNAVLQAKNATNSDGLVSSTRSSSDTGLLDMLEGKLAVLRFQIKIKEELEHMASSSEVLHSTSNSVENGLVSDASPTVDANFANATREKAKELSSDLKSITQLYNEYAVPFKLWETCLEMLYFANYSGDSDSSIVRETWARLIDQAISGGGIAEACSVLKRLGPRLYPGDGTVFQLDIICLHLEKAALERLNTGVESVGDEDVARALVSACKGAAEPVLNAYDQLLSNGAILPSPNLRLRMLRSVLVVLREWAMSIYSHRMGTGATGSSIIIGGGFSLERTVASQGIRDKITSVANRYMTEVRRLALPQSQTEGVYCGFKELEESLISPHSFDRF

SEQ ID NO: 19389 - protein, 1378 aa, Lotus japonicus
VVNTWELPPVLIERYNAAGGEGTAFCGIFPEIRRAWASVDNSLFLWRFDKWDGQCPEYSGEEQAICAVGLAKSKPGVFVEAIQYLLILATPVELILVGVCCSGGADDSDPFEEVSLQPLPEYTIPSDGVTMTCVSCTDKGRIFLAGRDGHIYELLYSTGSGWQKRCRKICVTAGLGSVISRWVIPNVFNFGAVDPIVEMVFDNERQILYARTEEMKLQVYVLGPNGDGQLKKVAEEKNLVNQRDAQGRQSTGSRVSSRLPKPSIVCISPLSTLESKLLHLVAVLSDGRRMYLSTSPSSGSLTGFNTNHHKPSCLKVVATRPAPPWGVSGGLTFGTMALAGRPQNEDLSLKVDAAYYSTGTLILSDASPSTIPSLLVLNRDSSTQSSSSGNLGTGMRSSRALRESVSSLPVEGRMLSVADVLPLPDTAATVRSLYSEIEFGGYENSMESCERASGKLWSRGDLSTQHILPRRRIVIFSTMGMMEIVFNRPLDILRRLLESNSPRSVLEDFFNRFGAGEAAAMCLMLAARIVHSENLISNVIAEKAAEAFEDPRVVGMPQLEGSSALSNTRTAAGGFSMGQVVQEAEPVFSGAHEGLCLCSSRLLFPLWELPVMVVKGSLGPSGTLSENGVVVCRLSVGAMQVLELKLRSLEKFLRSRRNQRRGLYGCVAGLGDVSGSILYGNGSALGAGDRSMVRSLFGAYSRNMESNGGGTTNKRQRLPYSPAELAAMEVRAMECIRQLLLRSGEALFLLQLLSQHHVTRLIQGFDANLQHALVQLTFHQLVCSEEGDRLATRLISALMEYYTGPDGRGTVDDISRRLREGCPSYYKESDYKFFLSVEALERAAVTVDAEEKENLAREALNSLSKVPESADLRTVCKRFEDLRFYEAVVCLPLQKAQALDPAGDAYNDDIDATVREQALVQREQCYEVIISALRSLKGDTLQKEFGSPIRSAASQSALDPASRRKYISQIVQLGVQSPDRIFHEYLYQAMIDLGLENELLEYGGPDLLPFLQSAGRKPIHEVRAVTATTSPIGQSGAPLSSNQVKYYELLARYYVLKRQHMLAAHALLRLAERRSIDGVPTLEQRCQYLSNAVLQAKNATNNDGLVGSTRSSFDIPEGSSTADPNFANAIREKAKELSSDVKSITQLYNEYAVPFELWEICLEMLYFANYSGENDSSIVRETWARLIDQAISRGGIAEACSVLKRVGPRIYPGDGAVLPLDIICLHLEKAGLERLNSGVEPVGDEDVARALVSACKGSAEPVLNAYDQLLSNGAILPSPNLRLRLLRSVLVILREWATSVYSHRMGIGASPSRVLEGGFSLERTVASQGIRDKITSAANRYMTEVRRLALPQNQTEVVYRGFRELEESVISPHSFNRF

SEQ ID NO: 19390 - protein, 1490 aa, Prunus persica
MSWEDEIVMRDVTNAGLVVSDRIGREVSSQLDLEEALEASRYASHPYSTHPREWPPLVEVVDTWELPGVLIERYNAAGGEGNSLCGIFPEIRRAWASVDNSLFLWRFDKWDGQCPEYSGEDQAICAVGLAKSKPGVFVEAIQYLLILATPVELILVGVCCSGGADGTDPYAEVSLQPLPEYTVPSDGITMTCITCTDKGRIFLAGRDGHIYELHYTTGSGWQKRCRKVCLTAGLGSVISRWVVPNLFKFGAVDPIIEMVFDNERHILYARTEEMKLQVFIVGQNVDGPLKKVAEERNLINQRDAHYGGRQSTGPRGPNRSTKSSIVCISPLSTLESKSLHLVAVLSDGRRMYLTTSPSSGNLGGFNTNHKPSCLKVVTTRPSPPLGVGGGLAFGSMSLAGRPQNDDLSLKVEAAYYSAGTLVLSDSSPPTMASLLLVSRDSSTQSAGSSTSGTSSRSSRALRESVSSLPVEGRMLFVADVFPLPDTATTVQSLYSEIEYGGYEGSDESCEKVTGKLWARGDLSIQHILPRRRVVVFSTMGMMEIVFNRPVDILRRLFETNIPRSIVEEFFNRFGAGEAAAMCLMLAARIVHSETLISNVVSQKAAEAFEDPRLVGMPQLEGSNALSNTRTAAGGFSMGQVVQEAEPVFSGAHEGLCLCSARLLFPIWELPVVVVKGGLGSADAMSENGLVVCRLSLEAMQVLENKIRSLEKFLKSRRNQRRGLYGCVAGLGDVTGSILYGIGSELGGGDHSMVRNLFGTYSRNTESNDGGMSNKRQRLPYSPAELAAMEVRAMECIRQLLLRSSEALFLLQLLSQHHVTRLVQGFDANLRQALVQMTFHQLVCSEEGDHLATRLISALMEYYTGPDGRGAVNDISGRLREGCPSYYKESDYKFFLAVECLERAAVIPDPEEKENLAREAFNFLSKVPESADLRTVCKRFEDLRFYEAVVRLPLQKAQALDPAGDAFSDQIDAAVRQHARAQREQCYEIVISALRSLKGEPSQREFGSPLRPAAMRSALDPVSRNKYISQIVQLGIQSPDRLFHEYLYHAMIDMGLENELLEYGGPDLVPFLQSAGREPIQEVRAVSAVTSAASPISYSGTAIPFNQAKYSDLLARYYVLKRQHLLAAHVLLRLAERRSTNSGDVPTLDQRYHYLSNAVLQAKNASNSEGLVGSTRGAYDDGLLDLLEGKLAVLRFQIKIKEELEASASRIEALPGASEPVQSGTVPTSTLSGDANLANIAREKAKELSLDLKSITQLYNEYALPFELWEICLEMLYFAYYSGDADSSVVRDTWARLIDQALSRGGIAEACSVLKRVGSHIYPGDGAGLPLDTLCLHLEKAALERLESGVESVGDEDVARALLAACKGAIEPVLNTYDQLLTSGAILPSPNLRLRLLRSVLVVLREWAMSVFAQRMGTSATGASLILGGTFSLEQTSGINQGVRDKISSAANRYMTEVRRLALPQSQTEAVFHGFRELEESLISPFSFDRF

SEQ ID NO: 19391 - protein, 1494 aa, Theobroma cacao
MSWEEEIVMRDVTNAGLVVSDRIGREVAAQLDLEEALEASRYASHPYSTHPREWPPLIEVVDTWELPPVLIERYNAAGGEGTALCGIFPEIRRAWASVDNSLFLWRFDKWDGQCPEYNAEEQAICAVGLAKSRPGIFVEAIQYLLILATPVELILVGVCCSGGGDGTDPYAEVSLQPLPEYTVPSDGVTMTCINCTDKGRIFMAGRDGHIYELHYTTGSGWHKRCRKVCLTAGVGSVISRWVIPNVFKFGVVDPIVEMVVDNERQILYARTEEMKIQVFVMGPNGDGPLKKVAEERNLLNQKDGHYGGRQTAAPRASNRSAKPSIVSISPLSTLESKWLHLVAILSDGRRMYLSTSSSSGSNGTVGGLGGFNNHHHRPSCLKVVTTRPSPPLGVSGGLTFGAMSLAGRTQTEDLSLKVETSYYSAGTLVLSDASPPTMSSLLIVSRDSSSQSSQSGGLGASARSSRALRESVSSLPVEGRMLFVADVLPLPDAAATVLSLYSELEFCGFESSAESCEKASGKLWARGDLSTQHILPRRRIVVFSTMGMMEVVFNRPVDILRRLLESNSPRSILEDLFNRFGAGEAAAMCLMLAARIVHCENPISNVVAEKAAEAFEDPRIVGVPQLEGSSGLSNTRTAAGGFSMGQVVQEAEPVFSGAHEGLCLCSSRLLFPVWELPVMVAKGGQDAASENGVIACRLSVGAMQVLENKIRALEKFLRSRRNQRRGLYGCVAGLGDLTGSILYGTGSELGAGDRSMVRNLFGAYSRSVESNGGGASNKRQRLPYSPAELAAMEVRAMECIRQLLLRSAEALFLLQLVSQHHVTRLVQGFDANLRQALLQLTFHQLVCSEEGDRLATRLISALMEYYTGPDGRGTVDDISGKLREGCPSYFKESDYKFFLAVECLERAAVTPDPDVKENLAREAFNFLSKVPESADLRTVCKRFEDLRFYEAVVRLSLQKAQALDPAGDAFNEQIDPAIREYAIAQREQCYEIITSALRSLKDGGSQREFGSPARPVAVRSTLDQASRRKYICQIVQLGVQSPDRLFHEYLYRAMIDLGLENELLEYGGPDLVPFLQTAGREPVQEVQALSALTSATPSMGQPGAPIHSDQAKYFDLLARYYVLKRQHVLAAHVLLRLAERRSTDGSNAPTLEQRRQYLSNAVLQAKSASNNDGLVGSSRGAFDSGLLDLLEGKLTVLQFQIKIKEELEAIASRLEATPVTSESVQNGSVPDSRYNGDAHLANAAREKAKELSLDLKSITQLYNEYAVPFELWEICLEMLYFANYSGDADSSIIRETWARLIDQALLRGGVAEACAVLKRVGSRVYPGDGTVLPLDTLCLHLEKAALERVESGLETVGDEDVARALLAACKGAAEPVLNTYDQLLSNGAILPSPNLRLRLLRSVLVILREWAMSVYAQRMGTSSTGASLILGGTFSLEQTTVLNQGIRDKITSAANRFMTEVRRLALPQSRTEAVYRGFRELEESLISPLSFDRF

SEQ ID NO: 19392 - protein, 1480 aa, Prunus mume
MSWEDEIVMRDVTNAGLVVSDRIGREVASQLDLEEALEASRYASHPYSTHPREWPPLVEVVDTWELPRVLIERYNAAGGEGNSLCGIFPEIRRAWASVDNSLFLWRFDKWDGQCPEYSGEDQAICAVGLAKSKPGVFVEAIQYLLILATPVELILVGVCCSGGADGTDPYAEVSLQPLPEYTVPSDGITMTCITCTDKGRIFLAGRDGHIYELHYTTGSGWQKRCRKVCLTAGLGSVISRWVVPNLFKFGAVDPIIEMVFDNERHILYARTEEMKIQVFIVGQNVDGPLKKVAEERNLINQRDAHYGGRQSTGPRGPNRSTKSSIVCISPLSTLESKSLHLVAVLSDGRRMYLTTSPSSGNLGGFNTNHKPSCLKVVTTRPSPPLGVGGGLAFGSMSLAGRPQNDDLSLKVEAAYYSAGTLVLSDSSPPTMASLLLVSRDSSTQSAGSSTSGTSSKSSRALRESVSSLPVEGRMLFVADVFPMPDTATTVQSLYSEIEYGGYEGSDESCEKVTGKLWARGDLSIQHILPRRRVVVFSTMGMMEIVFNRPVDILRRLFETNIPRSIVEEFFNRFGAGEAAAMCLMLAARIVHSETLISNVVSQKAAEAFEDPRLVGMPQLEGSNALSNTRTAAGGFSMGQVVQEAEPVFSGAHEGLCLCSARLLFPIWELPVMVVKGGLGSADAMSENGLVVCRLSLEAMQVLENKTRSLEQFLKSRRNQRRGLYGCVAGLGDVTGSILYGIGSELGGGDHSMVRNLFGAYSRNTESNDGGMSNKRQRLDVRAMECIRQLLLRSSEALFLLQLLSQHHVTRLVRGFDANLRQALVQMTFHQLVCSEEGDHLATRLISALMEYYTGPDGRGAVNDISGRLREGCPSYYKESDYKFFLAVECLERAAVIPDPEEKENLAREAFNFLSKVPESADLRTVCKRFEDLRFYEAVVRLPLQKAQALDPAGDAFSDQIDAAVRQHARAQREQCYEIVISALRSLKGEPSQREFGSPLRPAAMRSALDPVSRNKYISQIVQLGIQSPDRLFHKYLYRAMIDMGLENELLEYGGPDLVPFLQSAGCEPIQEVRAVSAVTSAASPISYSGTAIPSNQAKYSDLLARYYVLKRQHLLAAHVLLRLAERRSTDSGDVPTLDQRYHYLSNAVLQAKNASNSEGLVGSTRGAYDDGLLDLLEGKLAVLRFQIKIKEELEASASRIEALPGASEPVQSGTVPNSTLSGDANLANIAREKAKELSLDLKSITQLYNEYALPFELWEICLEMLYFAYYSGDADSSVVRDTWARLIDQALSRGGIAEACSVLKRVGSHIYPGDGAGLPLDTLCLHLEKAALERLESGVESVGDEDVARALLAACKGAIEPVLNTYDQLLTSGAILPSPNLRLRLLRSVLVVLREWAMSVFAQRMGTSATGASLILGGTFSLEQTSGINQGVRDKISSAANRYMTEVRRLALSQSQTEAVFHGFRELEESLISPFSFDRF

SEQ ID NO: 19393 - protein, 1494 aa, Gossypium raimondii
MSWVEEVVLRDVTNAGLVVSDRIGREVAAQLDLEEALEASRYASHPYSTHPREWPPLIEVEDTWELPPVLIERYNAAGGEGTALCGIFPEIRRAWASVDNSLFLWRFDKWDGQCPEYNVEEQAICAVGLAKSRPGIFIEAIQYLLILATPVELILVGVCCSGGGDNSDPYAEVSLQPLPEYTIPSDGVTMTCISCTDKGRIFLAGRDGHIYELHYTTGSGWHKRCRKVCLTAGVGSVISRWVIPNMFKFGAVDPIVEMVVDNERQILYARTEEMKIQVFVMGPSGDSPLKKVAEERNLLNQKDAHYGGRQATASRASNRSAKPSIVSISPLSTLESKWLHLVAILSDGRRMYLSTSTSSGSNSTVGGLSGFNNHHHRPSCLKVVTTRPSPPLGVSGGLTFGAMSLAGRTQTEDLSLKVETAYYSTGTLVLSDSSPPTMSSLLIVSRDSSSQSSLSGNLGASARSSRALRESVSSLPVEGRMLFVADVLPLPDTAATVLSLYSELEFCGSESSVESCEKASGKLWARGDLSTQHILPRRRIVIFSTMGMMEVVFNRPVDILRRLLESNSPRPILEDFFNRFGAGEAAAMCLMLAARIVHSENLISNVVAEKAAEAFEDPRIVGVPQVEGTSGLSNTRTAAGGFSMGQVVQEAEPVFSGAHEGLCLCSSRLLFPVWELPVMVVKGGYDAASENGLIACRLSVGAMQVLENKTRALEIFLRSRRNKRRGLYGCVAGLGDMTGSILYGTGSELGAGDRSMVRNLFGAYFRSVESNGGGTSNKRQRLPYSPAELAAMEVRAMECIRQLLLRSAEALFLLQLVSQHHVTRLVQGFDANIRQELVQLTFHQLVCSEEGDRLATRLISALMEYYTGPDGRGTVDDISGKLREGCPSYFKESDYKFFLAVECLERAAVTPDPDVKENLAREAFDFLSKVPESADLRTVCKRFEDLRFYEAVVRLPLQKAQALDPAGDAFHEQIEQAIRDYAIAQREQCYEIIASALRSLKGEGSQREFGSPARPVAVRSVLDHASRRKYICQIVQLSVQSPDRLFHEYLYRTMIDLGLENELLEYGGPDLVPFLQTAGCEPAQEVRALSALTSATPSVGQPGAPIHSNQAKYFDLLARYYVLKRQHLLAAHVLLRLAERRSIDGSNAPSLEQRRQYLSNAVLQAKSASNNDGLVASNRGAFDSGLLDLLEGKLAVLQFQIKVKEELEAMATRLEATPGTSESVQNGSAADSRFNGDANLANAAREKAKELSSDLKSITQLYNEYAVPFELWEICLEMLYFANYSGDADSSIIRETWARLIDQALLSGGVAEACSVLKRVGSKVYPGDGAVLPLDTLCLHLEKAALERVESGTESVGDEDVARALLAACKGAAEPTLNTYDQLLSNGAILSSPNLRLRLLQSVLVVLREWAMSVFAQRMGTTAAGASLILGGAFSPEQTMVLNQGIRDKITSAANRYMTEVRRLPLPQSRTEAVYRGFRELEESLIAPFSFDRF

SEQ ID NO: 19394 - protein, 986 aa, Glycine max
MDDLERAILVMFDESGALDDDLKKQAKVYCNDIKEKPLICRLCIEKLCFSNLVQVQFWCLQTLHEVIRTRYLTMTPDERHMIRGSVFSIVCLEDKNLTRVLEGPAFIKNKLAQVLITLIYFEYPLVWSSVFVDFFPHLSKGNVVIDMFCRVLNALDDELISLDYPRTPEELAVAGRVKDAMRQQCVPQIVRAWYDIVSMYRNSDHELCTSVLDSMRRYISWIDIGLIVNDAFIPLLFDLILVGPLSDQLRGASVRCLLAVVSKRMEPESKLSLLQSLQISRVLRLVTEDVDVELVSDIAALLSGYAVEALDCFKRINSEDAKGISMELLSEVLPSIFYVMKNFEVDVTFNIIQFLSGYVAIFKSFVPLPEKQLLHLGQILEVILVLIRYDPVHRTNLDVMDKIGKEEEDRMVEFRKDLFVLLRNVGRVAPDVTQLFIRNSLASAVSRSSDSNVEEVEGALSLLYALGESISEEAIRTGSGLLSELVLMLLSTKFPCHSNRLVALVYLETVTRYIKFIQDNTQYIPMVLAAFLDERGIHHSNINVSRRASYLFMRVVKFLKMKLVPFIETILQSLQDTVAQFTIMNYTTEELSGSEDGSHIFEAIGLLIGTEDVLPEKQSDYLSSLLSPLCQQVEALLINAKLLNAEETNAKIAVIQQIIMAINSLSKGFSERLVTASRPAIGIMFKQTLDVLLQVLVIFPKVEPLRNKVTSFIHRMVDTLGASVFPYLPKALEQLLEEIEPKQMVGFLLLLNQLICKFNTLVRDILEEIFPSIAERIFSVIPRNGLPSSGSDAITEEIRELQELQRTLYTFLHVITTHDLSPVFLSPKCKAYLDPVMQLLLYSSCNHNDILVRKACVQIFIRLIKDWCAQPYEEKVPGFRSFVIEAFATNCCLYSVLDRSFEFHDANTFVLFGEIVLAQKVMYEKFGDDFLVNFVSKGFSSAHCPPDQAEQYRQKLQGGDFKALKSFYQSLVENLRVQQNGSLVFR

SEQ ID NO: 19395 - protein, 985 aa, Cajanus cajan
MDDLEKAILIIFDESGAIGDDLKKQAKVYCNDIKEKPSICRLCIEKLCFSNLVQVQFWCLQTLHEVIRTRYLTMAPDERHMIRGSVFSIVCLEDKNLTRVLEGPAFIKNKLAQVLITLIYFEYPLVWSSVFVDFFPHLSKGNVVIDMFCRVLNALDDELISLDYPRTSEELTVASRVKDAMRQQCVTQIVRAWYDIVSMYRNSDQELCTSVLDSMRRYISWIDITLIVNDAFIPLLFDLILVGPLSDQLRGAALRCLLAVVSKRMDPQSKLSLLQSLQISRVLRLVTEDGDAELVSDIAALLTGYAVEALDCFKRINSEDAKGISMELLSEVLPSIFYVMKNFEVDATFNIFQFLSGYVAILKSFAPLREKQLLHLGQILEVILVLIRYDPAYRTNLDVMDKIGKEEEDRMVEFRKDLFVLLRTVGRVAPDVTQLFIRNSLASAVSRSSDSNVEEVEGALSLLYALGESISEEAIRTGSGLLSELVLMLLSTKFTCHSNRLVALIYLETVTRYVKFIQDNSQYIPMVLAAFLDERGIHHPNINVSRRASYLFMRVVKLLKMKLVPFIETILQSLQDTVGQFTIMSYTTEELSGSEDGSHIFEAIGLLIGTEDVLPEKQSDYLSSLLSPLCQQVEALLINAKLLNCEETNAKIAVIQQIIMAINSLSKGFSERLVTASRPAIGLMFKQTLDVLLQVLVIFPKVEPLRNKVTSFIHRMVDTLGASVFPYLPKALEQLLEEIEPKQMVSFLLLLNQLICKFNTSVRDILEEIFPAVAERIFSVIPRNELPSGPDAITEEIRELQELQRTLYTFLHVITTHDLSPVFLSPKCKAYMDPVMQLILYSSCNHKDILVRKACVQIFIRLIKDWCALPYEEKVPGFRSFVIEAFATNCCLYSVLDRSFEFHDANTYVLFGEIVLAQKVMYEKFGDDFLVHFVSKGFSSAHCPPDLAEQYRQKLQGGDFKTLKSFYKSLVENLRLQQNGSLVFR

SEQ ID NO: 19396 - protein, 986 aa, Phaseolus vulgaris
MDDLEKGILIMFDESGALDDDLKKQAKLYCNSIKEKPSICRLCIEKLCFSNLVQVQFWCLQTLHEVIRTRYLTMTPDERHMIRGSVFSIVCLEDKNLTRVLEGPAFIKNKLAQVLITLIYFDYPLVWSSVFVDFFPHLNKGNVVIDMFCRVLNALDDELISLDYPRTQEELTVASRIKDAMRQQCVSQIVRAWYDIVSMYRNSDQELCTSVLDSMRRYISWIDIGLIVNDAFIPLLFDLILVGSLSDQLRGAAVRCLSAVVSKRMEPQSKLSLLQSLHISRVVRLVTENDDAELVSDVAALLTGYAVEALDCFKRINSEDAKGISMELLSEVLPSIFYVMKNFEVDSTFNIIQFLSGYVSILKSFSPLREKQLLHLGQILEVILVLIRYNQAYRANLDVMDKIGKEEEDRMVEFRKDLFVLLRTVGRVAPDVTQMFIRNSLASAVSRSSNSNVEEVEGALSLLYALGESISEEAMKTGSGLLSELVLMLLSTKFPCHSNRPVALVYLETVTRYVKFIQDNTQYIPMVLAAFLDERGIHHSNINVSRRASYLFMRVVKLLKMKLVPFIETILQSLQDTVAQFTIMNYTAEELSGSEDGSHIFEAIGLLIGTEDVQPEKQSDYLSSLLSPLCQQVEALLINAKLLNVEEANAKIAVIQQIIMAINSLSKGFSERLVTASRPAIGLMFKQTLDVLLRVLVTFPKVEPLRNKVTSFIHRMVDTLGASVFPYLPKALEQLLEEIEPKQMVCFLLLLNQLICKFNTLVRDILEQIFPAVAERIFSVIPRNGLPSTGPDAITEEVRELQELQRTLYTFLHVITTHDLSPVFLVPKCKAYLDPVMQLLLFSSCNHKDILVRKACVQIFIRLIKDWCAQPYEEKVPGFRSFVIEAFATNCCFYSVLDRSFEFHDANTFVLFGEIVLAQKVMYEKFGDDFLVHFVSKGLSSAQCPQDLAEQYRQKLQSGDLKALKSFYQSVVENLRLQQNGSLVFR

SEQ ID NO: 19397 - protein, 985 aa, Trifolium pratense
MDDLEKGILIMFDEWGAIDDELKKQAKSYCSNIKEKPSVCRLCIEKLCCSNLVQVQFWCLQTLHEVIRTRYSTISPEEKHMIRGTVFSIVCLEDKNPIRVLEGPAFIKNKLAQVFIALIYFEYPLIWSSVFVDFLPHLRKGNVVIDMFCRVLNALDDELISLDYPRTPEELTVAGRVKDAMREQCVSQIVRAWYDIISMYRNSDQDLCTTVLDSMRRYISWIDISLIFNDTFLPLLFDLILVGAPSDQLRGASVRCLLAIVSKRMEPQSKLSLLQSLQITRVFRLVTEDGNAELVPDIAALLSGYAVEALDCFKRISSEDAKRISMELLNEVLPSIFYVMKNFEIDATLNIVQFLSGYVSTLKSLTPLSEKHILHVGQILEVILVLIRYDPVYRTNLDVMDKIGKEEEDRMTEFRKDLFVLLRTVGRVAPNVTQLFIRNSLGSAISRPSDSNVEEVEGALSLLYALGESLSEEAIRTGSGLLSELLLMLLSTKFPCHSNRLVALVYLETVTRYVKFIQDNAQCIPIVLAPFLDERGIHHPNNSVSRRASYLFMRVVKLLKVKLVPFIAVILQSLPDTVARFTTMNYTTEEISGSEDGSHIFEAIGLLIGMEDVPPEKQSDYLSSLLSPLCQQVEALLRNAKSLSYEESKARIAVIQQIIMAINSLSKGFSERLVTASRPAIGNMFKQTLDVLLHVLVIFPRVEPLQNKVTSFIHRMVDTLGASVLPYLPKALEQLLAETEPKQMSGFLLLLNQLICKFNILVRDILEEIFPSVADRIFRVIPREGLPSGPDAVTEEIRELQELQRTLYTFLHVIATHDLSTVFIAPKCKAYLDPVMQLLFYSSCNHKDVLLRKACVQIFIRLIKDWCAQPYEEKVPGFRSFMIETFATNCCLYSVLDRSFDFRDANTLVLFGEIVVAQKVMYDKFGDDFLVHFISKGFSVAHCPPDLAEQYRQKLQGTDIKALKSFYQSLVENLRLQQNGSLVFR

SEQ ID NO: 19398 - protein, 985 aa, Cicer arietinum
MDDLEKGILIMFDESGAIDDELKKHAKSYCSDIKEEASVCRICIEKLCCSNLVQVQFWCLQTLHEVIQTRYSTISPEEKHMIRGTVVSIVCLEDKNRIRVLEGPAFIKNKLAQVLIALIYFEYPLIWSSVFVDFLPHLRKGNVVIDMFCRVLNALDDELISLDYPRTPEELTVAGRVKDAMRQQCVSQIVRAWYDIISMYRNSDQELCTNVLDSMRRYISWIDIGLIVNDAFVPLLFDLILVGAPSDQLRAAAVRCLLAVVSKRMEPQSKLSLLQSLHISRVFRLVTEDGNAELVPDIAALLSGYAVEALDCFKRISSDDAKGISMELLNEVLPSVFYIMKNFEVDATFSIVQFLLGYVSTMKGLTPLSEKHMLHMGQILEVVLGLIRYDPVYRTNLDVMDKIGKEEEDRMTEFRKDLFVLLRTVGRVAPNVTQLFIRNSLASAISISSDSNVEEVEGALSLLYALGESLSEESIRTGNGLLSELLLMLLSTKFPCHSNRLVALVYLETVTRYVKFIQDNTQCIPIVLAPFLDERGIHHPNISVSRRASYLFMRVVKLLKVKLVPFIAVILQSLPDTVARFTTMNYTTEELSGSEDGSHIFEAIGLLIGMEDVPPEKQSDYLSSLLSPLCQQVDALLRNAKLLSYEETNARIAVIQQIIMAINSLSKGFSERLVTASRPAIGNMFKQTLDVLLHVLVIFPRVEPLQNKVTSFVHRMVDTLGASVFPYLPKALEQLLAETEPKQMSGFLLLLNQLICKFKILMRDILEEIFPPVTDRIFSVIPREGLPSGLDAITEEIRELQELQRTLYTFLHVIATHDLSTVLISAKCKAYLDPVMQLLFYSSCNHKDILVRKACVQIFIRLIKDWCSQPYEEKVPGFRSFVIETFATNCCLYSVLDRSFDFRDANTLVLFGEIVVAQKVMYDKFGDDFLVYFISKGFSAAHCPPDLAEQYRQKLQGTDMKALKSFYQSLIENLRLQQNGSLVFR

SEQ ID NO: 19399 - protein, 985 aa, Trifolium pratense
MDDLERGILIMFDEWGAVDDELKKQAKSYCSNIKEKPSVCRLCIEKLCCSNLVQVQFWCLQTLHEVIRTRYSTISPEEKHMIRGTVFSIVCLEDKNPVRVLEGPPFIKNKLAQVFIALIYLEYPLIWSSVFVDFLPHLHKGNVVIDMFCRVLNALDDELISLDYPRTPEELTVAGRVKDAMREQCVSQIVRAWYDIISMYRNSNQDLCTIVLDSMRRYISWIDIGLIFNDTFLPLLFDLILVGAPSDQLRGASVRCLLAIVSKRMEPQSKLSLLQSLQITRVFRLVTEDGNAELVPDIAALLSGYAVEALDCFKRISSEDAKRISMELLNEVLPSVFHVMKNFEVDATLNIVQFLSGYVSTLKSLTPLSEKHILHVGQILEVILVLIRYDPVYRTNLDVMDKIGKEEEDRMTEFRKDLFVLLRTVGRVAPNVTQLFIRNSLGSAISRPSDSNVEEVEGALSLLYALGESLSEEAIRTGSGLLSELLLMLLSTKFPCHSNRLVALVYLETVTRYVKFIQDNAQCIPIVLAPFLDERGIHHPNNSVSRRASYLFMRVVKLLKVKLVPFIAVILQSLPDTVARFTTMNYTTEEISGSEDGSHIFEAIGLLIGMEDVPPEKQSDYLSSLLSPLCQQVEALLRNAKSLSYEESKARIAVIQQIIMAINSLSKGFSERLVTASRPAIGNMFKQTLDVLLHVLVIFPRVEPLQNKVTSFIHRMVDTLGASVLPYLPKALEQLLAETEPKQMSGFLLLLNQLICKFNILVRDILEELFPSVADRIFSVIPREGLPSGPDAVTEEIRELQELQRTLYTFLHVIATHDLSTVFIAPKCKAYLDPVMQLLFYSSCNHKDVLLRKACVQIFIRLVKDWCAQPYEEKVPGFRSFMIETFATNCCLYSVLDRSFDFRDANTLVLFGEIVVAQKVMYDKFGDDFLVHFISKGFSVAHCPPDLAEQYRQNLQGSDIKALKSFYQTLVENLRLQQNGSLVFR

SEQ ID NO: 19400 - protein, 985 aa, Trifolium pratense
MDDLERGILIMFDEWGAVDDELKKQAKSYCSNIKEKPSVCRLCIEKLCCSNLVQVQFWCLQTLHEVIRTRYSTISPEEKHMIRGTVFSIVCLEDKNPVRVLEGPPFIKNKLAQVFIALIYLEYPLIWSSVFVDFLPHLHKGNVVIDMFCRVLNALDDELISLDYPRTPEELTVAGRVKDAMREQCVSQIVRAWYDIISMYRNSNQDLCTIVLDSMRRYISWIDIGLIFNDTFLPLLFDLILVGAPSDQLRGAAVRCLLAIVSKRMEPQSKLSLLQSLQITRVFRLVTEDGNAELVPDIAALLSGYAVEALDCFKRISSEDAKRISMELLNEVLPSVFHVMKNFEVDATLNIVQFLSGYVSTLKSLTPLSEKHILHLGQILEVILVLIRYDPVYRTNLDVMDKIGIEEEDRMTEFRKDLFVLLRTVGRVAPNVTQLFIRNSLGSAISRPSDSNVEEVEGSLSLLYALGESLSEEAIRTGSGLLNELLLMLLSTKFPCHSNRLVALVYLETVTRYVKFIQDNAQCIPIVLAPFLDERGIHHPNNSVSRRASYLFMRVVKLLKVKLVPFIAVILQSLPDTVARFTTMNYTTEEISGSEDGSHIFEAIGLLIGMEDVPPEKQSDYLSSLLSPLCQQVEALLRSAKLLSYEESKARIAVIQQIIMAINSLSKGFSERLVTASRPAIGNMFKQTLDVLLHVLVIFPRVEPLQNKVTSFIHRMVDTLGASVLPYLPKALEQLLAETEPKQMSGFLLLLNQLICKFNILVRDILEELFPSVADRIFSVIPREGLPSGLDAVTEEIRELQELQRTLYTFLHVIATHDLSTVFIAPKCKAYLDPVMQLLFYSSCNHKDVLLRKACVQIFIRLVKDWCAQPYEEKVPGFRSFMIETFATNCCLYSVLDRSFDFRDANTLVLFGEIVVAQKVMYDKFGDDFLVHFISKGFSVAHCPPDLAEQYRQNLQGSDIKALKSFYQTLVENLRLQQNGSLVFR

SEQ ID NO: 19401 - protein, 993 aa, Medicago truncatula
MDDLEKGILIMFDESGAIDDELKNQAKTYCTDVKQKPSVCRLCIQKLCSSNLVQVQFWCLQTLHELIQTRYSAIPPEEKHAIRTTVFSIACLVVVEDNNNNTPIRVLEAAPAFIKNKLAQVLIALIYYEYPLICSSFFLDFLPHLRKGNVVIDMFCRVLNALDDELISMDYPRTPEEVTVANRVKDAMREQCVSQIVRAWYDILSMYRNSDQHLCITVLDSIRRFISWIDIAFIFNDTFLPFLFDFILVTTTSDHLRAAAVRCLLAIVSKRMESQSKLSLLQTLQITRVFRLLTDDANADLVPDIAALLSGYATEALDCFKRITSEDAKGISMELLNEVLPSVFYAMKNFELDTTTLNIVQFLSGYASTLKTLAPLSEKHILHVGQILEVILVLIRYDPVYRTNLDVMDKIGKEEEDRMTEFRKDLFVLLRTVGRVAPDVTQLFIRNSLASAISRSSDSNVEEVEGALSLLYALGESLSEEAVRNGNGLLSELLFMLLSTKFPCHSNRLVALVYLETVTRYVKLIQDNAQCIPIVLAPFLDERGIHHPNISVSRRASYLFMRVVKLLKVKLVPFIAVILQSLPDTVARFTATNYTTEELSGSEDGSHIFEAIGLLIGMEDVPPEKQSDYLSSLLSPLCQQVEALLRNAKLLSYEETNARIAVIQQIIMAINSLSKGFSERLVTASRPAIGNMFKQTLDVLLQVLVIFPRIEPLQSKVTSFIHRMVDTLGASVLPYLPKAIEQLLAETEPKQMSGFLLLLNQLICKFNILVRDILEEIFPSVADRIFSIIPREGLPSGLDAATEEIRELQELQRTLYTFLHVIATHDLSTVFISPKCKAYLDPVMQLLFYSSCNHKDILLRKTCVQIFIRLIKDWCAQPYGEKVPGFRSFVIETFATNCCLYSVLDRSFDFRDANTLVLFGEIVVAQKVMYDKFGDDFLVHFISKGFSVAHCPPEMAEQYRQKLQGSDIKALKSFYQSLIENLRLQQNGSLVFR

SEQ ID NO: 19402 - protein, 661 aa, Nicotiana benthamiana
MNMFGLKVEEGKEGQNGQPSVGPVYRNPIAKNGFPQTDPDLSTAWQLFRAAVEKYPGNKMLGWRDFKDGKWGPYLWKTYKEAYEEILHTGSALRAHGIEPGARIGIYGSNCPQWIVAMQACSAHSLICVPLYDTLGSGAVDFIIEHAEIDIVFVQDKKVKELSNSECTHAKRLKLLVCFTSLQQEQKDKAVSMGIKPYSWNEFLNMGKENPSEPSPPQPLDICTIMYTSGTSGEPKGVILTHENMTASVTGVDHFMEEFEDKMTVDDVYISFLPLAHILDRMIEEFFFHRGASVGYYHGNINEIQEDLMELKPTFLAGVPRVYEKIHEGVLKALGELNPFRRSMFHILYNYKLKWMKLGYKQKYASPLADLLAFRKVKNRLGGRIRLIVSGGAPLSTEVEEFLRVTSCGFVLQGYGLTETCGLATIGHPDEMSMLGTVGPPFVFTEVRLEEVPEMGYHPLGDPPRGEICVRGRTAFTGYYKNQELTREVIKDGWFHTGDIGEMLPNGVVKIIDRKKNVIKLSQGEYVAMEYLEKVYSIAPIIEDIWVYGDSFKSMLVAVVVPHEGNTKKWADQNGHKGSIPELCSLQELNHYILLELKTAAERNKLRGFECIKGLILEPQPFEFNQDFVTATMKKRRERLLKHYKVEIDDLYQRLNAVPKR

SEQ ID NO: 19403 - protein, 652 aa, Solanum phureja
MADVVQFKLERMLPELDDLEKRSLFSRQEIAEIVKQRRKFEYRLKRPSPLKQDFVAYIDYEKSLDSLRLLRKKAQMKTTGDRKLKKSVSDYAGVSRIIEIYRLATTRFKGDIELWFQYLEFCRERRNGRMKKALAQVIRFHPKVPGVWIYAAAWEFDNNLNAAAARALMHSGLRACPTSEDLWVEYLRMELTYLNKLKARKVVLGEDEGTLARSGKSAKEEQWRDENKELFIVLDDKREEDKLSNLHDGDSKEKLDLFREQGLSVLQTVYGGSIKALPSSFSLRTKFLDILEATDLGHSEDMRNEILADMKRDFSKEPKYWDWLARQEVIDLNNPETTGAMTADQLSRAIEVYEEGLKIVPSASMFDCYAKFLMDVIHFKNKGSQSSELFSTARHVMDPISHLLVVYEKAETMGCITEDLACQHVSFLLQLGKVDEAKTLAEKLCSGKFSEAVQLWALRFSIEMRFIQKNCTPNKAALSSIFELLRSVLLKLPILEAETIWLMALKYFSTHKKFFDKLVETSISLLAKDGGSDDGFSLSTTIVNFVLQRDGLGSARELYKRFLALPHPGLSLYRNCIELELNLASSGDKISLGNVRKLFETALTTYDQDVRLWQDYYNMEIKMGTSETAAAVHWRARKTLKKSISLVPSLDM

SEQ ID NO: 19404 - protein, 651 aa, Capsicum annuum
MADVVQYKMERMLHELDDLEKRGLFSHQEIEEIVKQRRKFEYRLKRPRPLKQDFVAYIDYEKSLDSLRLLRKKALMKKTGDRKLKKSVSDYAGVSRIIDIYRLATRRFKGDIELWFQYLEFCRDRRNGRMKKALAQAIRFHPKVPGVWIYAAAWEFDNNLNAAAARALMHSGLRACPTSEDLWVEYLRMELTYLNKLKARKVVLGEDKGTLAHSGKNAKEEQWRNENKELFMALDDKREDDKLSDLHDGDSKERLDLFREQGLSVLQTVYSGSIKALPSSFSLRTQFLEILEATNLAHSEDMRNEILADMKRDFSKEPKYWDWLARQEVIDRNNPESTEGVTADQLSRAIQVYEEGLKFVPLASMFDCYAKFLMDVIHFKNQGSQSSEHFSAASHGMDPISQLLVVYEKAETMGCITEDLACQYVSFLLQLEKVDEARTLAAKFCSGKFSEAVRLWALRFSTEMRFIQNNCTPNKAALSSFFEPLRNVLLEVPISEAETIWLMALKYFSTHKKFFHKLVEISMISLAKYGGSDDGFSLSATIVNFVLQSNGFESARELYKRFLALPHPGLSLYKNCIELELNLASNGDKISLGNARKLFDTAVTTYDHDVGLWQDYYNMEVKMGTSETAAAVHWRARKTLKKSISLLPPSQ

SEQ ID NO: 19405 - protein, 831 aa, Solanum phureja
MASDSSPVNARGGPSTPDDSISSPIGNTYSSPGDSARRKRGRRSASSTPVAPSNRRFTTPEATPTPSSTNPRRGGRRASSNTPTGAATPSYASDVPPSSEGGEGDDADDTPPMYVWGTNISVQDVNAAILRFLRNFREDPFQTEGKYMRAVHNVIEMEGDSLDVDAHDVFDYDGDLYTKMVRFPLEVLAIFDIVLMDMVSRINPLFEKHIQARIFNLKTSTSMRNLNPSDIEKMVSLKGMIIRCSAIIPEIREAIFRCLVCGYYSDPIVVDRGRISEPTICGKQECLARNSMTLVHNRCRFADKQIVRVQETPDEIPEGGTPHTVSLLMHDKLVDVGKPGDRVEVTGIYRAMSVRIGSAHRTVKSLFKTYIDCLHLKKTDKSRMHAEDPMEIENGVVGNEEPLDHEEKVEKLKELSKQPDIYERLTKSLAPNIWELDDVKKGLLCQLFGGNALTLLSGASFRGDINILLVGDPGTSKSQLLQYIHKLSPRGIYTSGRGSSAVGLTAYVAKDPETGETVLESGALVLSDRGICCIDEFDKMSDSARSMLHEVMEQQTVSIAKAGIIASLNARTSVLACANPIGSRYNPRLSVIDNIHLPPTLLSRFDLIYLILDKADEQTDRRLAKHIVALHFENPENSEQEVIDLPTLASYLSYARKHIHPQLSDEAAEELTRGYVEMRRRGNFPGSSKKVITATPRQLESLIRLGEGLARIRFSEKVEKRDVVEAFRLLEVALQQSATDHATGTIDMDLITTGVSASERMRRENLVSTTRNIIMEKMQLGGPSTRLLELLEDVKKQSSGGEVHLADLRNALATLATEGLVVVHGDTVKRI

SEQ ID NO: 19406 - protein, 834 aa, Nicotiana benthamiana
MPSDSSPVNTHGGPFTPDDSTSSPIGNTYSSPGDNTRRKRGRRSSATSTPVAPSNRRFTTPDATPTPSSTNSRRGRRRASSTTPSGAAATTPSYASDVPPSSEGGEGDGADEAPPMFVWGTNISVQDVNAAILRFLRNFREDPSQTEGKYMRAIHHVIEMEGDSLDVDAHDVFDYDNDLYTKMVRFPLEVLAIFDIVLMDMVSRINPLFEKHIQARIFNLKSSTSMRNLNPADIEKMVSLKGMIIRCSAIIPEIREAIFRCLVCGYYSDPIVVDRGRINEPTICGKQECLARNSMTLVHNRCRFADKQIVRVQETPDEIPEGGTPHTVSLLMHDKLVDAGKPGDRVEVTGIYRAMSVRIGSTQRTVKSLFKTYIDCLHLKKTDKSRMNAEDPMEIENGVVGNDDSLGYEEKVEKLKELSKQPDIYERLTRSLAPNIWELDDVKKGLLCQLFGGNALTLPSGASFRGDINILLVGDPGTSKSQLLQYIHKLSPRGIYTSGRGSSAVGLTAYVAKDPETGETVLESGALVLSDRGICCIDEFDKMSDSARSMLHEVMEQQTVSIAKAGIIASLNARTSVLACANPIGSRYNPRLSVIDNIHLPPTLLSRFDLIYLILDKADEQMDRRLAKHIVALHFENPEKSEQEVIDLPTLTAYLSYARKHIHPQLSDEAAEELTRGYVEMRRRGNFPGSSKKVITATPRQLESLIRLSEGLARIRFSERVEKRDVMEAIRLLEVALQQSATDHSTGTIDMDLITTGVSASERMRRENFVSTTRNIIMEKLQLGGPSTRMLELLEELKKQISGGEVHLADLRNALATLATEGLVAVHGDAVKRV

SEQ ID NO: 19407 - protein, 811 aa, Capsicum annuum
VNWRQKAPHFSRQRCPSHLHCCLPPQINPNNFFLQFPPKTPSTTFSCFRPISGERKMASDSSPVNTPGGANPSTPDVSISSGEGDDADEAPPMYVWGTNISVQDVNAAILRFLRNFREDSSQTEGKYMRAIHHVIEMEGDSLDVDAHDVFDYDGDLYTKMVRFPLEVLAIFDIVLMDMVSRINPLFEKHIQARIFNLKTSTSMRNLNPSDIEKMVSLKGMIIRCSAIIPEIREAIFRCLVCGYYSDPIVVDRGRINEPTICGKQECLARNSMTLVHNRCRFADKQIVRVQETPDEIPEGGTPHTVSLLMHDKLVDVGKPGDRVEVTGIYRAMTVRIGPAHRTVKSLFKTYIDCLHLKKTDKSRMHAEDPMEVENGVVGNDEHLDNEEKVEKLKELSKQPDIYERLTRSLAPNIWELDDVKKGLLCQLFGGNALSLSSGASFRGDINILLVGDPGTSKSQLLQYIHKLSPRGIYTSGRGSSAVGLTAYVAKDPETGETVLESGALVLSDRGICCIDEFDKMSDSARSMLHEVMEQQTVSIAKAGIIASLNARTSVLACANPIGSRYNPRLSVIDNIHLPPTLLSRFDLIYLILDKADEQTDRRLAKHIVALHFEDPENSEQEVIDLPTLAAYLSYARKNIHPELSDEAAEELTRGYVEMRRRGNFPGSSKKVITATPRQLESLIRLSEALARIRFSEKVEKKDVMEAFRLLEVALQQSATDHATGTIDMDLITTGVSASERMRRENLVSTTRNIIMEKLQLGGPSTRLLELLEDAKKQSSGGEVHLADLRNALATLATEGLVVVHGDTVKRI

SEQ ID NO: 19408 - protein, 833 aa, Sesamum indicum
MASDSSPANIHGGPSSPDDWATSPISNTVSSPGDRRRPKRGRRSSYATPSPLPSDSRFPTPDATPTPSGSNSRRRGRARRPAGTPTAAATPSSTDDAPMSSEAGDGDDDEAPPMYVWGTNISVQDVNAAILRFLRHFRENPQQIEGKYMRIINHVIEVEGDSLDVDAHDVFDYDNDLYAKMVRYPLEVLAIFDIVLMDMVSRINPLFEKHIQARIFNLKSSTSMRNLNPSDVEKMVSLKGMIIRCSSIIPEIREAVFRCLVCGYYSDPIVVDRGRIDEPTICGKQECRSKNSMTLVHNRCRFADKQVVRVQEMPDEIPEGGTPHTVSLLMHDKLVDAGKPGDRVEVTGIYRAMSVRVGQTQRTVKSIFKTYIDCLHLKKTDKSRMHVEDPMETENGPSRNENESTLDEDKVEQLKELSKQPDIYERLTKSLAPNIWELDDVKKGLLCQLFGGNALKLPSGASFRGDINILLVGDPGTSKSQLLQYIHKLSPRGIYTSGRGSSAVGLTAYVAKDPETGETVLESGALVLSDRGICCIDEFDKMSDNARSMLHEVMEQQTVSIAKAGIIASLNARTSVLACANPIGSRYNPRLSVIENIHLPPTLLSRFDLIYLILDKADEQMDRRLAKHIVALHFEDPDNSEQDVIDLPTLTAYVSYARKHIHPQLSDEAAEELTRGYVEMRRRGNFPGSSKKVITATPRQIESLIRLSEALARIRFSQWVEKRDVTEAFRLLEVAMQQSATDHSTGTIDMDLITTGVSASERMRRENLVSTTRNIIMEKMQLGGPSTRLLELLEELKKQSSGAEIHLSDLRNALATLSTEGFVVVHGDSVKRI

SEQ ID NO: 19409 - protein, 834 aa, Vitis vinifera
MASDSSPANINGGPSSPDDSYSSPIGNTFSSPGDGTRRRRGRRPSASPAFATPPHPHSRFAASETTPTPSEATPTPSSGRRRRGSRRASVSTPIATPSSTDEAPPSSEGEGDDMDEAPPMFVWGTNISVQDVNAAILRFLRHFREHPSHTEGKYMRAIHRVLEIEGESLDVDAHDVFDYDSDLYTKMVRYPLEVLAIFDIVLMDMVSRINPLFEKHIQARIFNLKTSTSMRNLNPSDIEKMVSLKGMIIRCSSIIPEIREAVFRCLVCRHYSDPIVVDRGRINEPTTCGRPECLAKNSMTLIHNRCRFADKQIVRLQETPDDIPEGGTPHTVSLLMHDKLVDAGKPGDRVEVTGIYRAMSVRVGPTQRTTYIDCLHLKKTDKSRMQAEDPMEVENGSGRNEEDTLLGYEDKVAQLKELSKQPDIYDRLTRSLAPNIWELDDVKKGLLCQLFGGSALKLPSGASFRGDINILLVGDPGTSKSQLLQYIHKLSPRGIYTSGRGSSAVGLTAYVTKDPETGETVLESGALVLSDRGICCIDEFDKMSDNARSMLHEVMEQQTVSIAKAGIIASLNARTSVLACANPSGSRYNPRLSVIDNIHLPPTLLSRFDLIYLILDKADEQTDRRLAKHIVALHFENPESLEQDVLDLPTLTAYVSYARKHIHPKLSDEAAEELTRGYVEMRRRGNFPGSSKKVITATPRQIESLIRLGEALARIRFSEWVEKRDVMEAFRLLEVALQQSATDHSTGTIDMDLITTGVSASERMRRESLVSTTRNIIMEKMQLGGPSMRLLELLEELKKQSSCSEAHLNDLRNALATLASEGFLSVHGDSVKRI

SEQ ID NO: 19410 - protein, 833 aa, Daucus carota
MASDSSPANNHDGPSSPDDESMSSPIGNTFSSPGNPRRRGRRSSVATPPSRRSSRFATPEPTPTPTTRTNRRRRRSPDPITTPIAATPSSADEAPPSSEGGEFGHPDEAPPMFVWGTNISVQDVNAAILRFLRNFRGRDDARVEGKYMIAIHHVIEMQGESLEVDAHDVFDYDNDLYNKMVRYPLEVLAIFDIVLMDMVSRINPLFEKHIQARIFNLKTSTTMRNLNPSDIEKMVSLKGMIIRCSSIIPEIREAMFRCLVCGYFSEPIVVDRGRISEPTTCGKQECLAKNSMTLVHNRCRFADKQVVRLQETPDEIPDGGTPHTVSLLMHDKLVDAGKPGDRVEVTGIYRAMTVRIGSSQRTVKSLFKTYIDCLHLKKTDKSRMNAEDPMEVENGASTNDEDIPHDYEDKVEKLKELSRKPDIYERLTKSLAPNIWELDDVKKGLLCQLFGGSALTLQSGASFRGDINILLVGDPGTSKSQLLTYIHKLSPRGIYTSGRGSSAVGLTAYVAKDPESGETVLESGALVLSDKGICCIDEFDKMSENARSMLHEVMEQQTVSIAKAGIIASLNARTSVLACANPSGSRYNPRLSVIDNIHLPPTLLSRFDLIYLILDKADEQTDRRLAKHIVGLHFEDTENSEQDVIDLPTLTAYVSYARKNIHPELSDEAAEELTRGYVEMRRRGNFPGSSKKVITATPRQIESLIRLSEALARIRFSELVEKKDVVEAFRLLEVAMQQSATDHATGTIDMDLITTGVSASERMRRESLVSLTRSIIMEKMQIGGPSIRPLELLEELKKQSSGAEYHLSDLRNALSTLASEGFVVIHGDSVKRV

SEQ ID NO: 19411 - protein, 786 aa, Vinca minor
AAYATPPPPTNGRFATPEATPTPSSTNPRRRGRRASTATPTAATPSSTDDVPPSSEAGDGDDADETPPMYVWGTNISVQDVNAAILRFLRHFREQPSQIEGKYMGAIHSVIEMEGDSLEVDAQNVYDYDIDLYTKMVRYPLEVLAIFDIVLMDMVSRINPVEKHIQARIFNLKTSTSMRNLNPSDIEKMVSLKGMIIRCSSVIPEIREAIFRCLICGYYSDPIVVDRGRISEPTTCGKQECLAKNSMTLVHNRCRFADKQIVRLQETPDEIPEGGTPHTVSLLMHDKLVDAGKPGDRVEVTGIYRAMSVRIGPTQRTVKSLFKTYIDCLHLKKTDISRMRTEDPLETETGPDRSTNGSVDYEDKVERLKELSQQPNIYERLTRSLAPNIWELDDLKKGLLCQLFGGNQLTLTSGASFRGDINILLVGDPGTSKSQLLQYIHKLSPRGIYTSGRGSSAVGLTAYVAKDPETGETVLESGALVLSDRGICCIDEFDKMSENARSMLHEVMEQQTVSIAKAGIIASLNARTSVLACANPIGSRYNPRLSVIDNIHLPPTLLSRFDLIYLILDKADEQTDRRLAKHIVALHFENPENSEDFIDLPTLTAYVSYARKNIHPELSDEAAEELTRGYVEMRRRGNFPGSSKKVITATPRQLESLLRLSEALARIRFSELVEKPDVIEAFRLLEVAMQQSATDHSTGTIDMDLITTGISASERMRRENLVSITRNVIMEKMQIGGSSTRLIELLEEVKKQNSTVEVHLNDLRNALSTLANEGFVVVHGDSVKRI

SEQ ID NO: 19412 - protein, 834 aa, Rosmarinus officinalis
MASDSSPVNTHDGPSSPDAWPMSPVGNTISPPGDRSRRKRGRHSSYATPSPMPSDSRVRTPEATPTPSSNARRRGRGRRSSATPTAAATPTSTDDVPPSSDAGEGNEDEPPVVYVWGTNISVQDVNAAILRFLRHFREDPQQIEGKYMRMINHVIEIEGDSLDIDAHDVYDYDSDLYTKMVRYPLEVLAIFDMVLMDMVGRINPLFEKHIQARIFNLKSSTSMRNLNPSDVEKMVSLKGMIIRCSSIIPEIREAVFRCLVCGYYSDPIVVERGRINEPTVCAKQECLSRNSMTLVHNRCRFADKQVVRVQETPDDIPDGGTPHTVTLLMHDKLVDAGKPGDRVEVTGIYRAMNVRVGQTQRTVKSIFKTYIDCLHLKTTDKSRMDVQDPMETENGASTGDDDSTQKSEINVEQLKELSRQPDIYERLTRSLAPNIWELDDVKRGLLCQLFGGNALKLPSGASFRGDINILLVGDPGTSKSQLLQYIHKLSPRGIYTSGRGSSAVGLTAYVAKDPETGETVLESGALVLSDRGICCIDEFDKMSDNARSMLHEVMEQQTVSIAKAGIIASLNARTSVLACANPIGSRYNPRLSVIENIHLPPTLLSRFDLIYLILDKADEQTDRRLAKHIVALHFENPNSSQRDVIDLPTLTAYVNYARKHIHPQLSDEAAEELTRGYVEMRKRGNFPGSSKKVITATPRQIESLIRLSEALARIRFSELVEKSDVIEAFRLLEVAMQQSATDHSTGTIDMDLITTGVSASERMRRGNLLLATRSLIMDKLSIGGSSARLMELLEELKKQNPGGAEVHLSDLRTAMATLSAEGFLVVHGDSVKRI

SEQ ID NO: 19413 - protein, 713 aa, Nicotiana benthamiana
MYVWGTNISVQDVNAAILRFLRNFREDSSQTEGKYMRAIHHVIEMEGDSLDVDAHDVFDYDNDLYTKMVRFPLEVLAIFDIVLMDMVSRINPLFEKHIQARIFNLKSSTSMRNLNPADIEKMVSLKGMIIRCSAIIPEIREAIFRCLVCGYYSDPIVVDRGRINEPTICGKQECLARNSMTLVHNRCRFADKQIVRVQETPDEIPEGGTPHTVSLLMHDKLVDAGKPGDRVEVTGIYRAMSVRIGSTQRTTYIDCLHLKKTDKSRMNAEDPMEIENGVVGNDDSLGYEEKVEKLKELSKQPDIYERLTRSLAPNIWELDDVKKGLLCQLFGGNALTLPSGASFRGDINILLVGDPGTSKSQLLQYIHKLSPRGIYTSGRGSSAVGLTAYVAKDPETGETVLESGALVLSDRGICCIDEFDKMSDSARSMLHEVMEQQTVSIAKAGIIASLNARTSVLACANPIGSRYNPRLSVIDNIHLPPTLLSRFDLIYLILDKADEQMDRRLAKHIVALHFENPENSEQEVIDLPTLTAYLSYARKHIHPQLSDEAAEELTRGYVEMRRRGNFPGSSKKVITATPRQLESLIRLSEGLARIRFSERVEKRDVMEAIRLLEVALQQSATDHSTGTIDMDLITTGVSASERMRRENFVSTTRNIIMEKLQLGGPSTRMLELLEELKKQSSGGEVHLADLRNALATLATEGLVSVHGDAVKRL

SEQ ID NO: 19414 - protein, 833 aa, Triphysaria pusilla
MASDSSTPNVHEGASSPDAWPTSPISNTISTPGDARRPKRGRRSTYATPSPLPSGSRFDTPGATPTATPSSTNHPRGRRRAPSGTPNAAATPSDDVPLSSDAGEGFDDEAPPLFVWGTNISVQDVNAAILRFLRNYRESSEQVEGKYMRAINNVIETEGDSIDVDAQDLFNYDSDLYAKMVRYPLEVLAIFDMVLMDMITRMHPTFEKHIQARIFNLKTSTSLRNLNPSDVEKLVCLKGMVIRCSSIIPEIREAIFRCLVCGYYSEPIVVDRGRIDEPKICSRQECLSRNAMTLIHNRCRFADKQVVRLQETPDEIPEGGTPHTVSLLMHDKLVDSGKPGDRVEVTGIYRAMSVRIGQSQRTVKSIFKTYVDCLHLRTMDKSRMYVEDSMVTENSESRNDNESSLDNVDKVQKLKDLSKLPDIYERLTRSLAPNIWELDDVKKGLLCQLFGGNALKLPSGASFRGDINILLVGDPGTSKSQLLQYIHKLAPRGIYTSGRGSSAVGLTAYVTKDPETGETVLESGALVLSDRGICCIDEFDKMSDNARSMLHEVMEQQTVSIAKAGIIASLNARTSVLACANPIGSRYNPRLSVIDNIHLPPTLLSRFDLIYLLLDKADEENDRRLAKHIVALHFDDPENSEQDVIDLPTLTAYISYARQRIHPQLSDEAAEELTRGYVEMRRRGNFPGSSKKVITATPRQIESLIRLSEALARIRFSEVVEKKDVTEAFRLLEVAMQQSATDHSTGTIDMDLITTGVSASERMRRENLVSTTRNIIMEKLQHGGPSTRLLELLEEVKKQNPTVEIHLNDLRNALSTLSTEGLVSVHGDSVKRV

SEQ ID NO: 19415 - protein, 831 aa, Lactuca sativa
MASDSSPGPTSTDDLISSPGRNTLSPANNTRNSRRKRGRPSAAVGTPPVPSHSRYVSTPEPSPTPNSTAPSSRRGGRGRSGSVPLTSPSTDDVVPSSEGGEEDEANGAPAMFVWGTNISVQDVNAAILRFLRHFREHESHTDGKYMKAINHVIEIEGESLEVDANDVDAYDSDLYTKMVRYPLEVLAIFDIVLMDMVSRINPLFEKHIQARIFNLKTSTSMRNLNPADIEKMVSLKGMVIRCSSIIPEIREAVFRCIVCGHFSEPIVVDRGQISEPTICMKEECKTKNSMTLVHNRCRFADKQIVRLQETPDEIPEGGTPHTVSLLMHDKLVDAGKPGDRVEVTGIYRAMSVRVGPTQRTVKSLFKTYIDCLHLKKTDNSRMNAEDPMETEQNSTQNGEEPRVDNEELVEKLKELSKQPDIYDMLTRSLAPNIWELDDVKKGLLCQLFGGSALTHDTGATFRGDINILLVGDPGTSKSQLLQYIHKLAPRGIYTSGRGSSAVGLTAYVSKDPETGETVLESGALVLSDRGICCIDEFDKMSENARSMLHEVMEQQTVSIAKAGIIASLNARTSVLACANPSGSRYNPRLSVIDNIHLPPTLLSRFDLIYLLLDKADEVTDRRLAKHIVALHFENPENSELNAIDIPTLTAYLSYARKNIHPELSDEAAEELTRGYVEMRRRGNFAGSSKKVITATPRQIESLIRLSEALARIRFSELVEKKDVVEAFRLLEVALQQSATDHATGTIDMDLITTGVSASERMRRDNLVGMARNIIMEKMQLGGPSTRMLELLEELKQQSNNAELHLNDLRNALGTLASEGFVVIHGDSVKRV

SEQ ID NO: 19416 - protein, 290 aa, Populus trichocarpa
MDSSTVLFNQLKAAEPFFLLAGPNVIESEEHILRMANHLKTISTRVGLPLVFKSSFDKANRTSSKSFRGPGMSEGLKILEKVKIAYDIPIVTDVHETIQCEPVGQVADIIQIPAFLCRQTDLLVAAAKTGKIINIKKGQFCAPSVMSNSAEKVRLAGNPNVMVCERGTMFGYNDLIVDPRNLEWIREAKCPVVADITHSLQQPAGKKLDGGGVASGGLRELIPCIARTAVAVGVDGIFMEVHDDPLNAPVDGPTQWPLRHLEELLEELVAIAKVSKGKKQMAIDLTPFRD

SEQ ID NO: 19417 - protein, 290 aa, Populus trichocarpa
MDSSTALFDQLKVAEPFFLLAGPNVIESEEHILRMANHLKTISTKVGLPLVFKSSFDKANRTSSKSFRGPGMSEGLKILEKVKIAYDIPIVTDVHETIQCEPVGKVADIIQIPAFLCRQTDLLVAAAKTGKIINIKKGQFCAPSVMSNSAEKVRLAGNPNVMVCERGTMFGYSDLIVDPRNLEWIREANCPVVADITHSLQQPAGRKLDGGGVASGGLRELIPCIARTAVAVGVDGIFMEVHDDPLNAPVDGPTQWPLRHLEELLEELVAIAKVSKGKKPMNIDLTPFHE

SEQ ID NO: 19418 - protein, 290 aa, Mimulus guttatus
MDSSTLLYNQLKAAEPFFLLAGPNVIESEEHILYMAKQLKQIASKLGLPLVFKSSFDKANRTSSKSFRGPGLAEGLKILERVKITYDIPIVTDVHETIQCEAVGRVADIIQIPAFLCRQTDLLVAAAKTGKIINIKKGQFCAPSVMANSAEKIRMAGNENVMVCERGTMFGYNDLIVDPRNFEWMREANCPVVADITHSLQQPAGRKLEGGGVASGGLRELIPCIARTAVAVGVDGIFMEVHDDPLNAPVDGPTQWPLRHLEELLEELVTIAKVSKGKKQFQIDLTPFHP

SEQ ID NO: 19419 - protein, 290 aa, Capsicum annuum
MDSSTLLFNQLKAAEPFFLLAGPNVIESEDHILYMAKHLKDITSKLGLKFVFKSSFDKANRTSSKSFRGPGLAEGLKILEKVKTTYDVPIVTDVHESIQCEAVGRVADIIQIPAFLCRQTDLLVAAAKTGKIISIKKGQFCAPSVMANSAEKVRLAGNQNVMVCERGTMFGYNDLIVDPRNFEWMREANCPVVADITHSLQQPAGKKLEGGGVASGGLRELIPCIARTAVAVGVDGIFMEVHNDPLSAPVDGPTQWPLRHLKELLEELVAIGRVSKGKQQFKIDLTPFHD

SEQ ID NO: 19420 - protein, 290 aa, Manihot esculenta
MDSSTLLFNQLKAAEPFFLLAGPNVIESEEHLLRMASHLKTIASKLGLPLVFKSSFDKANRTSSKSFRGPGMIEGLKILEKVKIAYDLPIVTDVHETIQCEPVGRVADIIQIPAFLCRQTDLLVSAAKTGKIINIKKGQFCASSVMINSAEKVRLAGNSNVMVCERGTMFGYNDLIVDPRNFEWMREADCPVVADVTHSLQQPAGRKLDGGGVASGGLRELIPCIARTAVAVGVDGIFMEVHDDPLNAPVDGPTQWPLRNLEELLEELMAIARVSKGKRRMEIDLTPFRE

SEQ ID NO: 19421 - protein, 290 aa, Nicotiana benthamiana
MDSSTLLFNQLKTAEPFFLLAGPNVIESEDHILYMAKHLKDITSKLGLKFVFKSSFDKANRTSSKSFRGPGLAEGLKILEKVKATYDVPIVTDVHESIQCEAVGRVADIIQIPAFLCRQTDLLVAAAKTRKIINIKKGQFCAPSVMANSAEKVRLAGNHNVMVCERGTMFGYNDLIVDPRNFEWMREANCPVVADITHSLQQPAGKKLEGGGVASGGLRELIPCIARTAVAVGIDGIFMEVHNDPLSAPVDGPTQWPLRHLEELLEELVTLGRVSKGKQQFKIDLTPFRD

SEQ ID NO: 19422 - protein, 290 aa, Petunia hybrida
MDSSTLLFNQLKAAEPFFLLAGPNVIESEDHILYMAKHLKDITSKLGLKFVFKSSFDKANRTSSKSFRGPGLEQGLKILEKVKTMYDVPIVTDVHESIQCEAVGRVADIIQIPAFLCRQTDLLVAAAKTGKIINIKKGQFCAPSVMANSAEKVRLAGNQNVMVCERGTMFGYNDLIVDPRNFEWMKEANCPVVADITHSLQQPAGKKLEGGGVASGGLRELIPCIARTAVAVGVDGIFMEVHNDPQNAPVDGPTQWPLRHLEELLEELVAIGRISKGKQQFKIDLTPFCD

SEQ ID NO: 19423 - protein, 290 aa, Ricinus communis
MDSSTVLFNQLKAAEPFFLLAGPNVIESEEHIFRMAKHLKTITSNLGLPLVFKSSFDKANRTSSKSFRGPGMSEGLKILEKVKVAYDIPIITDVHETIQCEPVGRVADIIQIPAFLCRQTDLLVAAAKTGKIINIKKGQFCAPSVMMNSAEKVRLAGNSNVMVCERGTMFGYNDLIVDPRNLEWLREADCPVVADITHSLQQPAGKKLDGGGVASGGLRELIPCIARTAVAVGVDGIFMEVHDDPLSAPVDGPTQWPLRHLEELLEELTAIARVSKGKRHMDIDLTPFHG

SEQ ID NO: 19424 - protein, 290 aa, Solanum phureja
MDSSTLLFNQLKAAEPFFLLAGPNVIESEDHILYMAKHLKNITSKLGLKFVFKSSFDKANRTSSKSFRGPGLAEGLKILEKVKTIYDVPIVTDVHESIQCEAVGQVADIIQIPAFLCRQTDLLVAAAKTGKVINIKKGQFCASSVMVNSAEKVRLAGNQNVMVCERGTMFGYNDLIVDPRNFEWMREANCPVVADITHSLQQPAGKKLEGGGVASGGLRELIPCIARTAVAVGVDGIFMEVHNDPLSAPVDGPTQWPLRHLEELLEELVALGRVSKGKQQFKIDLTPFCD

SEQ ID NO: 19425 - protein, 290 aa, Solanum lycopersicum
MESSSLLFNQLKAAEPFFLLAGPNVIESEDHILYMAKHLKNITSKLGLKFVFKSSFDKANRTSSKSFRGPGLAEGLKILEKVKTIYDIPIVTDVHESIQCEAVGRVADIIQIPAFLCRQTDLLVAAAKTGKVINIKKGQFCASSVMVNSAEKVRLAGNQNVMVCERGTMFGYNDLIVDPRNFEWMREANCPVVADITHSLQQPAGKKLEGGGVASGGLRELIPCIARTAVAVGVDGLFMEVHNDPLSAPVDGPTQWPLRHLEELLEELVALGRVSKGKQQFKIDLTPFCD

SEQ ID NO: 19426 - protein, 290 aa, Rosmarinus officinalis
MDSSTLLYNQLKAAEPFFLLAGPNVIESEEHILYMAKNLKSIATKLGLPLVFKSSFDKANRTSSKSFRGPGLAEGLKILERVKTTYDIPIVTDVHETIQCEAVGKVADIIQIPAFLCRQTDLLVAAAKTGKIINIKKGQFCAPSVMENSAEKIRLAGNDNVMVCERGTMFGYNDLIVDPRNFEWLREANCPVVADITHSLQQPAGRKLEGGGVASGGLRELIPCIARTAVAVGVDGIFMEVHDDPLKAPVDGPTQWPLRHLEELLEELIAIARVSKGKKQYQIDLTPFHP

SEQ ID NO: 19427 - protein, 290 aa, Solanum tuberosum
MESSSLLFNQLKAAEPFFLLAGPNVIESEDHILYMAKHLKNITSKLGLKFVFKSSFDKANRTSSKSFRGPGLAEGLKILEKVKTIYDVPIVTDVHESIQCEAVGRVADIIQIPAFLCRQTDLLVAAAKTGKVINIKKGQFCASSVMLNSAEKVRLAGNQNVMVCERGTMFGYNDLIVDPRNFEWMREANCPVVADITHSLQQPAGKKLEGGGVASGGLRELIPCIARTAVAVGVDGIFMEVHNDPLSAPVDGPTQWPLRHLEELLEELVTLGRVSKGKQQFKIDLTPFCD

SEQ ID NO: 19428 - protein, 290 aa, Echinacea purpurea
MDSSTLLYNQLKAAEPFFLLAGPNVIESEEHILYMAKNLKSIATKLGLPLVFKSSFDKANRTSSKSFRGPGLAEGLKILERVKTTYDIPIVTDVHETVQCEAVGKVADIIQIPAFLCRQTDLLVAAAKTGKIINIKKGQFCAPSVMENSAEKIRLAGNDNVMVCERGTMFGYNDLIVDPRNFEWLREANCPVVADITHSLQQPAGRKLEGGGVASGGLRELIPCIARTAVAVGVDGIFMEVHDDPLKAPVDGPTQWPLRHLEELLEELIAIARVSKGKKQYQIDLTPFLP

SEQ ID NO: 19429 - protein, 290 aa, Rosmarinus officinalis
MDSSNLLYNQLKAAEPFFLLAGPNVIESEEHILYMAKNLKSIASKLGLMLVFKSSFDKANRTSSKSFRGPGLTEGLKILERVKTTFDIPIVTDVHETIQCEAVGKVADIIQIPAFLCRQTDLLVAAAETGKIINIKKGQFCAPSVMENSAEKIRLAGNDNVMVCERGTMFGYNDLIVDPRNFEWLREANCPVVADITHSLQQPAGRKLEGGGVASGGLRELIPCIARTAVAVGVDGIFMEVHDDPLKAPVDGPTQWPLRHLEELLEELIAIARVSRGKKQYQIDLTPFHP

SEQ ID NO: 19430 - protein, 290 aa, Ananas comosus
MDSSVALFNQLKAAEPFFLLAGPNVIESEEHVLKMARNLQSVASKLGLPLVFKSSFDKANRTSSKSFRGPGLEEGLKILEKVKVTYDIPIITDVHESYQCEAVGRVADIIQIPAFLCRQTDLLVAAAKTGRIINIKKGQFCAPSVMVNSAEKIRLAGNQNVMVCERGTMFGYNDLIVDPRNLEWMREANCPVVADITHSLQQPAGKKLEGGGVASGGLRELIPCIARTCVAVGVDGIFMEVHDDPLNAPVDGPTQWPLRQLEELLEELIAIARVTKGKKPFKIDLTPFRD

SEQ ID NO: 19431 - protein, 290 aa, Helianthus annuus
MDSSTLLYNQLKEAQPFFVLAGPNVIESEEHILHMAKQLKAVTSKLGLPLVFKSSFDKANRTSSKSFRGPGLAEGLKILEKVKTTYGLPIVTDVHESDQCEAVGRVADIIQIPAFLCRQTDLLVAAAKTGKIVNIKKGQFCAPSVMTNSAEKVRLAGNQNVMVCERGTMFGYNDLIVDPRNFEWMREANCPVVADVTHALQQPAGKKLEGGGVASGGLRELIPCIARTAVAVGVDGLFMEVHDDPLNAPVDGPTQWPLRHFEELLEELMAIARVTKGKKQYKIDLTPFRE

SEQ ID NO: 19432 - protein, 302 aa, Euphorbia esula
TGPYLLHKNWPWIHPLPLFNKLKAAEPFFLLAGPNVIESEEHILKMAKHLKIITDKVGIPLVFKSSFDKANRTSSKSFRGPGMTEGLKILEKVKREYNIPIVTDVHESIHCEAVGKVADIIQIPAFLCRQTDLLVAAAKTGKIINIKKGQFCAPSVMVNSAEKVQLAGNSNVMVCERGTMFGYHDLIVDPRNLEWLREGGCPVVADITHSLQQPAGKKLEGGGVASGGLRELIPCIARTAVAVGVDGIFMEVHDNPLNAPVDGPTQWPLRHLEELLVELVAIARASKGRKTMELDLTPLSLE

SEQ ID NO: 19433 - protein, 490 aa, Glycine max
MAMVQDERCVQRSYWIEHTTDLSVESMMLDSNASDLDKEERPEVLSLLPAYEGKSVVELGAGIGRFTGELAKKAGQLLAVDFIESAIKKNESINGHHKNVKFMCADVTSPNLHISEGSVDLIFSNWLLMYLSDKEVENLAARMIKWLKVGGYVFFRESCFHQSGDSKRKYNPTHYREPRFYTKVFKECHISDDTRNSFELSLVGCKCIGAYVRNKKNQNQICWLWKKVRSQDDRGFQRFLDSVEYNHKDILLYESVFGQGFVSTGGLETTKEFVAKLGLKPGQKVLDVGCGTGGGDIYMAENFDVEVVGIDLSINVISLAIERAIGLKCSVEFECADCTKKTYPENTFDVIYSRDTLLHIKDKPPLFRSFYKWLKRGGTLIITDYCKSEGSLSLGYAEYIKKGGYHIHDMKTYCRMLENAGFDDVVAEDRTNLFMKTLQQELNALDSKKDDFIDDFSEEDYNEITERWKAKQMRGADGEQIWGLFVAKKE

SEQ ID NO: 19434 - protein, 489 aa, Glycine max
MAMVQDERCVQRSYWIEHTTDLSVESMMLDSNASDLDKEERPEVLSLLPAYEGKSVVELGAGIGRFTGELAKKAGQLLAVDFIESAIKKNESINGHHKNVKFMCADVTSPNLHISEGSVDLMFSNWLLMYLSDKEVENLAARMIKWLKVGGYVFFRESCFHQSGDSKRKYNPTHYREPRFYTKVFKECHTSDDTRNSFELSLVGCKCIGAYVRNKKNQNQICWIWKKVRSQDDRGFQRFLDSVEYNHKDILLYESVFGQGFVSTGGLETTKEFVAKLGLKPGQKVLDVGCGTGGGDIYMAENFDVEVVGIDLSINIISLAIERAIGLKCCVEFECADCTKKTFPVNTFDVIYSRDTLLHIKDKPSLFRSFYKWLKRGGTLLITDYCKSEGSLSLGYAEYIKKGGYYIHDMKTYCRMLENAGFDDVVAEDRTNLFMKTLQQELNALHSKKDDFIDDFSEEDYNEITERWKAKQMRGADGEQIWSLFIAKK

SEQ ID NO: 19435 - protein, 490 aa, Glycine max
MAMVQDERCVQKSYWIEHTTDLSVESMMLDSNASDLDKEERPEVLSLLPPYEGKSVVELGAGIGRFTVELAKKAGQLLAVDFIESAIKKNESINGHHKNVKFMCADVTSPNLYISEGSVDLIFSNWLLMYLSDKEVENLAARMIKWLKVGGYVFFRESCFHQSGDSKRKYNPTHYREPRFYTKVFKECHISDDTRNSFELSLVGCKCIGAYVRNKKNQNQICWLWKKVRSQDDRGFQRFLDSVEYNHKDILLYESVFGQGFVSTGGLETTKEFVAKLGLKPGQKVLDVGCGTGGGDIYMAENFDVEVVGIDLSINVISLAIERAIGLKCSVEFECADCTKKTYPENTFDVIYSRDTLLHIKDKPPLFRSFYKWLKRGGTLIITDYCKSEGSPSLGYAEYIKKGGYHIHDMKTYCQMLENAGFDDVVAEDRTNLFMKTLQQELNALESKKDDFIDEFSEEDYNGITERWKAKQMRGADGEQIWGLFVAKKE

SEQ ID NO: 19436 - protein, 497 aa, Medicago truncatula
MAHLEAMKQGGEDEREVQRSYWKEHCVNLSVESMMLDSNASHLDKEERPEVLSLLPSYEGKSVLELGAGIGRFTAELAQKAGQLLAVDFIESAIKKNENTNGHHKNVKFMCADVTSPNLHISEGSVDLIFSNWLLMYLSDEEVKNLAERMVKWLNVNGCIFFRESCFHQSGDSKRKYNPTHYREPRFYTKVFKECHMSDDNGNSFELSLVGCKCIGAYVRNKKNQNQICWIWQKVKSQDDRRFQRFLDSVEYNHKDILLYEHVYGHGFVSTGGLETTREIVAKLGLKPGQKVLDVGCGIGGGDFYMAENFDVEVVAIDLSINMISLAIERAIGLKYAVEFECVDCTKKSYPDKTFDVIYSRDTLLHIKDKPTLFRSFYKWLKPGGTLLITDYCKSVGSLSVEYAEYIKKRGYYIHDMKAYFQMLENAGFDDVIAVDQTNLFLKTLQMELNALENKKVDFIDDFSEDDYNEIVERWKAKQMRGVAGEQIWGLFIAKKK

SEQ ID NO: 19437 - protein, 464 aa, Cajanus cajan
MMLDSNASDLDKEERPEVLSLLPAYEGKSVVELGAGIGRFTGELAKQAGQLLAVDFIESAIKKNESINGHHKNVKFMCADVTSPNLHISEGSVDLMFSNWLLMYLSDKEVENLAARMIKWLKVGGYIFFRESCFHQSGDSKRKYNPTHYREPRFYTKVFKECHMSDDTGNSFELSLVGCKCIGAYVRNKKNQNQICWIWQKVRSQDDRGFQRFLDSVEYNHKDIFLYECVFGQGFVSTGGLETTKEFVAKLGLKPGQKVLDVGCGTGGGDFYMAENFDVEVVGIDLSINMISLAIERAIGLKCSVEFECADCTKKTYAENTFDVIYSRDTLLHIKDKPSLFRSFHKWLKHGGTLLITDYCKSAGNLSLGYAEYIQKGGYCIHDMKTYCQMLENAGFDDVIVEDQTNLFMKTLQRELNALESKKGNFIDEFSEKDYNEITERWKAKQMRGANGEQIWGLFIAKKK

SEQ ID NO: 19438 - protein, 503 aa, Trifolium pratense
MANSEAMTQGGVMGEVKEDEREVQRSYWKEHCADLSVESMMLDSNASNLDKEERPEVLSLLPEFEGKSVLELGAGIGRFTSELAQKAGQLLAVDFIESAIKKNENTNGHYKNVKFMCADVTSPNLHISEGSVDLIFSNWLLMYLSDEEVKNLVERMVKWLKVDGYIFFRESCFHQSGDSKRKYNPTHYREPRFYTKVFKECHMSDENGNSFELSLVGCKCIGAYVRNKKNQNQICWIWQKVKSQDDRGFQRFLDSVEYNHKDILLYEHVYGQGFVSTGGLETTREIVAKLELKPGQKVLDVGCGIGGGDFYMAENFDVEVIAIDLSINMISLAIERAIGLKYSVEFECVDCTKKSYPENTFDVIYTRDTLLHIKDKPTLFRSFYKWLKPGGTLLITDYCKSVGSLSLEYSEYIRKRGYYIHDIKSYCQMLENAGFDDVIAEDQTNLFLKTLQMELNALENKKVDFIDDFCEDDYNEIVERWKAKQMRGVAGEQIWGLFIVKKK

SEQ ID NO: 19439 - protein, 490 aa, Cicer arietinum
MTQEEDEREVQRNYWREHCANLSVESMMLDSNASHLDKEERPEVLSLLPAYEGKSILELGAGIGRFTSELAKKAGQLLAVDFIESAIKKNENINGHHKNVKFMCADVTSPNLHISEGSVDLIFSNWLLMYLSDEEVENLAEKMVKWLKVDGYIFFRESCFHQSGDSKRKYNPTHYREPRFYTKVFKECHMSDDNGNSFELSLVGCKCIGAYVRNKKNQNQICWLWQKVKSHDDRRFQRFLDSVEYNHKDILIYEKVYGQGFVSTGGLETTKEFVAKLGLKPGQKVLDVGCGLGGGDFYMAENFDVEVIAIDLSINMISLAIERAIGLKYAVEFECVDCTKKTYPEKTFDIIYTRDTLLHIKDKPTLFRSFYKWLKPGGTLLISDYCKSVGNLSLEYAEYIKKRGYYIHDMNAYCKMLENAGFDYVIDQDQTNLFLKTLQKELNSLENKKVDFINEFSEDDYNEIVERWKAKQMRGEAGEQIWGLFIAKKI

SEQ ID NO: 19440 - protein, 489 aa, Trifolium pratense
EVKEDEREVQRSYWKEHCTDLSVESMMLDSNASNLDKEERPEVLSLLPEFEGKSVLELGAGIGRFTCELAQKAGQLLAVDFIESAIKKNENTNGHYKNVKFMCADVTSPNLHISEGSVDLIFSNWLLMYLSDEEVKKLAERMVKWLKVDGYIFFRESCFHQSGDSKRRYNPTHYREPRFYTKVFKECHISDENGNSFELSLVGCKCIGAYVRNKKNQNQICWIWQKVKSQDDRGFQRFLDSVEYNHKDILLYEHVYGQGFVSTGGLETTREIVAKLGLKQGQKVLDVGCGIGGGDFYMAENFDVEVVAIDLSINMISLAIERAIGLKYSVEFECVDCTKKSYPENTFDVIYTRDALLHIKDKPTLFRSFYKWLKPGGTLLITDYCKSVGSLSLEYTEYIRKRGYYIHDMKSYYQMLENAGFDDVIVEDQTNLFLKTLQMELNALENMKVDFVDDFCEDDYNEIVERWKAKQVRGVAGEQIWGLFIAKKK

SEQ ID NO: 19441 - protein, 506 aa, Arachis hypogaea
MNVMMPSLAATTPQDNRGGGRDERCVQRSYWIEHSADLSVESMMLDSNASDLDKEERPEVLSLLPAYEGKSVLELGAGIGRFTGELAKKAGQLLAVDFIESAIKKNESINGHHKNVKFMCADVTSPNLHISEGSIDLIFSNWLLMYLSDKEVENLAERMIKWLKVGGYIFFRESCFHQSGDSKRKYNPTHYREPRFYTKVYKECHMNDETGDSYELSLVGCKCIGAYVRNKKNQNQICWIWKKVRSQDDKGFQRFLDSVEYSHKDILRYEHVYGQGFVSTGGLETTKEIVKKLGLKPGQKILDVGCGTGGGDIYMAENFDVDVVGIDLSINMISLAIERVIGLKCTVEFECADCTRKTYPKNTFDVIYTHDAMLHIKDKPALFESFYKWLKHGGTLLITDYCKRAGSISLECEEYIKKGGYYIHDMEAYYQMLKNAGFDDVIAEDQTELFMKTLQQELNALENKKHYFIDEFSEEDYNEIVERWRAKQIRGAAGEQKWGLFIAKKK

SEQ ID NO: 19442 - protein, 446 aa, Panicum virgatum
MKITVRGSEMVYPAAETPRRRLWNSGPDLVVPRFHTPSVYFFRRRDSEGNDLAAADGSFFDGARMRRALAEALVPFYPMAGRLARDEDGRVEIDCNAGGVLFQEADAPDATVDDFGDFAPTMELKRLIPTVEYTDDISAFPLLVLQVTHFKCGGVAIGVGMQHHVADGFSGLHFINSWADLCRGIPIAVMPYIDRSLLRARDPPTPVYPHIEYQPAPAMLSEPPQAPLTAKPATPPTAVAIFRLSRADLGRLRSQIPAREGAPRFSTYAVLAAHVWRCASLARGLPADQPTKLYCATDGRQRLQPPLPEGYFGNVIFTATPLADAGTVTAGVAEGAAVIQAALDRMDDGYCRSALDYLELQPDLSALVRGAHTFRCPNLGLTSWVRLPIHDADFGWGRPVFMGPGGIAYEGLAFVLPSSNRDGSLSVAISLQAEHMEKFRKFIYDF

SEQ ID NO: 19443 - protein, 446 aa, Echinochloa colona
MKITVRGSEMVYPAAETPQRRLWNSGPDLVVPRFHTPSVYFFRRRDAEGKDLAGADGSFFDGARMRRALAEALVPFYPMAGRLAHDEDGRVEIDCNAGGVLFQEADAPDATVDDFGDFAPTMGLKRLIPTVEYTDDISAFPLLVLQVTHFKCGGVAIGVGMQHHVADGFSGLHFINSWADLCRGVPIAVMPYIDRSLLRARDPPAPAYPHVEYQPAPAMLSEPPQAPLTAKPAAPPTAVAIFRLSRADLGRLRSQLPAREGAPRFSTYAVLAAHVWRCASLARGLPADQPTKLYCATDGRQRLQPALPEGYFGNVIFTATPLADAGTVTAGVAEGAGVIQAALDRMDDGYCRSALDYLELQPDLSALVRGAHTFRCPNLGLTSWVRLPIHDADFGWGRPVFMGPGGIAYEGLAFVLPSANRDGSLSVAISLQAEHMEKFRKLIYDF

SEQ ID NO: 19444 - protein, 446 aa, Panicum virgatum
MKITVRGSEMVYPAAETPRRRLWNSGPDLVVPRFHTPSVYFFRRRDGEGNDLAAADGSFFDGARMRRALAEALVPFYPMAGRLARDEDGRVEIDCNAGGVLFQEADAPDATVDDFGDFAPTMELKRLIPTVEYTDDISAFPLLVVQVTHFKCGGVAIGVGMQHHVADGFSGLHFINSWADLCRGVPIAVMPYIDRSLLRARDPPTPVYPHVEYQPAPAMLSEPPQAPLMAKPATPPAAVAIFRLSRADLGRLRSQIPAREGVPRLSTYAVLAAHVWRCASLARGLPADQPTKLYCATDGRQRLQPPLPEGYFGNVIFTATPLADAGTVTAGVAEGAAVIQAALDRMDEGYCRSALDYLELQPDLSALVRGAHTFRCPNLGLTSWVRLPIHDADFGWGRPVFMGPGGIAYEGLAFVLPSANRDGSLSVAISLQAEHMEKFRKFIYDF

SEQ ID NO: 19445 - protein, 446 aa, Zea mays
MKITVRGSEMVYPAAETPRRRLWNSGPDLVVPRFHTPSVYFFRREDADGNDLAGADGSFFDGARMRRALAEALVPFYPMAGRLARDEDGRVEIDCNAGGVLFQEADAPDATIDYFGDFAPTMELKRLIPTVDFTDDISSFPLLVLQVTHFKCGGVAIGVGMQHHVADGFSGLHFINSWADLCRGVPIAVMPFIDRSLLRARDPPTPAYPHIEYQPAPAMLSEPPQAALTSKPATPPTAVAIFKLSRAELVRLRSQVPAREGAPRFSTYAVLAAHVWRCASLARGLPADQPTKLYCATDGRQRLQPPLPEGYFGNVIFTATPLANAGTVTAGVAEGASVIQAALDRMDDGYCRSALDYLELQPDLSALVRGAHTFRCPNLGLTSWVRLPIHDADFGWGRPVFMGPGGIAYEGLAFVLPSANRDGSLSVAISLQAEHMEKFRKLIYDF

SEQ ID NO: 19446 - protein, 446 aa, Saccharum officinarum
MKITVRGSEMVYPAAETPRRRLWNSGPDLVVPRFHTPSVYFFRRRDADGNDLTAPDGSFFDGARMRRALAEALVPFYPMAGRLARDEDGRVEIDCNAAGVLFQEADAPDATIDYFGDFAPTMELKRLIPTVDFSDDTAFPLLVLQVTHFKCGGVAIGVGMQHHVADGFSGLHFINSWADLCRGVPIAVMPFIDRSLLRARDPPTPAYPHIEYQPAPAMLSSEPPQAALTAKPATPPAAVAIFKLSRAELGRLRSQVPAREGAPRFSTYAVLAAHVWRCASLARGLPADQPTKLYCATDGRQRLQPPLPEGYFGNVIFTATPLANAGTVTAGVAEGAGVIQAALDRMDDGYCRSALDYLELQPDLSALVRGAHTFRCPNLGLTSWVRLPIHDADFGWGRPVFMGPGGIAYEGLAFVLPSANRDGSLSVAISLQAEHMEKFRKLIYDF

SEQ ID NO: 19447 - protein, 448 aa, Sorghum bicolor
MKITVRGSEMVYPAAETPRRRLWNSGPDLVVPRFHTPSVYFFRRRDADGNDLTAADGSFFDGARMRRALAEALVPFYPMAGRLARDEDGRVEIDCNAAGVLFQEADAPDATIDYFGDFAPTMELKRLIPTVDFSDDTAFPLLVLQVTHFKCGGVAIGVGMQHHVADGFSGLHFINSWADLCRGVPIAVMPFIDRSLLRARDPPAPVYPHVEYQPAPAMLSSEPPQAALTAKPATPPAAVAIFKLSRAELGRLRSQVPAREREGAPRFSTYAVLAAHVWRCASLARGLPADQPTKLYCATDGRQRLQPPLPEGYFGNVIFTATPLANAGTVTAGVAEGAAVIQAALDRMDDGYCRSALDYLELQPDLSALVRGAHTFRCPNLGLTSWVRLPIHDADFGWGRPVFMGPGGIAYEGLAFVLPSANRDGSLSVAISLQAEHMEKFRKLIYDF

SEQ ID NO: 19448 - protein, 442 aa, Oryza sativa
MKINVRGSTMVRPAEETPRVRLWNSSLDLVVPRFHTPSVYFFRRGEAAAAEGGSYFDGERMRRALAEALVPFYPMAGRLAHDEDGRVEIDCNGEGVLFVEADAPGATVDDFGDFAPTMDLKRLIPTVDYTDGISSFPILVLQVTHFKCGGVALGVGMQHHVADGFSGLHFINSWADLCRGVPIAVMPFIDRTLVRARDPPAPSHPHVEYQPAPAMLAPEPPQALTAKPAPPPTAVDIFKLSRSDLGRLRSQLPRGEGAPRYSTYAVLAAHVWRCASLARGLPAEQPTKLYCATDGRQRLQPSLPDGYFGNVIFTATPLAEAGRVTGSLADGAATIQSALDRMDSGYCRSALDYLELQPDLSALVRGAHTFRCPNLGLTSWVRLPIHDADFGWGRPVFMGPGGIAYEGLAFVLPSASGDGSLSVAISLQAEHMEKFRKMIFDF

SEQ ID NO: 19449 - protein, 442 aa, Triticum aestivum
MKITVRGSTVVVPAEETPRLRLWNANPDLVVPRFHTPSVYFFRRGAGEGEEAGRYFDAERMRRALAEALVPFYPMAGRLARDEDGRVEIDCNAEGVLFVEADAPDGTVDDFGDFAPTMDLKRLIPAVDFTGGISSYPLLVVQVTHFKCGGVALGIGMQHHVADGFSGLHFINSWADLCRGVPIAVMPFIDRTLLRARDPPTPSHPHIEYQPAPAMLDSEEPQALTAKPEAPPTAVDIFKLSRADLGRLRAQLPTGEGAPRFSTYAVLGAHVWRCASLARGLSPEQPTKLYCATDGRQRLQPPLPEGYFGNVIFTATPLAVAGKVTGSLADGATTIQAALEVMDNEYCRSALDYLEMQPDLSALVRGAHTFRCPNLGLTSWVRLPIHDADFGWGRPVFMGPGGIAYEGLAFVLPSASRDGSLSVAISLQAEHMEKFRKMIFDF

SEQ ID NO: 19450 - protein, 441 aa, Secale cereale
MKITVRGSTVVVPAEETPRLRLWNANPDLVVPRFHTPSVYFFRRGAGEQEADRYFDAERMRRALAEALVPFYPMAGRLARDEDGRVEIDCNAEGVLFVEADAPDGTVDDFGDFAPTMDLKRLIPAVDFTGGISSYPLLVVQVTHFKCGGVALGIGMQHHVADGFSGLHFINSWADLCRGVPIAVMPFIDRTLLRARDQPTPSHPHIEYQPAPAMLDSEEPQALSAKPEAPPTAVDIFKLSRADLGRLRAQLPTGEGAPRFSTYAVLGAHVWRCASLARGLSPEQPTKLYCATDGRQRLQPPLPEGYFGNVIFTATPLAVAGKVTVSLADGATTIQAALEVMDNEYCRSALDYLEMQPDLSALVRGAHTFRCPNLGLTSWVRLPIHDADFGWGRPVFMGPGGIAYEGLAFVLPSASRDGSLSVAISLQAEHMEKFRKMIFDF

SEQ ID NO: 19451 - protein, 441 aa, Cenchrus ciliaris
MAITVRRSTMVRPARETPRQRLWNSNLDLVVPRFHTPSVYFYRRGGGGPEAAEGFFDGERMRRALAEALVPFYPMAGRLARDEDGRVEIDCNGEGVLFVEADAPNAAVDDYGDFAPTMELKRLIPAVDYTDDISAFPLLVLQVTYFKCGGVSLGVGMQHHVADGMSGLHFINSWSDLCRGAQIAVMPFIDRTLLRARDPPTPSFQHIEYQPAPAMLSSTPQSLTSKSKPPATAVDIFKLTRSDLGRLRSQLPTGEGAPRYSTYAVLAAHVWRCASLARGLTPEQPTKLYCATDGRQRLQPPLPDGYFGNVIFTATPLAEAGKVTSGVADGAAVIQGALDRMDNDYCRSALDYLELQPDLSALVRGAHTFRCPNLGLTSWVRLPIHDADFGWGRPVFMGPGGIAYEGLAFVLPSANGDGSLSIAISLQAEHMEKFRKLIYEL

SEQ ID NO: 19452 - protein, 442 aa, Oryza sativa
MAITVRRSTMVRPAWETPRVRLWNSNLDLVVPRFHTPSVYFYRRGPEGGGAPEGFFDGERMRRALAEALVPFYPMAGRLARDEDGRVEIDCNGEGVLFVEADAPDASVDDYGDFAPTMELKRLIPAVDYTDDISSFSLLVLQVTYFKCGGVSLGVGMQHHVADGMSGLHFINSWSDLCRGTQIAIMPFIDRTLLRARDPPTPSYPHVEYQPAPAMLSSVPQSVTANKTTPPPTAVDIFKLTRSDLGRLRSQLPSGEGAPRFSTYAVLAAHVWRCVSLARGLPSEQPTKLYCATDGRQRLQPPLPEGYFGNVIFTATPLAEAGKVTSGLADGAAVIQEALDRMNDSYCRSALDYLELQPDLSALVRGAHTFRCPNLGLTSWVRLPIHDADFGWGRPVFMGPGGIAYEGLAFVLPSANKDGSLSIAISLQAEHMEKFRKLIFEV

SEQ ID NO: 19453 - protein, 441 aa, Avena sativa
MKITVRSSTVVVPAAETPRLRLWNANPDLVVPRFHTPSVYFYRRGGGEDGGDACYFDAGRMRRALAEALVPFYPMAGRLAHDEDGRVEIDCNAEGVLFVEADAPDGAVDDFGDFAPTMELKRLIPAVDYSGDISSFPLLVLQVTYFKCGGVSLGVGMQHHVADGMSGLHFINSWSDLCRGAQIAVMPFIDRTLLRARDPPTPSYTHVEYQPAPAMLSSAPQALTGKPTLAPTAVDIFKLTRSELGRLRSQLPTGEGAPRFSTYAVLAAHVWRCVSLARGLPAEQPTKLYCATDGRHRLQPPLPEGYFGNVIFTATPLAEAGKVTGAVADGAAVIQGALDRMSDDYCRSALDYLETQPDLSALVRGAHTFRCPNLGLTSWVRLPIHDADFGWGRPVFMGPGGIAYEGLAFVLPSANKDGSLSIAISLQAEHMEKFRKLIADV

SEQ ID NO: 19454 - protein, 442 aa, Brachypodium distachyon
MKITVRGSTVVRPAEETPRMRLWNANPDLVVPRFHTPSVYFYRRDAAVEVGCYFDAERMRRALAEALVPFYPMAGRLARDEDGRVEIDCNAEGVLFVEADAPDGTVDDYGDFAPTMELKRLIPAIDFTGGISSYPLLVVQVTHFKCGGVALGIGMQHHVADGFSGLHFINSWADLCRGVPIAVMPFIDRTLLRAHDPPTPAHPHIEYQPAPAMLDSEPPQAILAGAKPDQPPAAVDIFKLSRSDLGRLRAQLPTGEGAPRFSTYAVLGAHVWRCASLARGLAPEQPTKLYCATDGRQRLLPPLPEGYFGNVIFTATPLAEAGKVIASLADGANTIQAALERMDNEYCRSALDYLELQPDLSALVRGAHTFRCPNLGLTSWVRLPIHEADFGWGRPVFMGPGGIAYEGLAFVLPSASRDGSLSVAISLQAEHMEKFRKMIFDF

SEQ ID NO: 19455 - protein, 440 aa, Avena sativa
MKITVRSSTVVVPAAETPRVRLWNANPDLVVPRFHTPSVYFYRRGGDGDACCYFDAARMRRALAEALVPFYPMAGRLAHDEDGRVEIDCNAEGVLFVEADAPDGAVDDFGDFAPTMGLKRLIPTVDFTGGISSYPLLVVQVTHFKCGGVALGIGMQHHVADGFSGLHFINSWSDLCRGVPIAVMPFIDRTLLRARDPPVPTHPHIEYQPAPAMLGSEEPQALAGKPESPPTAVDIFKLSRSDLGRLRAQLPTGEGAPRFSTYAVLGAHVWRCASLARGLAPEQPTKLYCATDGRQRLTPTLPDGYFGNVIFTATPLAEAGKVTGSLADGATTIQDALEKMDDEYCHSALDYLELQPDLSALVRGAHTFRCPNLGLTSWVRLPIHDADFGWGRPVFMGPGGIAYEGLAFVLPSANRDGSLSVAISLQAEHMEKFRKMIFDF

SEQ ID NO: 19456 - protein, 444 aa, Avena sativa
MKITVRSSTVVVPAAETPRVRLWNANPDLVVPRFHTPSVYFYRRGGEGGGDGDACCYFDAARMRRALAEALVPFYPMAGRLAHDEDGRVEIDCNAEGVLFVEADAPDGAVDDFGDFAPTMGLKRLIPTVDFTGGISSYPLLVVQVTHFKCGGVALGIGMQHHVADGFSGLHFINSWSDLCRGVPIAVMPFIDRTLLRARDPPVPTHPHIEYQPAPAMLGSEEPQALAGKPESPPTAVDIFKLSRSDLGRLRAQLPTGEGAPRFSTYAVLGAHVWRCASLARGLAPEQPTKLYCATDGRQRLTPTLPDGYFGNVIFTATPLAEAGKVTGSLADGATTIQDALEKMDDEYCHSALDYLELQPDLSALVRGAHTFRCPNLGLTSWVRLPIHDADFGWGRPVFMGPGGIAYEGLAFVLPSANRDGSLSVAISLQAEHMEKFRKMIFDF

SEQ ID NO: 19457 - protein, 440 aa, Zea mays
MAITVRRSTMVRPARETPRQRLWNSNLDLVVPRFHTPSVYFYRRDGPVPDAEGFFDGERMRRALAEALVPFYPMAGRLARDEDGRVEIDCNGEGVLFVEADAPDASVDDYGDFAPTMELKRLIPTVDYTDDISAFPLLVLQVTYFKCGGVSLGVGMQHHAADGMSGLHFINSWSDLCRGAQISVMPFIDRTLLRARDPPTPSFQHIEYQPAPAMLSSTTQFLASKSKPPATAVDIFKLTRSDLGRLRSQLPAGEGAPRFSTYAVLAAHVWKCVSLARSLPPEQPTKLYCATDGRQRLQPPLPDGYFGNVIFTATPLAEAGKVTSELAEGAAVIQGALDRMDNDYCRSALDYLELQPDLSALVRGAHTFRCPNLGLTSWVRLPIHDADFGWGRPVFMGPGGIAYEGLAFVLPSANGDGSLSIAISLQAEHMEKFRKLIGEA

SEQ ID NO: 19458 - protein, 438 aa, Echinochloa colona
MAITVRRSTMVRPARETPRQRLWNSNLDLVVPRFHTPSVYFYRRGGPEVEGFFDGERMRRALAEALVPFYPMAGRLARDEDGRVEIDCNGEGVLFVEADAPDAVVDDYGDFAPTMELKLLIPAVDYTDDISAFPLLVLQVTYFKCGGVSLGVGMQHHVADGMSGLHFINSWSDLCRGAQISVMPFIERTLLRARDPPTPSFQHIEYQPAPAMLSSTPQSLTSKSKPPATAVDIFKLTRSDIGRLRSQLPTGEGAPRFNTYAVLAAHVWKCVSLARGLAPEQPTKLYCATDGRQRLQPPLPEGYFGNVIFTATPLAEAGKVTSGLAEGAAVIQGALDRMDNDYCRSALDYLELQPDLSALVRGAHTFRCPNLGLTSWVRLPIHDADFGWGRPVFMGPGGIAYEGLAFVLPSSNGDGSLSIAISLQAEHMEKFRKLIYDI

SEQ ID NO: 19459 - protein, 441 aa, Sorghum bicolor
MVITVRRSTMVRPARETPRQRLWNSNLDLVVPRFHTPSVYFYRRGDGAAAPAEGFFDGERMRRALAEALVPFYPMAGRLARDEDGRVEIDCNGEGVLFVEADAPDVSVDDYGDFAPTMDLKRLIPTVDYTDDISAFPLLVLQVTHFKCGGISLGVGMQHHVADGMSGLHFINSWSDLCRGAQISVMPFIDRTLIRARDPPTPSFHHIEYQPAPAMLSSTPQFLASKSKPPATAVDIFKLTRSDLGRLRSQLAAGEGAPRFSTYAVLAAHVWKCVSLARSLPPEQPTKLYCATDGRQRLQPPLPDGYFGNVIFTATPLAEAGKVTSGLAEGAAVIQGALDRMDNDYCRSALDYLELQPDLSALVRGAHTFRCPNLGLTSWVRLPIHDADFGWGRPVFMGPGGIAYEGLAFVLPSANGDGSLSIAISLQAEHMEKFRKLICEV

SEQ ID NO: 19460 - protein, 443 aa, Brachypodium distachyon
MAITVKRSTMVRPAGETPRVRLWNSNLDLVVPRFHTPSVYFYRRAEAGGDAGATGVFFDGERMRRALAEALVPFYPMAGRLARDEDGRVEIDCNGEGVLFVEADAPDAAVDDYGDFAPTMELKRLIPAVDYTDDISSFPLLVLQVTYFKCGGVSLGVGMQHHVADGMSGLHFINSWSDLCRGLQIAIMPFIDRTLLRARDPPTPSYPHVEYQPAPAMLSSAPQVLTGKPMLPPTAVDIFKLTRSELGRLRSQLPSGEGAPRFSTYAVLAAHVWRCVSLARSLPPEQPTKLYCATDGRQRLQPPLPDGYFGNVIFTATPLAEAGKVTSGLEDGATVIQGALDRMSDDYCRSALDFLELQPDLSALVRGAHTFRCPNLGLTSWVRLPIHDADFGWGRPVFMGPGGIAYEGLAFVIPSSSKDGSLSIAISLQAEHMEKFRKLIFEV

SEQ ID NO: 19461 - protein, 442 aa, Avena sativa
MKITVRSSTVVVPAAETPRVRLWNANPDLVVPRFHTPSVYFYRRGGGEDGGDACYFDAGRMRRALAEALVPFYPMAGRLAHDEDGRVEIDCNAEGVLFVEADAPDGAVDDFGDFAPTMGLKRLIPTVDFTGGISSYPLLVAQVTHFKCGGVALGIGMQHHVADGFSGLHFINSWSDICRGVPIAVMPFIDRTLLRARDPPVPTHPHIEYQPAPAMLGSEEPQALAGKPESPPTAVDIFKLSRSDLGRLRAQLPTGEGAPRFSTYAVLGAHVWRCASLARGLAPEQPTKLYCATDGRQRLTPTLPDGYFGNVIFTATPLAEAGKVTGSLADGATTIQDALEKMDDEYCHSALDYLELQPDLSALVRGAHTFRCPNLGLTSWVRLPIHDADFGWGRPVFMGPGGIAYEGLAFVLPSANRDGSLSVAISLQAEHMEKFRKMIFDF

SEQ ID NO: 19462 - protein, 441 aa, Avena sativa
MKITVRSSTVVVPAAETPRVRLWNANPDLVVPRFHTPSVYFYRRGGEDGGDACYFDAGRMRRALAEALVPFYPMAGRLAHDEDGRVEIDCNAEGVLFVEADAPDGAVDDFGDFVPTMGLKRLIPTVDFTGGISSYPLLVVQVTHFKCGGVALGIAMQHHVADGFSGLHFINSWSDLCRGVPIAVMPFIDRTLLRARDPPVPTHPHIEYQPAPAMLGSEEPQALAGKPESPPTAVDIFKLSRSDLGRLRAQLPTGEGAPRFSTYAVLGAHVWRCASLARGLAPEQPTKLYCATDGRQRLTPTHPDGYFGNVIFTATPLAEAGKVTGSLADGATTIQDALEKMDDEYCHSALDYLELQPDLSALVRGAHTFRCPNLGLTSWVRLPIHDADFGWGRPVFMGPGGIAYEGLAFVLPSANRDGSLSVAISLQAEHMEKFRKMIFDF

SEQ ID NO: 19463 - protein, 440 aa, Avena sativa
MKITVRSTTVVVPAAETPRLRLWNANPDLVVPRFHTPSVYFYRRGGGDGDACYFDAGRMRRALAEALVTFYPMAGRLAHDEDGRVEIDCNAEGVLFLEADAPDGTVDDFGDFAPTMGLKRLIPTVDFTGGISSYPLLVAQVTHFKCGGVALGIGMQHHVADGFSGLHFINSWSDICRGVPIAVMPFIDRTLLRARDPPVPTHPHIEYQPAPAMLGSEEPQALAGKPESPPTAVDIFKLSRSDLGRLRAQLPTGEGAPRFSTYAVLGAHVWRCASMARGLAPEQPTKLYCATDGRQRLTPTLPDGYFGNVIFTATPLAEAGKVTGSLADGATTIQEALEKMDDEYCHSALDYLELQPDLSALVRGAHTFRCPNLGLTSWVRLPIHDADFGWGRPVFMGPGGIAYEGLAFVLPSANRDGSLSVAISLQAEHMEKFRKMIFDF

SEQ ID NO: 19464 - protein, 438 aa, Hordeum vulgare
MAITVRRSTMVRPAVERPRERLWNSNLDLVVPRFHTPSVYFYRRPEAGADGFFDADRMRLALADALVPFYPMAGRLARDEDGRVEIDCSGEGVLFVEADAPTATVDDYGDFAPTMDLKRLIPPVDYTDDISSFPLLVLQVTYFKCGGVSLGVGMQHHVADGMSGLHFINSWSDLCRGVKIAVMPFIDRTLVRARDPPTPSYPHVEYQPAPAMLSSVPQALGGKPVPPPTAVDIFKLTRSELGRLRSQLPTGEGAPRFSTYAVLAAHVWRCVSLARNLAPEQPTKLYCATDGRQRLQPPLPEGYFGNVIFTATPLAEAGKVTSGLAEGAAVIQGALDRMTGDYCQSALDYLEMQPDLSALVRGAHTFRCPNLGLTSWVRLPIHDADFGWGRPVFMGPGGIAYEGLAFVLPSASKDGSLSIAISLQAEHMEKFRKLILDV

SEQ ID NO: 19465 - protein, 439 aa, Setaria italica
MAITVRRSTMVRPARETPRQRLWNSNLDLVVPRFHTPSVYFYRRGGGPEAEGFFDGERMRRALAEALVPFYPMAGRLARDEDGRVEIDCNGEGVLFVEADAPNAAIDDYGDFAPTMELKRLIPAVDYTDDISAFPLLVLQVTYFKCGGVSLGVGMQHHVADGMSGLHFINSWSDLCRGAQISVMPFIDRTLLRARDPPTPSFQHIEYQPAPAMLSSTPQSLTSISKPPATAVDIFKLTRSDLGRLRSQLPTGEGAPRFNTYAVLAAHVWKCVSLARGLTPEQPTKLYCATDGRQRLQPPLPDGYFGNVIFTATPLAEAGKVTSGLAEGAAVIQGALDRMDNDYCRSALDYLELQPDLSALVRGAHTFRCPNLGLTSWVRLPIHDANFGWGRPVFMGPGGIAYEGLAFVLPSANGDGSLSIAISLQAEHMVKFRKLIYEL

SEQ ID NO: 19466 - protein, 438 aa, Secale cereale
MAITVRRSTMVRPAVERPRERLWNSNLDLVVPRFHTPSVYFYRRPDAGADGFFDADRMRLALADALVPFYPMAGRLARDEDGRVEIDCSGEGVLFVEADAPGAAVDDYGDFAPTMDLKRLIPPVDYTDDISSFPLLVLQVTYFKCGGVSLGVGMQHHVADGMSGLHFINSWSDLCRGAKIAVMPFIDRTLVRARDPPTPSYPHIEYQPAPAMLSSVPQALSGKPTPPPTAVDIFKLTRSELGRLRSQLPTGEGAPKFSTYAVLAAHVWRCVSIARGLSPEQPTKLYCATDGRQRLQPPLPEGYFGNVIFTATPLAEAGKVTSGVAEGAAVIQGALDRMTGDYCQSALDYLEMQPDLSALVRGAHTFRCPNLGLTSWVRLPIHDADFGWGRPVFMGPGGIAYEGLAFVLPSATKDGSLSIAISLQAEHMEKFRKLILDV

SEQ ID NO: 19467 - protein, 442 aa, Hordeum vulgare
MRRQMAITVRRSTMVRPAVERPRERLWNSNLDLVVPRFHTPSVYFYRRPEAGADGFFDADRMRLALADALVPFYPMAGRLARDEDGRVEIDCSGEGVLFVEADAPTATVDDYGDFAPTMDLKRLIPPVDYTDDISSFPLLVLQVTYFKCGGVSLGVGMQHHVADGMSGLHFINSWSDLCRGVKIAVMPFIDRTLVRARDPPTPSYPHVEYQPAPAMLSSVPQALGGKPAPPPTAVDIFKLTRSELGRLRSQLPTGEGAPRFSTYAVLAAHVWRCVSLARNLAPEQPTKLYCATDGRQRLQPPLPEGYFGNVIFTATPLAEAGKVTSGLAEGAAVIQGALDRMTSDYCQSALDYLEMQPDLSALVRGAHTFRCPNLGLTSWVRLPIHDADFGWGRPVFMGPGGIAYEGLAFVLPSASKDGSLSIAISLQAEHMEKFRKLILDV

SEQ ID NO: 19468 - protein, 453 aa, Sorghum bicolor
MDSLPRKRKGGARAVCSLSGSRHDAPAAARNRKRTCREPKPRPEKKKPSASASASARGGGVVMTAPPASGSRAAPDSPGRGLKRKLGCIDSATRMGRKKRLESEYELGAEIGQGKFGSVRICRARAGGGGDEFACKALPKNGEETVHREVEIMQHLSGHPGVVTLRAVFEDADRFYLVMELCGGGRLLDEIAREGKFSEQRAAIVIKDLMSVLKYCHEMGVVHRDIKPENILLTKAGKVKLADFGLAARVTNGQKLFGVAGSPAYVAPEVLSGSYSEKVDIWGAGVLLHVLLLGSLPFQGGSLDAVFESIKTVELDFSSSPWKSISVLGRDLIGRMLNRDVSSRMTADEVLGHPWVVFYTECPLKVVAANLCLTNKIIAPKIPWDRHKPECDSLSDSSRRSEDQDECGLVDALTAAITRVRISEPKRSRLCSPAITIQQECSSNLKNNLCTAF

SEQ ID NO: 19469 - protein, 447 aa, Zea mays
MDSLPRKRKGARAACSMAGSRHDAPAARKRTCREPKPRPEKKKPSSADEGSASARGGVVMTAPPASGRAAPDSPGRGLKRKLGCIDSATRMGRKKRLESEYELGAEIGQGKFGSVRICRAKVGGDEFACKELPKNGEETVHREVEIMQHLSGHPGVVTLRAVFEDADKFYLVMELCSGGRLLDEIAREGKFSEQRAAIVIKDLMAVLKYCHEMGVVHRDVKPENILLTKAGKVKLADFGLAARVTNGQKMFGVAGSPAYVAPEVLSGSYSEKVDIWGAGVLLHVLLLGSLPFQGGSLDAVFESIKTLELDFSSTPWESISVLGRDLIGRMLNRDVSCRMTADEVLSHPWVVFYTECPLKVVAANLCLPNKVIAPKIPWDRHKSECDSVSDASQRSEDQDECGIVDALAAAITRVRISEPKRSRLCSPAITIQQECSSNLKNNLCTAF

SEQ ID NO: 19470 - protein, 448 aa, Brachypodium distachyon
MESLPRKRKGARSLAGSLHDASADRKRTCRERKPRPDKKKKNKPSAGDDAASTRGGVVMTAPPTSGMAAPDSPGRGLKRKVGCIESATRIGRKKRLDSEYALGDEIGQGKFGSVRICRAKAGGEEFACKALPKNGEETVHREVEIMQHLSGHPGVVTLKAVFEDTDKFYLVMELCSGGRLLDEIARDGKFSEQRAAIVIKDLMSVLKYCHEMGVIHRDIKPENILLTKTGKMKLADFGLAARVTNGQKLSGIAGSPAYVAPEVLSGSYSEKVDIWGAGVLLHVLLLGSLPFQGDSLEAVFDAIRTVELDFHSGPWKSMSVLGRDLISRMLDRDVSSRITAAGVLSHPWVLFYTECTLKAVTANLCVTNKIVAPCFPWDRIRSHCDSSASDSSSQRSEDQDECGIVDALTAAITHVRISEPKRTRLCSPAISIQQECSSNLKSNLCTAF

SEQ ID NO: 19471 - protein, 448 aa, Hordeum vulgare
MESLPRKRKGARSLAGSLHDDSADRKRTCRERKPRPEKKKKKPSAGGDDAATASGRGGVVMTAPPASGRATPDSPGRGLKRKVGCIESATRIGRKKRLETEYELGDEIGQGKFGSVRICRAKAGGEEFACKALPKNGEETVHREVEIMQHLSGHPGVVTLKAVFEDADKFYLVMELCSGGRLLDEMARDGIFSEQRAALVIKDLMSVVKYCHEMGVIHRDIKPENILLTKTGKMKLADFGLAARVTNGQKLSGVAGSPAYVAPEVLSGRYSEKVDIWGAGVLLHVLLLGSLPFQGGSLEAVFEAIKTVELDFNSGPWESMSVLGRDLISRMLDRDVSSRITADQVLCHPWVLFYTECTLKAVTPNVTNKIVAPRIAWDRIRSHCESSASDSSSQRSEDQDECGIVDALTAAITHVRISEPKRTRLCSPGIPIQQECSSNLKSNLCTAF

SEQ ID NO: 19472 - protein, 446 aa, Hordeum vulgare
SLPRKRKGARSLAGSLHDDSADRKRTCRERKPRPEKKKKKPSAGGDDAATASGRGGVVMTAPPASGRATPDSPGRGLKRKVGCIESATRIGRKKRLETEYELGDEIGQGKFGSVRICRAKAGGEEFACKALPKNGEETVHREVEIMQHLSGHPGVVTLKAVFEDADKFYLVMELCSGGRLLDEMARDGIFSEQRAALVIKDLMSVVKYCHEMGVIHRDIKPENILLTKTGKMKLADFGLAARVTNGQKLSGVAGSPAYVAPEVLSGRYSEKVDIWGAGVLLHVLLLGSLPFQGGSLEAVFEAIKTVELDFNSGPWESMSVLGRDLISRMLDRDVSSRITADQVLCHPWVLFYTECTLKAVTPNVTNKIVAPRIAWDRIRSHCESSASDSSSQRSEDQDECGIVDALTAAITHVRISEPKRTRLCSPGIPIQQECSSNLKSNLCTAF

SEQ ID NO: 19473 - protein, 453 aa, Oryza sativa
MESSLPRKRKGARSACSLVGSFHEPTTVARKRACREPKPRPEKKKKDPSSDDASGRGGGGGVVQTAPPASGRAAPESPSRGLKRKLGCIESATRMGRKKRLESEYELGAEIGQGKFGSVRICRAKVGGEEFACKALPKNGEETVHREVEIMQHLSGHPGIVTLKAVFEDADKFYLVMELCGGGRLLDEMAREGKFSEQRAAIVIKDLMSVVKYCHEMGVVHRDIKPENILLTKAGKIKLADFGLAARVADGQKLSGIAGSPAYVAPEVLSGCYSEKVDVWGAGVLLHVLLHGSLPFQGGSLDAVFEAIKTVELDFHSGPWESISSLARDLISRMLNRDVPSRITADEVLSHPWVVFYTECPLKAVTANLSITNNIVAPRITWDRIRLHCESISSDSSSQRSADQDECGIVDALTAAITNVRISEPKRSRLCNPAIPIQQECSSNLKSNLCTAF

SEQ ID NO: 19474 - protein, 543 aa, Echinochloa colona
MAGREQALLSTEIVNRGVEPSGPDAGSPTFSVRVRRRLPDFLQSVNLKYVRLGYHYLISHGVYLATIPVIVLVCGAELGSLSRDELWDKVWGEATYDLATVLAFLAVLAFTISVYIMSRPRPVYLIDFACYKPADELKVSKAEFIDLARKSGKFDEDSLAFQSRLLAKSGIGDESYMPRCVFEPNVNCATMKEGRAEASTAMFAALDELFDKCRVRPKDVGVLVVNCSLFNPTPSLSAMIVNHYKMRGNILSYNLGGMGCSAGVIAVDLARDMLQASGAGLAVVVSTEAVSFTWYPGKRRSMLIPNAFFRAGCAAVLLSNRRRDFHRAKYQLEHVVRTHKGADDRAFRSVYQEEDEQRIKGLSISRDLLEVGGHALKTNITTLGPLVLPFSEQLMFFAGVLFRHLFPSKASTPPPATTPGDASAAAPYIPDFKRAFEHFCMHAASRDVLEHLQSNLGLRDADLEASRAALHRFGNTSSSSIWYELAYLEAKGRVRRGDRVWQLAFGSGFKCNSAVWRAVRRVRRPSRSPWLDCVDQYPERINA

SEQ ID NO: 19475 - protein, 543 aa, Zea mays
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARKSGKFDEDSLAFQSRLLAKSGIGDESYMPRCVFEPNASCATMKEGRAEASTAMFAALDELFDKCRVRPKDVGVLVVNCSLFNPTPSLSAMIVNHYKMRGNILSYNLGGMGCSAGVIAIDLARDMLQASGAGLAVVVSTEAVSFTWYPGKRRSMLIPNAFFRAGCAAVLLSNRRRDFHRAKYQLEHVVRTHKGADDRAFRSVYQEEDEQRIKGLSISRDLLEVGGHALKTNITTLGPLVLPFSEQLLFFAGVLFRHLFPSKASTPAPPTTPGDASAAAPYIPDFKRAFEHFCMHAASRDVLEHLQSNLGLRDADLEASRAALHRFGNTSSSSIWYELAYLEAKGRVRRGDRVWQLAFGSGFKCNSAVWRAVRRVRRPARSPWLDCIDQYPARMDA

SEQ ID NO: 19476 - protein, 543 aa, Saccharum officinarum
MAREEQALLSTEIVNRGVEPSGPDAGSPTFSVRVRRRLPDFLQSVNLKYVRLGYHYLISHGVYLATIPVIVLVCGAEVGSLSRDELWRKVWGEATYDLATVLAFLAVLAFTISVYIMSRPRPVYLIDFACYKPADELKVSKAEFIDLARKSGKFDEDSLAFQSRLLAKSGIGDESYMPRCVFEPNANCATMKEGRAEASTAMFAALDELFDRCRVRAKDVGVLVVNCSLFNPTPSLSAMIVNHYKMRGNILSYNLGGMGCSAGVIAIDLARDMLQASGAGLAVVVSTEAVSFTWYPGKRRSMLIPNAFFRAGCAAVLLSNRRRDFHRAKYQLEHVVRTHKGADDRAFRSVYQEEDEQRIKGLSISRDLLEVGGHALKTNITTLGPLVLPFSEQLLFFAGVLFRHLFPSKASTPPPPTTPGDASAAAPYIPDFKRAFEHFCMHAASRDVLDHLQSNLGLRNADLEASRAALHRFGNTSSSSIWYELAYLEAKGRVRRGDRVWQLAFGSGFKCNSAVWRAVRRVRRPARSPWLDCIDQYPSRMDA

SEQ ID NO: 19477 - protein, 537 aa, Sorghum bicolor
MAREEQALLSTEIMNRGVEPSGPDAGSPTFSVRVRRRLPDFLQSVNLKYVRLGYHYLISHGVYLATIPVIVLVCGAEVGSLSRDELWRKVWGEATYDLATVLAFLAVLAFTISVYIMSRPRPVYLIDFACYKPADELKVSKAEFIDLARKSGKFDEDSLAFQSRLLAKSGIGDESYMPRCVFEPNANCATMKEGRAEASTAMFAALDELFDKCRVRPKDVGVLVVNCSLFNPTPSLSAMIVNHYKMRGNILSYNLGGMGCSAGVIAIDLARDMLQASGAGLAVVVSTEAVSFTWYPGKRRSMLIPNAFFRAGCAAVLLSNRRRDFHRAKYQLEHVVRTHKGADDRAFRSVYQEEDEQRIKGLSISRDLLEVGGHALKTNITTLGPLVLPFSEQLLFFAGVLFRHLFPSKASTPGDASAAAPYIPDFKRAFEHFCMHAASRDVLEHLQSNLGLRNSDLEASRAALHRFGNTSSSSIWYELAYLEAKGRVRRGDRVWQLAFGSGFKCNSAVWRAVRRVRRPARSPWLDCVDQYPARMDA

SEQ ID NO: 19478 - protein, 542 aa, Oryza sativa
MAREQALLSTEIVNRGVEPSGPDAGSPTFSVRVRRRLPDFLQSVNLKYVRLGYHYLISHGVYLATIPVIVLVCGAEVGSLSRDELWRKVWGEATYDLATVLAFLAVLAFTISVYIMSRPRPVYLIDFACYKPADELKVSKAEFIDLARKSGKFDEDSLAFQSRLLAKSGIGDESYMPRCVFEPGTNCATMKEGRAEASAAMFAALDELFDKCRVRPKDVGVLVVNCSLFNPTPSLSAMIVNHYKMRGNILSYNLGGMGCSAGVIAVDLARDMLQASGAGLAVVVSTEAVSFTWYAGKRRSMLIPNAFFRAGCAAVLLSNRRRDFHRAKYQLEHIVRTHKGADDRSFRSVYQEEDEQRIKGLSISRDLVEVGGHALKTNITTLGPLVLPFSEQILFFAGVLFRHLFPSKTSAPPPPSADGDASAAAPYIPDFKRAFEHFCMHAASRDVLEHLQGNLGLRDGDLEASRAALHRFGNTSSSSIWYELAYLEAKGRVRRGDRVWQLAFGSGFKCNSAVWRAVRRVRRPARSPWLDCVEQYPARMNA

SEQ ID NO: 19479 - protein, 542 aa, Oryza sativa
MAREQALLLTEIVNRGVEPSGPDAGSPTFSVRVRRRLPDFLQSVNLKYVRLGYHYLISHGVYLATIPVIVLVCGAEVGSLSRDELWRKVWGEATYDLATVLAFLAVLAFTISVYIMSRPRPVYLIDFACYKPADELKVSKAEFIDLARKSGKFDEDSLAFQSRLLAKSGIGDESYMPRCVFEPGTNCATMKEGRAEASAAMFAALDELFDKCRVRPKDVGVLVVNCSLFNPTPSLSAMIVNHYKMRGNILSYNLGGMGCSAGVIAVDLARDMLQASGAGLAVVVSTEAVSFTWYAGKRRSMLIPNAFFRAGCAAVLLSNRRRDFHRAKYQLEHIVRTHKGADDRSFRSVYQEEDEQRIKGLSISRDLVEVGGHALKTNITTLGPLVLPFSEQILFFAGVLFRHLFPSKTSAPPPPSADGDASAAAPYIPDFKRAFEHFCMHAASRDVLEHLQGNLGLRDGDLEASRAALHRFGNTSSSSIWYELAYLEAKGRVRRGDRVWQLAFGSGFKCNSAVWRAVRRVRRPARSPWLDCVEQYPARMNA

SEQ ID NO: 19480 - protein, 540 aa, Leymus cinereus x Leymus triticoides
  Sequence also found in Organisms: Triticum aestivum
MAREELSTEIVNRGVEPSGPDAGSPTFSVRVRRRLPDFLQSVNLKYVRLGYHYLLSHGVYLATIPVIVLVCGAEVGSLSRDELWRKVWDEATYDLATVLAFLAVLAFTISVYIMSRPRPIYLIDFATYKPADELKVSKAEFIDLARKSGKFDEESLAFQARLLAKSGIGDESYMPRCVFQPDANCATMKEGRAEASAAMFAALDELFDKCRVRPKDVGVLVVNCSLFNPTPSLSAMIVNHYKMRGNILSYNLGGMGCSAGVISIDLARDMLQASGAGLAVVVSTEAVSFTWYAGKRRSMLIPNAFFRAGAAAVLLSNRRRDFRRAKYQLEHVVRTHKGADDRAFRSVYQEEDEQRIKGLSISRDLVEVGGHALKTNITTLGPLVLPFSEQLLFFAGVLFRHLYPSKTSTPPPPAANGDTSAAAPYIPDFKRAFEHFCMHAASRDVLEHLQRNLGLRDADLEASRAALHRFGNTSSSSIWYELAYLEAKGRVRRGDRVWQLAFGSGFKCNSAVWRAVRRVRRPSRSPWLDCVDQYPARMDA

SEQ ID NO: 19481 - protein, 540 aa, Hordeum vulgare
MAREELSTEIVNRGVEPSVPDAGSPTFSVRVRRRLPDFLQSVNLKYVRLGYHYLLSHGVYLATIPVIVLVCGAEVGSLSRDELWRKVWDEATYDLATVLAFLAVLAFTISVYIMSRPRPIYLIDFATYKPADELKVSKAEFIDLARKSGKFDEESLAFQARLLAKSGIGDESYMPRCVFQPDANCATMKEGRAEASAAMFAALDELFDKCRVRPKDVGVLVVNCSLFNPTPSLSAMIVNHYKMRGNILSYNLGGMGCSAGVISIDLARDMLQASGAGLAVVVSTEAVSFTWYAGKRRSMLIPNAFFRAGAAAVLLSNRRRDFRRAKYQLEHVVRTHKGADDRAFRSVYQEEDEQRIKGLSISRDLVEVGGHALKTNITTLGPLVLPFSEQLLFFAGVLFRHLYPSKTSTPPPPAANGDTSAAAPYIPDFKRAFEHFCMHAASRDVLEHLQRNLGLRDADLEASRAALHRFGNTSSSSIWYELAYLEAKGRVRRGDRVWQLAFGSGFKCNSAVWRAVGRVRRPSRSPWLDCIDQYPARMDA

SEQ ID NO: 19482 - protein, 540 aa, Secale cereale
MAREELSTEIVNRGVEPSGPDAGSPTFSVRVRRRLPDFLQSVNLKYVRLGYHYLLSHGVYLATIPLIVLVCGAEVGSLSRDELWRKVWDEATYDLATVLAFLAVLAFTISVYIMSRPRPIYLIDFATYKPADELKVSKAEFIDLARKSGKFDEESLAFQARLLAKSGIGDESYMPRCVFQPDANCATMKEGRAEASAAMFAALDELFEKCHVRPKDVGVLVVNCSLFNPTPSLSAMIVNHYKMRGNILSYNLGGMGCSAGVISIDLARDMLQASGAGLAVVVSTEAVSFTWYAGKRRSMLIPNAFFRAGAAAVLLSNRRRDFRRAKYQLEHVVRTHKGADDRAFRSVYQEEDEQRIKGLSISRDLVEVGGHALKTNITTLGPLVLPFSEQLLFFAGVLFRHLYPSKTSTPPPPAANGDTSAAAPYIPDFKRAFEHFCMHAASRDVLEHLQRNLGLRDADLEASRAALHRFGNTSSSSIWYELAYLEAKGRVRRGDRVWQLAFGSGFKCNSAVWRAVRRVRRPSRSPWLDCVDQYPARMDA

SEQ ID NO: 19483 - protein, 537 aa, Avena sativa
AMLSTEIVNRGVEPSGPDAGSPTFSVRVRRRLPDFLQSVNLKYVKLGYHYLLSHGVYLATIPVIVLVCGAEVGSLSRDELWRKVWDEATYDLATVLAFLAVLAFTISVYIMSRPRPIYLIDFATYKPADELKVSKAEFIDLARKSGKFDEESLAFQARLLAKSGIGDESYMPRCVFQPDANCATMKEGRAEASTAMFAALDELFEKCHVRPKDVGVLVVNCSLFNPTPSLSAMIVNHYKMRGNILSYNLGGMGCSAGVISIDLARDMLQASGAGLAVVVSTEAVSFTWYAGKRKSMLIPNAFFRAGCAAVLLSNRRRDYRRAKYQLEHVVRTHKGADDRSFRSVYQEEDEQRIKGLSISRDLVEVGGHALKTNITTLGPLVLPFSEQLFFFAGVLFRHLYPSKTSTPPPPTAEGGTSAAAPYIPDFKRAFEHFCMHAASRDVLEHLQSNLGLRHTDLEASRAALHRFGNTSSSSIWYELAYLEAKGRVRRGDRVWQLAFGSGFKCNSAVWRAVRRVRRPSRSPWLDCVDQYPARMDA

SEQ ID NO: 19484 - protein, 544 aa, Brachypodium distachyon
MAREAEEQALLSTEIVNRGVEPSGPDAGSPTFSVRVRRRLPDFLQSVNLKYVRLGYRYMLSHGVYLATIPVIVLVCGAEVGSLSRDELWRKVWDEATYDLATVLAFLAVLAFTISVYIMSRPRPIYLIDFATYKPPEELKVSKAEFIDLARKSGKFDEESLAFQSRLLAKSGIGDESYMPRCVFQPDANCATMKEGRAEASAAMFAALDELFDKCRVRPKDVGVLVVNCSLFNPTPSLSAMIVNHYKMRGNILSYNLGGMGCSAGVISIDLARDMLQASGAGLAVVVSTEAVSFTWYAGKRRSMLIPNAFFRAGCAAVLLSNRRRDFHRAKYQLEHIVRTHKGADDRSFRSVYQEEDEQRIKGLAISRDLVEVGGHALKTNITTLGPLVLPFSEQLLFFAGVLFRHLYPSKTSSAQVAGEADSAAAAPYIPDFKRAFEHFCMHAASRDVLEHLQRNLGLRDADLEASRAALHRFGNTSSSSIWYELAYLEAKGRVRRGDRVWQLAFGSGFKCNSAVWRAVRRVRRPSRSPWLDCVDQYPARMDA

SEQ ID NO: 19485 - protein, 514 aa, Secale cereale
FSVRVRRRLPDFLQSVNLKYVRLGYHYLLSHGVYLATIPLIVLVCGAEVGSLSRDELWRKVWDEATYDLATVLAFLAVLAFTISVYIMSRPRPIYLIDFATYKPADELKVSKAEFIDLARKSGKFDEESLAFQARLLAKSGIGDESYMPRCVFQPDANCATMKEGRAEASAAMFAALDELFEKCHVRPKDVGVLVVNCSLFNPTPSLSAMIVNHYKMRGNILSYNLGGMGCSAGVISIDLARDMLQASGAGLAVVVSTEAVSFTWYAGKRRSMLIPNAFFRAGAAAVLLSNRRRDFRRAKYQLEHVVRTHKGADDRAFRSVYQEEDEQRIKGLSISRDLVEVGGHALKTNITTLGPLVLPFSEQLLFFAGVLFRHLYPSKTSTPPPPAANGDTSAAAPYIPDFKRAFEHFCMHAASRDVLEHLQRNLGLRDADLEASRAALHRFGNTSSSSIWYELAYLEAKGRVRRGDRVWQLAFGSGFKCNSAVWRAVRRVRRPSRSPWLDCVDQYPARMDA

SEQ ID NO: 19486 - protein, 479 aa, Avena sativa
LSTEIVNRGVEPSGPDAGSPTFSVRVRRRLPDFLQSVNLKYVKLGYHYLLSHGVYLATIPVIVLVCGAEVGSLSRDELWRKVWDEATYDLATVLAFLAVLAFTISVYIMSRPRPIYLIDFATYKPADELKVSKAEFIDLARKSGKFDEESLAFQARLLAKSGIGDESYMPRCVFQPDANCATMKEGRAEASTAMFAALDELFEKCHVRPKDVGVLVVNCSLFNPTPSLSAMIVNHYKMRGNILSYNLGGMGCSAGVISIDLARDMLQASGAGLAVVVSTEAVSFTWYAGKRKSMLIPNAFFRAGCAAVLLSNRRRDYRRAKYQLEHVVRTHKGADDRSFRSVYQEEDEQRIKGLSISRDLVEVGGHALKTNITTLGPLVLPFSEQLLFFAGVLFRHLYPSKTSTPPPPTAEGGTSAAAPYIPDFKRAFEHFCMHAASRDVLEHLQSNLGLRHTDLEASRAALHRFGNTSSSSIWYELAY

SEQ ID NO: 19487 - protein, 406 aa, Gossypium hirsutum
MCTSKAKVTTGTTHVEITPPAVARINGRPVLQPTCNRVPSLDRRNSLKKIPPISPPPPASLPFTPSATSTTTVANGSRARASLTLPLSPSSKFTTKRGSDPNALNSSSEKVAIPRNTTKTLDRKKSKSFKEGMGNNGLSSYIEPSLSYSSSLLVEAPGSIAAVRREQVALQQAQRKMKIAHYGRSKSAKFESKVVPLDNTKPAEEKKRCSFITPNSDPIYVAYHDEEWGVPIHNDSMLFELLVLSGAQVGSDWTSILKKRQDFRDAFSGFDAETVANFTEKQMTTISSEYGIDISRVRGVVDNSNRILEVKREFGSFDKYIWGFVNHKPMSTQYKFDHKIPVKTSKSESISKDMVRRGFRFVGPTVVHSFMQAAGLTNDHLITCHRHLPCALLAIQRPPVHSLPDL

SEQ ID NO: 19488 - protein, 405 aa, Gossypium hirsutum
CTSKAKVTTGTTHVEITPPAVARINGRPVLQPTCNRVPSLDRRNSLKKIPPISPPPPASLPFTPSATSTTTVANGSRARASLTLPLSPSSKFTTKRGSDPNALNSSSEKVAIPRNTTKTLDRKKSKSFKEGMGNNGLSSYIEPSLSYSSSLLVEAPGSIAAVRREQVALQQAQRKMKIAHYGRSKSAKFESKVVPLDNTKPAEEKKRCSFITPNSDPIYVAYHDEEWGVPIHDDSMLFELLVLSGAQVGSDWTSILKKRQDFRDAFSGFDAETVANFTEKQMTTISSEYGIDISRVRGVVDNSNRILEVKREFGSFDKYIWGFVNHKPMSTQYKFDHKIPVKTSKSESISKDMVRRGFRFVGPTVVYSFMQAAGLTNDHLITCHRHLPCALLAIQRPPVHSLPDL

SEQ ID NO: 19489 - protein, 461 aa, Sorghum bicolor
MDSAAAALLDSSASASSSAAANGNAKEMPARLLAHRTAHNMSSSSLRKKSDLALLRKVPCATLRRLLDNFQEVLLATKLALLFPAVLLALAARIFQFGQEWVFVLSLIGLVPLAERLSFLTEQVAFYTGPTVGGLLNATFGNVTEVIIAIFALYEGKVVVVKCSLLGSVLSNLLLVLGTSLFLGGLANLGTEQLYDRMQVDVSTGLLILGVLCHSLPLMLRYAVSSGEHAVSSWDSELELSRACSIVMLLAYVAYLFFQLKTHRQLFEPQEVEDDGDDSVSQDEVVLGFSSAMIWLGVMTLMTAVLSEFVVSTIEAASKSWELSVSFISIILIPIVGNAAEHAGAVIFAFKNKLDITLGVSLGSATQISMFVVPLSVLVAWIMGVPMDLDFNLLETGSLFLAVLVTAFTLQDGSSHYLKGLLLLFCYIVIAVCFFVLRQRGNGSNNDVHHQLGVASKPWRI

SEQ ID NO: 19490 - protein, 490 aa, Setaria italica
MPAAAAHTTTTTTTTYSASTNALGPPLPYWAVGREEHRWHVGMDSAAAATGLLEPGAKELAARSLGRTAHNMSSSSLRKKSDLALLRKVPCASLRRLLDNLQQVLLATKLVLLFPAVILALAARFFHFGQEWIFVLSLIGLIPLAERLSFLTEQVAFYTGPTVGGLLNATFGNVTEVIIAIFALYEGKVLVVKCSLLGSILSNLLLVLGTSLFFGGLANLGKEQPYDRMQADVSTGLLILGALCHSLPLMLRYSVSSGEHMMVSWDAGLELSRACSVVMLLAYVAYLFFQLKTHRQLFEPQEAEDDGDDSVSQDEAVLGFSSAIIWLGVMTLMTAVLSEFVVSTIEAASKSWELSVSFISIILIPIVGNAAEHAGAVIFAFKNKLDITLGVSLGSATQISMFVVPLSVLVAWIMGVPMDLDFNLLETGCLFLAILVTTFTLQDGSSHYLKGLLLLFCYIVIGICFFVLRQRGSGGNDGVDLGIGSKTWRI

SEQ ID NO: 19491 - protein, 172 aa, Sorghum bicolor
MAASATAARPLAGAAAVPLPLPARPRTARVALLPLTPVPGQRLALGRAGQERLPARGRSVRCLAALSPEMRATLDKVVGSSKVVLFMKGTKDFPQCGFSHTVVQILRSLDVPFDTLDVLANEALRQGLKEYSSWPTFPQLYIDGEFFGGCDITVEAYKSGELQETLEKAMCS

SEQ ID NO: 19492 - protein, 181 aa, Zea mays
MAASAPAVRPLARAAIPIPLSARPRTARVSLLPLAPLAPAQRLALGRTGQARLPARSRSVRCLAALSPEMRETLDKVVGSSKVLLFMKGTKDFPQCGFSHTVVQILRSLDVPFETLDVLANEALRQGLKEYSSWPTFPQLYIDGEFFGGCDITVGKLLYVLSLHSQMLEPVRFTELTISWY

SEQ ID NO: 19493 - protein, 171 aa, Panicum virgatum
MAASATAARPLAGASVPLPLSARRQLARVALLPRAPAAIQRLSLGRPAQAQPSARGRSVRCLAALSPEMRATLDKVVGSSKVVLFMKGTKDFPQCGFSHTVVQILRSLDVPFETLDVLANEALRQGLKEYSSWPTFPQLYIDGEFFGGCDITVEAYKSGELQETLEKAMCS

SEQ ID NO: 19494 - protein, 171 aa, Panicum virgatum
MAASATAARPLAGASAPLPFSARPQPARVALLPRAPAAIRGLSLGRPAQAQPSARGRSVRCLAALSPEMRATLDKVVGSSKVVLFMKGTKDFPQCGFSHTVVQILRSLDVPFETLDVLANEALRQGLKEYSSWPTFPQLYIDGEFFGGCDITVEAYKSGELQETLEKAMCS

SEQ ID NO: 19495 - protein, 134 aa, Saccharum officinarum
MASCSSSPRRPPIPLLLLLLFLLHFSPVLAASAPPASSPQQAGTGGGGGNVTETAAWTPRLRKTFLDGGGIDHWRGRRLVGRFQVCAVCTCCGGPHGMCIPAPCCYAINCNIPNRPFGVCSFTPRTCNCFNCHL

SEQ ID NO: 19496 - protein, 131 aa, Sorghum bicolor
MASCSSSPRRPPIPLLLLFLFHFSSVLAASAPPASSQQAGTGGGGGNVTEPAAWTPRLRKTFLDGGGIEHWRGRRLVGRFQVCAVCTCCGGQHGMCIPAPCCYAINCNIPNRPFGVCSFTPRTCNCFNCHL

SEQ ID NO: 19497 - protein, 128 aa, Zea mays
MVSCSSSPRPPIPLLLLFLLHFSSVLAVSAPSASQQAGTDGGGGNVSETAAWTPRLRKTFLDGGIEHWHGRRLVGRFQVCAVCTCCGGPHGMCIPAPCCYAINCNIPNRPFGVCSFTPRTCNCLNCHL

SEQ ID NO: 19498 - protein, 127 aa, Panicum virgatum
MASCSSSPWPPIPPLLLLLFFLLASPSSILAAPATSSQQQAESAGNATAAWTPRLRKTFLDGGVERWRGRRLVGRFQVCAVCTCCGGPHGMCIPAPCCYAINCNIPNRPFGVCSFTPRTCNCLNCHL

SEQ ID NO: 19499 - protein, 130 aa, Panicum virgatum
MASCSSSPWPPIPPLLLLLFFFFVLLASPSFVLTAPAASSQQPAESGGNATAAWTPRLRKTFLDGGVERWRGRRLVGRFQVCAVCTCCGGAHGMCIPAPCCYAINCNIPNRPFGVCSFTPRTCNCLNCHL

SEQ ID NO: 19500 - protein, 138 aa, Setaria italica
MASCSSPPWPPIPLLLLLFFLLSSSFSFSVLTASAAQASSRQAESGGNATATAAQGTETAAWTPRLRKTFLDGGVERWRGRRLVGRFQVCAVCTCCGGPHGMCIPAPCCYAINCNIPNRPFGVCSFTPRTCNCLNCHL

SEQ ID NO: 19501 - protein, 509 aa, Setaria italica
MSSSVSAAAKASAAFAHKKELAAAAPAPTQHRAGSGRRSKPCRVRAVASPARAPRAPASTGSVKTAMTMTEKILARASERAGLEPGENVWVDVDVLMTHDVCGPGTIGIFKKEFGEDAKVWDREKVVIIPDHYIFTNDERANRNVDILRDFCMEQNIKYFYDIKDLSNFKANPDYKGVCHVALAQEGHCRPGEVLLGTDSHTCNAGAFGQFATGIGNTDAGFVLGTGKALLKVPPTIRFVLDGEMPPYLLAKDLILQIIGEISVSGATYKSMEFVGSTIESLNMEERMTLCNMVVEAGGKNGVVPADETTFKYLEGKTSVDYEPVYSDAQARFFSDYRFDVSKLEPVVAKPHSPDNRALARECKDVKIDRVYIGSCTGGKTEDFLAAAKVFLASGKKVKVPTFLVPATQKVWMDLYSLPVPGSGGKTCSQIFEEAGCDTPASPSCGACLGGPRDTYARMNEPMVCVSTTNRNFPGRMGHKEGQIYLASPYTAAASALTGYVTDPRDFLM

SEQ ID NO: 19502 - protein, 507 aa, Sorghum bicolor
MASSISAAAKASTAFAHKKELAAPAPAQHRAGSSRRTKPCRVRAVASPARAPRAPSSTGSVKSAMTMTEKILARASERAALEPGENVWVDVDVLMTHDVCGPGTIGIFKKEFGEDAKVWDREKVVIIPDHYIFTTDERANRNVDILRDFCLEQNIKYFYDIKDLSNFKANPDYKGVCHVALAQEGHCRPGEVLLGTDSHTCNAGAFGQFATGIGNTDAGFVLGTGKALLKVPPTIRFVLDGEMPPYLLAKDLILQIIGEISVSGATYKSMEFVGSTVESLTMEERMTLCNMVIEAGGKNGVVPADETTFKYLEGKTSVDYEPVYSDAQARFFSDYRFDVSKLEPVVAKPHSPDNRALARECKDVKVDRVYIGSCTGGKTEDFLAAAKVFLASGKKVKVPTFLVPATQKVWMDVYSLPVPGSGGKTCSQIFEEAGCDTPASPSCGACLGGPRDTYARMNEPMVCVSTTNRNFPGRMGHKEGQIYLASPYTAAASALTGYVTDPRDFLM

SEQ ID NO: 19503 - protein, 510 aa, Triticum aestivum
MASISAAAKATSAAFAHKKELAAAAPQQQRLSAGASSRRARAGRVRAVATPTRAPRSPASTGSVKSPMTTTEKILARASERASLEPGENVWVDVDVLMTHDVCGPGTIGIFKQEFGEDAKVWDREKVVIIPDHYIFTSDERANRNVDILRDFCEEQKIKYFYDIKDLSDFRANPDYKGVCHIALAQEGHCRPGEVLLGTDSHTCNAGAFGQFATGIGNTDAGFVMGTGKALLKVPPTIRFVLDGEMPPYLLAKDLILQIIGEISVSGATYRSMEFVGSTIESLTMEERMTLCNMVIEAGGKNGVVPADETTFKYLEGKTSVEYEPVYSDAQARFYSDYRFDVSKLEPVVAKPHSPDNRALARECKDVKIDRVYIGSCTGGKTEDFIAAAKVFLASGKKVKVPTFLVPATQKVWMDVYSLPVPGSGGKTCSQIFEEAGCDTPASPNCGACLGGPRDTYARMNEPTVCVSTTNRNFPGRMGHKEGQIYLASPFTAAASALTGYVTDPRDFLS

SEQ ID NO: 19504 - protein, 507 aa, Saccharum officinarum
MASSIYGAAKASAAFAHKKELAAPAPAQHRAGSSRRTKPCRVRAVASPARAPRAPSSTGSVKSAMTMTEKILARASERAALEPGENVWVDVDVLMTHDVCGPGTIGIFKKEFGEDAKVWDREKVVIIPDHYIFTSDERANRNVDILRDFCLEQNIKYFYDIKDLSNFKANPDYKGVCHVALAQEGHCRPGEVLLGTDSHTCNAGAFGQFATGIGNTDAGFVLGTGKALLKVPPTIRFVLDGEMPPYLLAKDLILQIIGEISVSGATYKSMEFVGSTVESLTMEERMTLCNMVIEAGGKNGVVPADETTFKYLEGKTSVDYEPVYSDAQARFFSDYRFDVSKLEPVVAKPHSPDNRALARECKDVKIDRVYIGSCTGGKTEDFLAAAKVFLASGKKVKVPTFLVPATQKVWMDVYSLPVPGSGGKTCSQIFEEAGCDTPASPSCGACLGGPRDTYARMNEPMVCVSTTNRNFPGRMGHKEGQIYLASPYTAAASALTGYVTDPRDFLM

SEQ ID NO: 19505 - protein, 515 aa, Panicum virgatum
RAPPRHGLLRLRPPPRPSAAFAHKKELAAAAPSPAQHRAGSGRRSKSCRVRAVASPARAPRAPASTGSVKTAMTMTEKIMARASERAGLEPGENVWVDVDVLMTHDVCGPGTIGIFKKEFGEDAKVWDREKVVIIPDHYIFTSDERANRNVDILRDFCMEQNIKYFYDIKDLSNFKANPDYKGVCHVALAQEGHCRPGEVLLGTDSHTCNAGAFGQFATGIGNTDAGFVLGTGKALLKVPPTIRFVLDGEMPPYLLAKDLILQIIGEISVSGATYKSMEFVGSTVESLNMEERMTLCNMVIEAGGKNGVVPADETTFKYLEGKTSVDYEPVYSDAQARFFSDYRFDVSKLEPVVAKPHSPDNRALARECKDVKIDRVYIGSCTGGKTEDFLAAAKVFLASGKKVKVPTFLVPATQKVWMDVYSLPVPGSGGKTCSQIFEEAGCDTPASPSCGACLGGPRDTYARMNEPMVCVSTTNRNFPGRMGHKEGQIYLASPYTAAASALTGYVTDPRDFLM

SEQ ID NO: 19506 - protein, 516 aa, Brachypodium distachyon
MASISAAAKASAASFAHKKELAAAAPHQHQQQQRAGAAHQGHRRARVGGRVRAVATPARAPRAPASTGSVKAPMTTTEKILARASERARLEPGENVWVDVDVLMTHDVCGPGTIGIFKQEFGDDAKVWDREKVVIIPDHYIFTSDERANRNVDILRDFCTEQEIKYFYDIRDLSDFRANPDYKGVCHIALAQEGHCRPGEVLLGTDSHTCNAGAFGQFATGIGNTDAGFVMGTGKALLKVPPTIRFVLDGEMPPYLLAKDLILQIIGEISVSGATYKSMEFVGSTVESLTMEERMTLCNMVIEAGGKNGVVPADKTTFKYLEGKTSVEYEPVYSDAQARFFSDYRFDVSKLEPVVAKPHSPDNRALARECKDVKIDRVYIGSCTGGKTEDFLAAAKVFLASGKKVKVPTFLVPATQKVWMDVYSLPVPGSGGKTCSQIFEEAGCDTPASPNCGACLGGPRDTYARMNEPTVCVSTTNRNFPGRMGHKEGQIYLASPYTAAASALTGYVTDPRDFLM

SEQ ID NO: 19507 - protein, 505 aa, Zea mays
MASSISAAAKASAAFAHKKELAAPAPHRAGSSRRTKPCRVRAVASPARTPRAPSSTGSVKTAMTMTEKILARASERAALEPGENVWVDIDVLMTHDVCGPGTIGIFKKEFGEDAKVWDREKVVIIPDHYIFTSDERANRNVDILRDFCLEQNIKYFYDIKDLSDFRANPDYKGVCHIALAQEGHCRPGEVLLGTDSHTCNAGAFGQFATGIGNTDAGFVMGTGKALLKVPPTIRFVLDGEMPPYLLAKDLILQIIGEISVSGATYKSMEFVGSTVESLTMEERMTLCNMVVEAGGKNGVVPADETTFKYLEGRTSVDYQPVYSDAEARFFSDYRFDVSKLEPVVAKPHSPDNRALARECKDVKIDRVYIGSCTGGKTEDFLAAAKVFLASGKKVKVPTFLVPATQKVWMDVYSLPVPGSGGKTCAQIFEEAGCDTPASPNCGACLGGPRDTYARMNEPTVCVSTTNRNFPGRMGHKEGQIYLASPYTAAASALTGYVTDPRDFLM

SEQ ID NO: 19508 - protein, 508 aa, Avena sativa
MASISAAAKASAAFAHKHEFATAAPPPQQQRTSARSRPARDGRVRAVATPARAPRAPASTGSVKIPMTTTEKILARASERASLEPGENVWVDVDVLMTHDVCGPGTIGIFKQEFGEDAKVWDREKVVIIPDHYIFTSDERANRNVDILRDFCNEQKIKYFYDIKDLSDFRANPDYKGVCHIALAQEGHCRPGEVLLGTDSHTCNAGAFGQFATGIGNTDAGFVMGTGKALLKVPPTIRFILDGEMPPYLLAKDLILQIIGEISVSGATYKSMEFAGSTIESLTMEERMTLCNMVIEAGGKNGVVPADATTFKYLEGKTSVEYEPVYSDAQARFVSDYRFDVSKLEPVVAKPHSPDNRALARECKDVKIDRVYIGSCTGGKTEDFLAAAKVFLASGKKVKVPTFLVPATQKVWMDVYGLTVPGSDKTCAQIFEEAGCDTPASPNCGACLGGPRDTYARMNEPTVCVSTTNRNFPGRMGNKEGQIYLASPYTAAASALTGYVADPRDFLV

SEQ ID NO: 19509 - protein, 504 aa, Zea mays
MASSVSAAAKAAAAFAHKVQKELAAPAQRRAGLTRRTKPCSVRAVASPARALSSTGSVKSAMTMTEKILARASERAALEPGENVWVDVDVLMTHDVCGPGAFDIFKKEFGEDARVWDREKLVVIPDHYIFTSDDRANRNVDILRDFCAEQNIKYFYDIKDLSDFRANPDYKGVCHIALAQEGHCRPGEVLLGTDSHTCNAGAFGQFATGIGNTDAGFVLGTGKALLKVPPTIRFILDGEMPPYLLAKDLILQIIGEISVSGATYKSMEFVGSTVESLTMEERMTLCNMVIEAGGKNGVVPADETTFKYLEGKTSVDYEPVYSDAQARFFSDYRFDVSKLEPVVAKPHSPDNRAPARECKDVKIDRVYIGSCTGGKTEDFLAAAKVFLASGKKVKVPTFLVPATQKVWLDIYSLPVPGSGGKTCSQIFEEAGCDTPASPNCGACLGGPRDTYARMNEPTVCVSTTNRNFPGRMGHKEGQIYLASPYTAAASALTGYVTDPRDFLM

SEQ ID NO: 19510 - protein, 481 aa, Pennisetum glaucum
TQHRAGSGRRTKPCRVRAVASPARAPRAPASTGSVKTSMTMTEKILARASERAALEPGENVWVGVDVLMTHDVCGPGTIGIFKKEFGEDAKVWDREKVVIIPDHYIFTSDERANRNVDILRDFCKEQNIKYFYDIKDLSNFKANPDYKGVCHVALAQEGHCRPGEVLLGTDSHTCNAGAFGQFATGIGNTDAGFVLGTGKALLKVPPTIRFVLDGEMPPYLLAKDLILQIIGEISVSGATYKSMEFVGSTIESLNMEERMTLCNMVVEAGGKNGVVPADVTTFKYLEGKTSVEYEPVYSDAQARFFSDYRFDVSKLEPVVAKPHSPDNRALARECKDVKIDRVYIGSCTGGKTEDFVAAAKVFLASGKKVKVPTFLVPATQKVWMDVYSLPVPGSGGKTCSQIFEEAGCDTPASPSCGACLGGPRDTYARMNEPMVCVSTTNRNFPGRMGHKEGQIYLASPYTAAASALTGYVTDPRDFLM

SEQ ID NO: 19511 - protein, 494 aa, Avena sativa
HKQEFAATAAPPPQQQRASARSRPARDGRVRAVATPARAPRAPASTGSVKIPMTTTEKILARASERASLEPGENVWVDVDVLMTHDVCGPGTIGIFKQEFGEDAKVWDREKVVIIPDHYIFTSDERANRNVDILRDFCNEQKIKYFYDIKDLSDFRANPDYKGVCHIALAQEGHCRPGEVLLGTDSHTCNAGAFGQFATGIGNTDAGFVMGTGKALLKVPPTIRFILDGEMPPYLLAKDLILQIIGEISVSGATYKSMEFAGSTIESLTMEERMTLCNMVIEAGGKNGVVPADATTFKYLEGKTSVEYEPVYSDAQARFVSDYRFDVSKLEPVVAKPHSPDNRALARECKDVKIDRVYIGSCTGGKTEDFLAAAKVFLASGKKVKVPTFLVPATQKVWMDVYGLTVPGSDKTCAQIFEEAGCDTPASPNCGACLGGPRDTYARMNEPTVCVSTTNRNFPGRMGNKEGQIYLASPYTAAASALTGYVADPRDFLV

SEQ ID NO: 19512 - protein, 517 aa, Echinochloa colona
PPARRHSSHGRLRLRRRQGLRRLRPQEGARRGAAATAQHRAGSGRRSKPCRVRAVASPARAPRAPASTGSVKSAMTMTEKILARASERAALEPGENVWVDVDVLMTHDVCGPGTIGIFKKEFGEDAKVWDREKVVIIPDHYIFTSDERANRNVDILRDFCMEQNIKYFYDIKDLSNFRANPDYKGVCHVALAQEGHCRPGEVLLGTDSHTCNAGAFGQFATGIGNTDAGFVLGTGKALLKVPPTIRFVLDGEMPPYLLAKDLILQIIGEISVSGATYRSMEFVGSTVESLNMEERMTLCNMVIEAGGKNGVVPADETTFKYLEGKTSVDYEPVYSDSQARFFSDYRFDVSKLEPVVAKPHSPDNRALARECKDVKIDRVYIGSCTGGKTEDFLAAAKVFLASGKKVKVPTFLVPATQKVWMDVYSLPVPGSGGKTCSQIFEEAGCDTPASPSCGACLGGPRDTYARMNEPMVCVSTTNRNFPGRMGHKEGQIYLASPYTAAASALTGYVTDPRDFLM

SEQ ID NO: 19513 - protein, 474 aa, Avena sativa
RSRPARDGRVRAVATPARAPRAPASTGSVKIPMTTTEKILARASERASLEPGENVWVDVDVLMTHDVCGPGTIGIFKQEFGEDAKVWDREKVVIIPDHYIFTSDERANRNVDILRDFCNEQKIKYFYDIKDLSDFRANPDYKGVCHIALAQEGHCRPGEVLLGTDSHTCNAGAFGQFATGIGNTDAGFVMGTGKALLKVPPTIRFVLEGEMPPYLLAKDLILQIIGEISVSGATYKSMEFVGSTIESLTMEERMTLCNMVIEAGGKNGVVPADATTFKYLEGKTSVEYEPVYSDAQARFVSDYRFDVSKLEPVVAKPHSPDNRALARECKDVKIDRVYIGSCTGGKTEDFLAAAKVFLASGKKVKVPTFLVPATQKVWMDVYGLTVPGSDKTCAQIFEEAGCDTPASPNCGACLGGPRDTYARMNEPTVCVSTTNRNFPGRMGNKEGQIYLASPYTAAASALTGYVADPRDFLV

SEQ ID NO: 19514 - protein, 508 aa, Ananas comosus
MASLLAASKCSFFNPKKEFDIGSSFSPSISAHRCRRRAMRKVLAVMAPPAPSPRSPATTGSVKHSMTMTEKILARASERSQLEPGENVWVNVDVLMTHDVCGPGTIGIFKREFGQNAKVWDREKIVIIPDHYIFTSDERANRNVDILRDFCSEQNIKYFYDIKDLSNFKVNPDYKGVCHVALAQEGHCRPGEVLLGTDSHTCNAGAFGQFATGIGNTDAGFVMGTGKVLLKVPPTMKFILDGEMPDYLLAKDLILQIIGEITVAGATYKSMEFVGSTVESLTMEERMTLCNMVVEAGGKNGVVPADETTFKYLEDKTSVKYETVYSDDNARFISDYKFDVSKLEPLVAKPHSPDNRALARECKDVKIDRVYIGSCTGGKTEDFLAAARVFLASGKKVKVPTFLVPATQKVWMDIYSLPVPGSGGKTCSQIFEEVGCDVPASPSCGACLGGPRDTYARMNEPQVCVSTTNRNFPGRMGHKEGQIYLASPYTAAASALTGFVTDPREFLM

SEQ ID NO: 19515 - protein, 508 aa, Chelidonium majus
MASSAIASSSTSFIKKNEIGLSSFTPTSFPIQRCNRRALSKKVVSVMAPPQSDRRPSTTGSVKTAMTMTEKIMARASERSHVVPGENVWVNVDVLMTHDVCGPGTIGIFKKEFGENAKVWDREKIVIIPDHYIFTSDERANRNVDILRDFCGEQNIKYFYDIKDLGNFRANPDYKGVCHVALAQEGHCRPGEVLLGTDSHTCNAGAFGQFATGIGNTDAGFVMGTGKSLLKVPPTLRFVLDGEMPNHLLAKDLILQIIGEITVAGATYKSMEFVGSTVESLTMEERMTLCNMVVEAGGKNGVVPADSTTYKYLEGKTSVEFEPVYSDDNARFIAEYRFDVSKLEPVVAKPHSPDNRALARECKDVKIDRVYIGSCTGGKTEDFLAAAKVFLASGKKVKVPTFLVPATQKVWMDLYGMEVPGSGGKTCSQIFEEAGCDTPASPSCGACLGGPRDTYARMNEPKVCVSTTNRNFPGRMGHKEGEIYLASPYTAAASALTGFVTDPRDFLQ

SEQ ID NO: 19516 - protein, 501 aa, Phaseolus vulgaris
MASSLLSPSFSSFLRTKKDLPLYAFSSQRCFKAVPKRIRCSVAAPQRQPSTTGSVRTAMTMTEKILARASEKAQLSPGDNVWVNIDVLMTHDVCGPGSIGIFKREFGEDAKVWDREKVVIIPDHYIFTSDERANRNVDILRDFCQEQNIKYFYDIKDLGNFKANPDYKGVCHVALAQEGHCRPGEVLLGTDSHTCTAGAFGQFATGIGNTDAGFVLGTGKLLLKVPPTLRFVMDGEMPDYLLSKDLILQIIGEISVAGATYKAMEFVGTTVESLSMEERMTLCNMVVEAGGKNGVVPADSTTFKYIEGKTSLPYEPVYSDQKARFLSEYRFDVSKLEPVVAKPHSPDNRALARECKDVKINRVYIGSCTGGKTEDFMAAAKVFLASGKKVKVPTFLVPATQKVWMDVYTIPVPGSGGKTCSQIFEEAGCDTPASPSCGACLGGPKDTYARMNEPQVCVSTTNRNFPGRMGHKEGQIYLASPYTAAASALTGYVTDPREFLQ

SEQ ID NO: 19517 - protein, 511 aa, Eucalyptus grandis
MASSAAFSPAAASFAAVKKEFGLSRSVASRPFPSAGKSRKPASKRIVSVMAPQQTERKPAATGSVKNAMTMTEKILARASEKPELSPGENVWVDVDVLMTHDVCGPGSFGIFKKEFGENAKVWDREKIVIIPDHYIFTTDERANRNVDILRDFCKEQNIKYFYDIKDLSDFKVNPDYKGVCHVALAQEGHCRPGEVLLGTDSHTCTAGAFGQFATGIGNTDAGFVLGAGKILLKVPPTLRFVMDGEMPEYLLAKDLILQIIGEISVSGATYKSMEFVGSTVESLNMEERMTLCNMVVEAGGKNGVVPADSTTFEYLKDKTSKPYEPVYSDEKARFLSEYRFDVSKLEPMVAKPHSPDNRALARECKDVKIDRVYIGSCTGGKTEDFLAAAKVFLASGKKVKVPTFLVPATQKVWMDIYALPVPGSGGKTCSQIFEEAGCDTPTSPSCGACLGGPRDTYARLNEPQVCVSTTNRNFPGRMGHKEGQIYLASPFTAAASALTGYVTDPRDFLQ

SEQ ID NO: 19518 - protein, 510 aa, Theobroma cacao
MASSLVSPSPTSSFISNKKDLGFSAFPSTSQVAIRKCKKQVSKQIVSVMAPQQSERKPATTGSVKTGMTMTEKILARASEKPQLSPGDNVWVNVDILMTHDVCGPGSIGIFKKEFGENAKVWDREKIVIIPDHYIFTSDERANRNVDILRDFCKEENIKYFYDIKDLSNFKANPDYKGVCHVALAQEGHCRPGEVLLGTDSHTCTAGAFGQFATGIGNTDAGFVLGTGKLLLKVPPTLRFVMDGEMPHYLLAKDLILQIIGEISVAGATYKSMEFVGTTVESLNMEERMTLCNMVVEAGGKNGVVPADSTTFKYLEDKTSVPYEPVYSDAQASFLSEYRFDISKLEPLVAKPHSPDNRALARECKDVKIDRVYIGSCTGGKTEDFLAAAKVFLASGKKVKVPTFLVPATQKVWLDIYTLPVPGAGGKTCSQIFEEAGCDTPASPSCGACLGGPKDTYARMNEPKVCVSTTNRNFPGRMGHKEGQIYLASPYTAAASALTGYVTDPREFLL

SEQ ID NO: 19519 - protein, 510 aa, Manihot esculenta
MASSTILPASYSFFANKKDLRLSDFSSTSSPLSIPKCRKSISKKIVSVMAPQQSERKPASTGSVKTAMTMTEKILARSSEKPQLSPGDNVWVNVDTLMTHDVCGPGSIGIFKREFGENAKVWDREKIIIIPDHYIFTSDERANRNVDILRDFCLEQNIKYFYDIKDLSNFKVNPDYKGVCHVALAQEGHCRPGEVLLGTDSHTCTSGAFGQFATGIGNTDAGFVLGTGKLLLKVPPTLRFVLDGEMPDYLLAKDLILQIIGEISVSGATYKSMEFVGTTVESLNMEERMTLCNMVVEAGGKNGVVPADSTTFKYLEDKTSVPYEPVYSDEQARFLSEYRFDISNLEPLVAKPHSPDNRALARECKDVKIDRVYIGSCTGGKTEDFMAAAKVFLASGKKVKVPTFLVPATQKVWMDVYSLPVPGSGGKTCSQIFEEAGCDTPASPSCGACLGGPKDTYARMNEPMVCVSTTNRNFPGRMGHKEGQIYLASPYTAAASALTGYVTDPREFLE

SEQ ID NO: 19520 - protein, 500 aa, Glycine max
MASSLLSPSFTSFLRTKDLSLSAFTSQRCFKAVPRKIIRCAIAAPQRQPSTTGSVRTAMTMTEKILARASEKAQLTPGDNVWVNVDILMTHDVCGPGSIGIFKREFGEDAKVWDREKLVIIPDHYIFTSDERANRNVDILRDFCHEQNIKYFYDIKDLSNFKVNPDYKGVCHVALAQEGHCRPGEVLLGTDSHTCTAGAFGQFATGIGNTDAGFVLGTGKLLLKVPPTLRFVMDGEMPDYLLSKDLILQIIGEITVAGATYKSMEFVGTTVESLTMEERMTLCNMVVEAGGKNGVVPADSTTFKYLEGKTSLPYEPVYSDDQARFLAEYRFDVSKLEPVVAKPHSPDNRALARECKDVKIDRVYIGSCTGGKTEDFMAAAKVFLASGKQVKVPTFLVPATQKVWMDLYSLPVPGSGGKTCSQIFEEVGCDTPASPSCGACLGGPKDTYARMNEPKVCVSTTNRNFPGRMGHKEGQIYLASPYTAAASALTGYVTDPREFL

SEQ ID NO: 19521 - protein, 507 aa, Ananas comosus
MASLFTASKCAFFSPKEFDLGSSFSPSISAHGCRRRAMRKVLSVMAPPAPSPHSLATTGLVKHSMTMTEKILARASERSRLEPGENVWVNVDVLMTHDVCGPGTFGIFKREFGRNAKVWDREKIVVIPEHYIFTSDERANRNVDILRDYCIEQNIKYFYDIKDLSNFRVNPDYKGVCHIALAQEGHCRPGEVLLGTDSHTCNAGAFGQFATGIGNTDAGFVMGTGKVLLKVPPTMRFVLDGEMPDYLLAKDLILQIIGEITVSGATYKSMEFTGSAVESLTMEERMTLCNMVIEAGGKNGVVPPDETTFKYLEDKTSVKYEPVYSDDNARFISDYKFDVSKLEPTVAKPHSPDNRALARECKDVKIDRVYIGSCTGGKTEDFLAAARVFLASGKKVKVPTFLVPATQKVWMDIYSLPVPGSGGKTCSQIFEEAGCDVPASPSCGACLGGPRDTYARMNEPQVCVSTTNRNFPGRMGHKEGQIYLASPYTAAASALTGFVTDPRQFLM

SEQ ID NO: 19522 - protein, 507 aa, Musa acuminata
MASPLMASCSSIFGAKSGSSFASCFSPSIRAHSLRKHALNKVLAVMAPARSPRSPSSTGSVKHAMTMTEKILARASEKSHLEPGENIWVNVDVLMTHDVCGPGTIGIFKKEFGQNAKVWDHEKIVIIPDHYIFTSDERANRNVDILRDFCLEQNIKYFYDIKDLGDFRANPDYKGVCHIALAQEGHCRPGEVLLGTDSHTCTAGAFGQFATGIGNTDAGFVMGTGKLLLKVPPTLRFILDGEMPNYLLAKDLILQIIGEITVAGATYKSMEFVGSTIEGLNMEERMTLCNMVVEAGGKNGVVPADETTFKYLEDKTSKNFEPVYSDDNARFIQEYRIDVSKLEPLVAKPHSPDNRALARECKDVKIDRVYIGSCTGGKTEDFFAAAKVFLASGKKVKVPTFLVPATQKVWMDIYSLPVPGSGGKTCSQIFEEAGCDVPASPSCGACLGGPRDTYARMNEPQVCVSTTNRNFPGRMGHREGQIYLASPYTAAASALTGYVADPRDFLL

SEQ ID NO: 19523 - protein, 502 aa, Glycine max
MASSLLSPSFTSFPRIKKDVSLSAFTSQRCFKALPRRIIRCAVAAPQRQPSTTGSVRTAMTMTEKILARASEKVQLTPGDNVWVNVDILMTHDVCGPGSIGIFKREFGDDAKVWDREKLVIIPDHYIFTSDERANRNVDILRDFCHEQNIKYFYDIKDLSNFKVNPDYKGVCHVALAQEGHCRPGEVLLGTDSHTCTAGAFGQFATGIGNTDAGFVLGTGKLLLKVPPTLRFVMDGEMPDYLLSKDLILQIIGEITVAGATYKSMEFVGTTVESLTMEERMTLCNMVVEAGGKNGVVPADSTTFKYLEGKTSLPYEPVYSDDQARFLAEYRFDVSKLEPVVAKPHSPDNRALARECKDVKIDRVYIGSCTGGKTEDFMAAAKVFLASGKQVKVPTFLVPATQKVWMDLYSLPVPGSGGKTCSQIFEEAGCDTPASPSCGACLGGPKDTYARMNEPKVCVSTTNRNFPGRMGHKEGQIYLASPYTAAASALTGYVTDPREFLQ

SEQ ID NO: 19524 - protein, 512 aa, Castanea mollissima
MNSMASSTIAPNLASFIANKKDLGFTAFSTSSQFSIPKCNRRISKKICSVMAPQQSERRPSTTGSVKTAMTMTEKILARASEKTQLSPGENSWVNIDILMTHDVCGPGSFGIFKKEFGQNAKVWDREKIVIIPDHYIFTSDERANRNVDILRDFCREQNIKYFYDIKDLSDFKANPDYKGVCHIALAQEGHCRPGEVLLGTDSHTCTAGAFGQFATGIGNTDAGFVLGAGKLLLKVPPTLRFVMDGEMPNYLLAKDLILQIIGEISVSGATYKSMEFVGTTVESLTMEERMTLCNMVVEAGGKNGVVPADSTTFKYLEDKTSVAYEPVYSDEQARFLSEYRFDVSKLEPLVAKPHSPDNRALARECKDVKIDRVYIGSCTGGKTEDFMAAAKVFLASGKKVKVPTFLVPATQKVWMDVYGLPVPGSGGKTCSQIFEEAGCDTPASPNCGACLGGPKDTYARMNEPTVCVSTTNRNFPGRMGHKEGQIYLASPYTAAASALTGYVTDPREFLQ

SEQ ID NO: 19525 - protein, 509 aa, Quercus alba
MASSTIAPTPASFISNKKDLGFTAFSTSSQFSIPKCNRRISKKICSVMTPQQSERRPSTTGSVKTAMTMTEKILARASEKSQLSPGENTWVNIDILMTHDVCGPGSIGIFKKEFGQDAKVWDREKIVIIPDHYIFTSDERANRNVDILRDFCMEQNIKYFYDIKDLSDFKANPDYKGVCHIALAQEGHCRPGEVLLGTDSHSCTAGAFGQFATGIGNTDAGFVLGAGKLLLKVPPTLRFVMDGEMPNYLLAKDLILQIIGEISVSGATYKSMEFVGTTVESLTMEERMTLCNMVVEAGGKNGVVPADSTTFKYLEDKTSVAYEPVYSDEQARFLSEYRFDVSKLEPLVAKPHSPDNRALARECKDVKIDRVYIGSCTGGKTEDFMAAAKVFLASGKKVKVPTFLVPATQKVWMDVYGLPVPGSGGKTCSQIFEEAGCDTPASPNCGACLGGPKDTYARMNEPTVCVSTTNRNFPGRMGHKEGQIYLASPYTAAASALTGYVTDPREFLQ

SEQ ID NO: 19526 - protein, 512 aa, Arachis hypogaea
MASSSSFLAPSSTSILHSKKDVGLSALTSTSSISSQRCQKTGFRRICCSVAAPQQSQRQPSTTGSVKTAMTMTEKILARASEKPYLTPGDNVWVNVDILMTHDVCGPGSIGIFKREFGEDAKVWDREKLVIIPDHYIFTSDERANRNVDILRDFCQEQNIKYFYDIKDLSNFKANPDYKGVCHVALAQEGHCRPGEVLLGTDSHTCTAGAFGQFATGIGNTDAGFVLGTGKLLLKVPPTLRFVMDGEMPSYLLAKDLILQIIGEITMAGATYKAMEFVGTTVESLNMEERMTLCNMVVEAGGKNGVVPADSTTYKYLEDKTSVPYQPVYSDQQARFLSEYRFDVSKLEPLVAKPHSPDNRALARECKDVKIDRVYIGSCTGGKTEDFMAAAKVFLASGKKVKVPTFLVPATQKVWMDLYSIPVPGAGGKTCSQIFEEAGCDTPASPSCGACLGGPKDTYARLNEPQVCVSTTNRNFPGRMGHKEGQIYLASPYTAAASALTGYVTDPREFLQ

SEQ ID NO: 19527 - protein, 507 aa, Platanus occidentalis
MASSAIALSSSPLIKKKFVGFSFFSSSPFPIKKCMRRGSKKVSAVMAPPQSQRPPSTTGSVRTAMTMTEKILAKASEKSQLNPGDNVWVNVDILMTHDVCGPGTIGIFKKEFGKDAKVWDREKIVIIPDHYIFTSDERANRNVDILRDFCMEQNIKYFYDIKDLGNFKANPDYKGVCHVALAQEGHCRPGEVLLGTDSHTCNAGAFGQFATGIGNTDAGFVMGTGKLLLKVPPTLRFVMDGEMPNYLLAKDLILQIIGEITVSGATYKSMEFIGSTVESLSMEERMTLCNMVVEAGGKNGVVPADNTTYKYLEGKTSAAFEPVYSDEKARFLSEYRFDVSKLEPLVAKPHSPDNRALARECKDVKIDRVYIGSCTGGKTEDFLAAAEVFLASGKKVKVPTFLVPATQKVWMDIYSLPVPGAGGKTCSQIFEEAGCDVPASPSCGACLGGPRDTYARMNEPQVCVSTTNRNFPGRMGHKEGQIYLASPYTAAASALTGFVTDPREFLQ

SEQ ID NO: 19528 - protein, 510 aa, Gossypium raimondii
MASSLASPSPTSSFIRNKKDLGFSAFPSTSQIAIQKCKKQVSKKIVSVMAPQQSERKPATTGSVKTGMTMTEKILAKASEKPQLSPGDNVWVNVDILMTHDVCGPGSIGIFKKEFGQNAKVWDREKIVIIPDHYIFTSDERANRNVDILRDFCTEQNIKYFYDIKDLSNFKANPDYKGVCHVALAQEGHCRPGEVLLGTDSHTCTAGAFGQFATGIGNTDAGFVLGTGKLLLKVPPTLRFVMDGEMPPYLLAKDLILQIIGEISVAGATYKAMEFVGTTVESLNMEERMTLCNMVVEAGGKNGVVPADSTTFKYLEGKTSLPYEPVYSDAQASYLSEYRFDISKLEPLVAKPHSPDNRALARECKDVKIDRVYIGSCTGGKTEDFLAAAKVFLASGKKVKVPTFLVPATQKVWLDLYTLPVPGSGGKTCSQIFEEAGCDTPASPSCGACLGGPKDTYARMNEPKVCVSTTNRNFPGRMGHKEGQIYLASPYTAAASALTGYVTDPREFLQ

SEQ ID NO: 19529 - protein, 511 aa, Plantago ovata
MASSSSSIITPPSSSIFSKKKDVGLSSLCAQPSFMGSQKKKASGKVVCVMAPQQSERKPSTTGAVKTGMTMTEKIFARASEKTQLSPGENVWVNVDVLMTHDVCGPGSIGIFKKEFGQDAKVWDREKVVIIPDHYIFTADERANRNVDILRDFCTEQNIKYFYDIKDLGNFKANPDYKGVCHVALAQEGHCRPGEVLLGTDSHTCTAGAFGQFATGIGNTDAGFVLGAGKLLLKVPPTLRFVLDGEMPDYLLSKDLILQIIGEISVAGATYKAMEFVGSTVESLSMEERMTLCNMVVEAGGKNGIVPADSTTFKYLEDKTSVPYEPVYSDGQARFLSEYRFDVSKLEPLVAKPHSPDNRALARECKDVKIDRVYIGSCTGGKTEDFMAAAKVFLASGKKVKVPTFLVPATQKVWMDVYSLPVPGAGGKTCSQIFEEAGCDTPASPSCGACLGGPRDTYARMNEAQVCVSTTNRNFPGRMGHKEGQIYLASPYTAAASALTGFVTDPREFLQ

SEQ ID NO: 19530 - protein, 510 aa, Gossypium hirsutum
MASSLASPSPTSSFIRNKKDLGVSAFPSTSQIAIQKCKKQVSKKIVSVMAPQQSERKPATTGSVKTGMTMTEKILAKASEKPQLSPGDNVWVNVDILMTHDVCGPGSIGIFKKEFGQNAKVWDREKIVIIPDHYIFTSDERANRNVDILRDFCTEQNIKYFYDIKDLSNFKANPDYKGVCHVALAQEGHCRPGEVLLGTDSHTCTAGAFGQFATGIGNTDAGFVLGTGKLLLKVPPTLRFVMDGEMPPYLLAKDLILQIIGEISVAGATYKAMEFVGTTVESLNMEERMTLCNMVVEAGGKNGVVPADSTTFKYLEGKTSLPYEPVYSDAQASYLSEYRFDISKLEPLVAKPHSPDNRALARECKDVKIDRVYIGSCTGGKTEDFLAAAKVFLASGKKVKVPTFLVPATQKVWLDLYTLPVPRSGGKTCSQIFEEAGCDTPASPSCGACLGGPKDTYARMNEPKVCVSTTNRNFPGRMGHKEGQIYLASPYTAAASALTGYVTDPREFLQ

SEQ ID NO: 19531 - protein, 499 aa, Allium cepa
MSTVMASNSALLGKKIELGCLVTTNKYPVKSSTKISSVMTPTQLKRTPSATGSVKHAMTMTEKILARASERSSLEPGDNIWVNIDTLMTHDVCGPGTIGIFKREFGQNAKVWDREKIIIIPDHYIFTSDERANRNVDILRDFCHEQNIKYFYDIKDLGNFKANPDYKGVCHVALAQEGHCRPGEVLLGTDSHTCNAGAFGQFATGIGNTDAGFVMGTGKLLLKVPPTLRFVLDGEMPDHLLAKDLILQIIGEISVAGATYKAMEFVGSTIESLTMEDRMTLCNMVVEAGGKNGVIPADATTFNYLEGKTSVGYEPVYSDEYARFFQDYKFDVSKLEPVVAKPHSPDNRALARECKDVKIDRVYIGSCTGGKTEDFLAAAKLFLAAGKKVKVPTFLVPATQKVWMDIYALPVPGSGGKTCSQIFEEAGCDTPASPSCGACLGGPLDTYARMNEPLVCVSTTNRNFPGRMGHKEGQIYLASPYTAAASALTGYVTDPREFL

SEQ ID NO: 19532 - protein, 505 aa, Medicago truncatula
MASSLVPSTSFFHTKKDLSLSAFSSPSSQRCHKHASKRITCSVAAPQQTQRQPSSTGSVKTAMTMTEKIMAKASEKGHVTPGDNIWVDVDVLMTHDVCGPGSIGIFKKEFGQDAKVWDREKVVIIPDHYIFTSDERANRNVDILRDFCHEQDIKYFYDIKDLSNFKVNPDYKGVCHIALAQEGHCRPGEVLLGTDSHTCTAGAFGQFATGIGNTDAGFVLGAGKLLLKVPPTLRFVMDGEMPNYLLAKDLILQIIGEISVAGATYKSMEFVGSTVESLNMEERMTLCNMVVEAGGKNGVIPPDSITYKYLEGKTSVPYEPVYSDQQARFLSEYRFDVSKLEPLVAKPHSPDNRALARECKDVKINRVYIGSCTGGKTEDFMAAAKVFLASGKKVKVPTFLVPATQKVWMDVYSLPVPGSGGKTCSQIFEEAGCDTPASPSCGACLGGPKDTYARMNEPQVCVSTTNRNFPGRMGHREGEIYLASPYTAAASALTGYVTDPREFLQ

SEQ ID NO: 19533 - protein, 510 aa, Phalaenopsis aphrodite
MAASTITATGSSLFGKKCDLGRLISSSSTSFVAHRCRKHSLNKILSVMAPSRSPQRSPSTSGSVKHAMTMTEKILARASERSHLEPGENVWVNVDVLMTHDVCGPGTIGIFKREFGENAKVWDREKIVIIPDHYIFTSDERANRNVDILRDFCMEQNIKYFYDIKDLGNFKANPDYKGVCHVALAQEGHCRPGEVLLGTDSHTCTAGAFGQFSSGIGNTDAGFVMGAGKLLLKVPPTLRFTLDGEMPSYLLAKDLILQIIGEITVAGARYKSMEFLGSTVESLSMEERMTLCNMVVEAGGKNGVVPADKTTFKYLEDKTSVEYQPVYSDENARFIQDYKFDVSKLEPLVAKPHSPDNRGLARECRDVKIDRVYIGSCTGGKTEDFMAAAKVFLASGKKVKVPTFLVPATQKVWMDLYGLPVPGSGGKTCSQIFEEAGCDTPTSPSCGACLGGPRDTYARMNEPQVCVSTTNRNFPGRMGHKEGQIYLASPYTAAASALTGFVTDPREFLQ

SEQ ID NO: 19534 - protein, 509 aa, Papaver somniferum
MASSAIAAGSATSSFIKKNEIGLSSFTPTSFRTHSCKRAFSKKVVSVMSPPQSERRPSTTGSVKTAMAMTEKIMARASEKSQVVPGENVWVNVDVLMTHDVCGPGTIGIFKKEFGENAKVWDREKIVIIPDHYIFTSDERANRNVDILRDFCAEQDIKYFYDIKDLGNFRANPDYKGVCHVALAQEGHCRPGEVLLGTDSHTCNAGAFGQFASGIGNTDAGFVMGTGKSLLKVPPTLRFILDGEMPSYLLAKDLILQIIGEITVAGATYKSMEFVGSAVESLTMEERMTLCNMVVEAGGKNGVVPADSTTYKYLEGKTSVEFNPVYSDDNARFLQQYTINVSKLEPLVAKPHSPDNRAMARECKDVKIDRVYIGSCTGGKTEDFLSAAKVFLASGKKVKVPTFLVPATQKVWMDLYAMEVPGSGGKTCSQIFEEAGCDTPASPSCGACLGGPRDTYARMNEPKVCVSTTNRNFPGRMGHKEGEIYLASPYTAAASALTGYVTDPRDYLQ

SEQ ID NO: 19535 - protein, 512 aa, Sesamum indicum
MASSAITPSSSFLADKKDGIGGFSAFRRQPPFPRSAQVSKRKVSKKIASVMAPQQSERKPSTTGAVKTGMTMTEKILARASEKTQLVPGENVWVNVDILMTHDVCGPGSIGIFKREFGENAKVWDREKVVIIPDHYIFTTDERANRNVDILRDFCTEQNIKYFYDIKDLGNFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVAGATYKAMEFVGSTVESLTMEERLTLCNMVVEAGGKNGIIPADSTTYKYLEDKTSLPYEPVVSDGDARFLSEYRFDISKLEPVVAKPHSPDNRALARECKDVKIDRVYIGSCTGGKTEDFMAAAKLFLASGKKVKVPTFLVPATQKVWMDIYSLPVPGSGGKTCSQIFEEAGCDTPASPSCGACLGGPRDTYARMNEPQVCVSTTNRNFPGRMGHKEGQIYLASPYTAAASALTGFVTDPREFLQ

SEQ ID NO: 19536 - protein, 509 aa, Trigonella foenum-graecum
MASSLVPTPSTSFFHTKKDLNLSAFSSSSSSSQRCHKHASKRISCSVAAPQQTQRQPSATGSVKTAMTMTEKIMARSSQKEHVTPGDNIWVDVDVLMTHDVCGPGSIGIFKKEFGQDAKVWDREKVVIIPDHYIFTSDERANRNVDILRDFCNEQNIKYFYDIKDLSNFKVNPDYKGVCHVALAQEGHCRPGEVLLGTDSHTCTAGAFGQFATGIGNTDAGFVLGAGKLLLKVPPTLRFVMDGEMPNYLLAKDLILQIIGEISVAGATYKSMEFVGSTVESLNMEERMTLCNMVVEAGGKNGVIPPDSITYKYLEGKTSVPYEPVYSDQKARFLSEYRFDVSKLEPLVAKPHSPDNRALARECKDVKINRVYIGSCTGGKTEDFMAAAKVFLASGKKVKVPTFLVPATQKVWMDVYSLPVPGSGGKTCSQIFEEAGCDTPASPSCGACLGGPKDTYARMNEPQVCVSTTNRNFPGRMGHREGEIYLASPYTAAASALTGYVTDPREFLQ

SEQ ID NO: 19537 - protein, 510 aa, Citrullus lanatus
MAASTGSALTSTAFLSNKKELDVAAFSSSLPFSYRRCERTVSKKICSVMTPQQSERKPSATGSVKTAMTMTEKIFAKASKKTELSPGENVWVDVDVLMTHDVCGPGSIGIFKKEFGENAKVWDREKVVIIPDHYIFTSDERANRNVDILRDFSKEQNIKYFYDIKDLSDFRVNPDYKGVCHVALAQEGHCRPGEVLLGTDSHTCTAGAFGQFASGIGNTDAGFVLGTGKSLLKVPPTLRFVMDGEMPDYLLAKDLILQIIGEISVSGATYKAMEFIGTTVESLTMEERMTLCNMVVEAGGKNGVIPPDSTTFKYLEGKTSKAYEPVYSDENARFLSEYRFDVSKLEPVVAKPHSPDNRALARECKDVKIDRVYVGSCTGGKTEDFLALAKVFLAAGKKVKVPTFIVPATQKVWMDLYSIPVPGAGGKTCSQIFEEAGCDTPASPGCAACLGGPRDTYARMNEPQVCVSTTNRNFPGRMGHKEGQIYLASPYTAAASALTGYVTDPREFLQ

SEQ ID NO: 19538 - protein, 511 aa, Ricinus communis
MASSAITSPSSSFITKKKDLGLSAFSSQSSPFYSIPKCKKSISKKIVSVMAPQQSERTPATTGSVKTAMTMTEKILARASEKSQLSPGENVWVNVDVLMTHDVCGPGSIGIFKREFGQNATVWDREKIVIIPDHYIFTTDERANRNVDILRDFCQEQNVKYFYDIKDLSNFKVNPDYKGVCHVALAQEGHCRPGEVLLGTDSHTCTAGAFGQFATGIGNTDAGFVLGTGKLLLKVPPTLRFVMDGEMPDYLLAKDLILQIIGEISVSGATYKSMEFVGTTVESLNMEERMTLCNMVVEAGGKNGVIPSDSTTFKYLEDKTSVPFEPVYSDEKARFLSEYRFDVSKLEPLVAKPHSPDNCALARECKDVKIDRVYIGSCTGGKTEDFMAAAKVFLASGKKVKVPTFLVPATQKVWMDVYSLPVPGSGGKTCSQIFEEAGCDTPASPSCGACLGGPKDTYARMNEPMVCVSTTNRNFPGRMGHKEGQIYLASPYTAAASALTGYVTDPREFLQ

SEQ ID NO: 19539 - protein, 510 aa, Carica papaya
MASSVISPSPPSIINSKKDLGFSASSSSLKLSIPRCQKRSVSRKIVSVMAPQQSERKPAATGSVKTVMTMTEKILARASEKPHLSPGDNVWVNVDILMTHDVCGPGSIGIFKKEFGENAKVWDREKIVIIPDHYIFTSDERANRNVDILREFCVEQNIKYFYDIKDLSNFKVNPDYKGVCHVALAQEGHCRPGEVLLGTDSHTCTAGAFGQFATGIGNTDAGFVLGTGKVLLKVPQTLRFVMDGEMPDYLLAKDLILQIIGEISVAGATYKAMEFVGTTVESLNMEERMTLCNMVVEAGGKNGVIPADSTTFKYLEDKTALPYEPVYSDDQASFLSEYRFDVSKLEPLVAKPHSPDNRALARECKDVKIDRVYIGSCTGGKTEDFLAAAKVFLASGKKVKVPTFLVPATQKVWMDLYTLPVPGSGGKTCSQIFEEAGCDTPASPSCGACLGGPKDTYARMNEPKVCVSTTNRNFPGRMGHKEGQIYLASPYTAAASALTGYVTDPREFLM

SEQ ID NO: 19540 - protein, 508 aa, Tabernaemontana elegans
MASSAIASPHTPLIKKKDVGLSSFSSQASFSIKSSKKKVSKKIVSVMAPQQSERKPSTTGSVKTGMTMTEKILAKASEKSQLSPGENVWVNVDVLMTHDVCGPGAIGIFKKEFGEDAKVWDREKVVIIPDHYIFTADERANRNVDILRDFCTEQNIKYFYDIKDLGNFKANPDYKGVCHVALAQEGHCRPGEVLLGTDSHTCTAGAFGQFATGIGNTDAGFVLGTGKLLLKVPPTLRFVMDGEMPSYLLAKDLILQIIGEISVAGATYKSMEFVGTTVESLTMEERMTLCNMVVEAGGKNGVVPADNTTYKYLEDKTSVPYEAVYSDEQARFLSEYRFDISKLEPLVAKPHSPDKRALARECKDVKIDRVYIGSCTGGKTEDFMAAAKVFLASGKKVKVPTFLVPATQKVWMDIYALPVPGSGGKTCSQIFEEAGCDTPASPSCGACLGGPRDTYARMNEPQVCVSTTNRNFPGRMGHKEGQIYLASPYTAAASALTGFVTDPREFLQ

SEQ ID NO: 19541 - protein, 508 aa, Panax ginseng
MASPAIASSFTPFINQKDVGLYAFSGKSSFYLPKWKKYFSREVVSVMAPQQSERKPSTTGSVKTGMTMTEKILARASEKPQLSPGENVWVNVDILMTHDVCGPGSIGIFKREFGQNAKVWDREKLVIIPDHYIFTTDERANRNVDILRDFCAEQNIKYFYDIKDLGNFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVSGATYKSMEFVGSTVESLTMEERMTLCNMVVEAGGKNGVVPADATTYKYLEDKTSLPYEPVYSDEQARFLSEYRFDISKLEPLVAKPHSPDNRALARECKDVKIDRVYIGSCTGGKTEDFLAAAKVFLASGKKVKVPTFLVPATQKVWMDVYSLPVPGSGGKTCSQIFEEAGCDTPASPSCGACLGGPKDTYARMNEAQVCVSTTNRNFPGRMGHKEGQIYLASPYTAAASALTGFVTDPREFLQ

SEQ ID NO: 19542 - protein, 509 aa, Papaver somniferum
MASSTIAAGSATSSFIKKNEMGLSSFTPTSFRTHSCKRAFSKKVVSVMSPPQSERRPSTTGSVKTAMTMTEKIMARASEKSQVVPGENVWVNVDVLMTHDVCGPGTIGIFKKEFGENAKVWDREKIVIIPDHYIFTSDERANRNVDILRDFCAEQDIKYFYDIKDLGNFRANPDYKGVCHVALAQEGHCRPGEVLLGTDSHTCNAGAFGQFASGIGNTDAGFVMGTGKSLLKVPPTLRFILDGEMPSYLLAKDLILQIIGEITVAGATYKSMEFVGSAVESLTMEERMTLCNMVVEAGGKNGVVPADSTTYKYLEGKTSVEFNPVYSDDNARFLQQYAINVSKLEPLVAKPHSPDNRAMARECKDVKIDRVYIGSCTGGKTEDFLSAAKVFLASGKKVKVPTFLVPATQKVWMDLYAMAVPGSGGKTCSQIFEEAGCDTPSSPSCGACLGGPRDTYARMNEPKICVSTTNRNFPGRMGHKEGEIYLASPYTAAASALTGYVTDPRDYLQ

SEQ ID NO: 19543 - protein, 520 aa, Aquilegia formosa
MASSTIASSSTPFIKQNDLGRSSFTSTYLPIQRYSRKASSSSSSSRKVVSVMAPSQSQRPPSTTGSVKTGMTMTEKILARASERSQLVPGENVWVNIDVLMTHDVCGPGTIGIFKKEFGENAKVWDREKIVIIPDHYIFTSDERANRNVDILRDFCMEQNIKYFYDIKDLGDFRANPDYKGVCHVALAQEGHCRPGEVLLGTDSHTCNAGAFGQFATGIGNTDAGFVMGAGKLLLKVPPTLRFVMDGEMPNYLLAKDLILQIIGEISVAGATYRSMEFVGSTVESLSMEERMTLCNMVVEAGGKNGVVPADSTTYKYLEGKTSVEFEPLYSDDKARFLSEYRFDVSKLEPLVAKPHSPDNRALARECKDVKIDRVYIGSCTGGKTEDFLAAAKLFHASGRKVKVPTFLVPATQKVWMDIYSIPVPGAGGKTCSQIFEEAGCDTPASPSCGACLGGPRDTYARMNEPKAKLLIVQVCVSTTNRNFPGRMGHKEGQIYLASPYTAAASALTGFVTDPRDFLQ

SEQ ID NO: 19544 - protein, 508 aa, Catharanthus roseus
MASSAIASTSTPLINKKDVGLSALSSQASFSIKSSKKTVSKKIVSVMAPQQSERKPSMTGSVKTGMTMTEKILARASEKSQLSPGENVWVNVDVLMTHDVCGPGAIGIFKKEFGEDAKVWDREKVVIIPDHYIFTADERANRNVDILRDFCTEQSIKYFYDIKDLGNFKANPDYKGVCHVALAQEGHCRPGEVLLGTDSHTCTAGAFGQFATGIGNTDAGFVLGTGKLLLKVPPTLRFVMDGEMPSYLLAKDLILQIIGEISVAGATYKAMEFVGTTVESLTMEERMTLCNMVVEAGGKNGVVPADSTTYKYLEDKTSMPFEPLYSDEQARFLSEYRFDISKLEPLVAKPHSPDNRALARECKDVKIDRVYIGSCTGGKTEDFMAAAKVFLASGKKVKVPTFLVPATQKVWMDIYALPVPGSGGKTCSQIFEEAGCDTPTSPSCGACLGGPRDTYARMNEPQVCVSTTNRNFPGRMGHKEGQIYLASPYTAAASALTGYVTDPREFLQ

SEQ ID NO: 19545 - protein, 508 aa, Malus domestica
MACSTVTPPSTSFIGNKKDLNLSAFSSATPLSSQKCKRKSKKICSVMSPQQSERKPATTGSVKTGMTMTEKIFARASEKTQLSPGENVWVDVDVLMTHDVCGPGSIGIFKKEFGQNAKVWDREKVVIIPDHYIFTTDERANRNVDILRDFCMEQNIKYFYDIKDLSNFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVAGGTYKAMEFVGSTVESLSMEERMTLCNMVVEAGGKNGIVPADSTTFKYLEDKTSVPYEPVYSDAKARFLKEYRFDISKLEPLVAKPHSPDNRALARECKDVKIDRVYIGSCTGGKTEDFMAAARVFLASGKKVKVPTFLVPATQKVWMDVYSLPVPGSGGKTCSQIFEEAGCDTPASPSCGACLGGPKDTYARLNEPQVCVSTTNRNFPGRMGHKEGQIYLASPYTAAASALTGHVTDPREFLQ

SEQ ID NO: 19546 - protein, 510 aa, Cicer arietinum
MASSLVAPPSTSFFHTKKDLNLSAFSSSSSSSSQRYQKHASRKICCSVSAPQQTQRQPSTTGSVKTAMTMTEKILARASQKEQVTPGDNIWVNVDILMTHDVCGPGSIGIFKNEFGKDAKVWDREKVVIIPDHYIFTSDERANRNVDILRDFCNEQNIKYFYDIKDLSNFKVNPDYKGVCHIALAQEGHCRPGEVLLGTDSHTCTAGAFGQFATGIGNTDAGFVLGAGKLLLKVPPTLRFVMDGEMPNYLLAKDLILQIIGEISVAGATYKSMEFVGSTVESLNMEERMTLCNMVVEAGGKNGVIPPDSITYKYLEGKTSVPYEPVYSDHQARFLSEYRFDVSKLEPLVAKPHSPDNRALARECKDVKINRVYIGSCTGGKTEDFMAAAKVFLASGKKVKVPTFLVPATQKVWMDVYSLPVPGSGGKTCSQIFEEAGCDTPASPSCGACLGGPKDTYARMNEPQVCVSTTNRNFPGRMGHREGEIYLASPYTAAASALTGYVTDPREFLQ

SEQ ID NO: 19547 - protein, 510 aa, Lupinus angustifolius
MAFSLIAPTSTPSLQHKNLTVPSDFSFTSTISTHRCHKPSSRRIYCSIAPPQQLQHRPSTTGSVKKAMTMTEKIFARASEKTHLSPGDNVWVNVDILMTHDVCGPGSIGIFKREFGEDAKVWDREKIVIIPDHYIFTSDERANRNVDILRDFCNEQNIKYFYDIKDLSNFKANPDYKGVCHVALAQEGHCRPGEVLLGTDSHTCTAGAFGQFATGIGNTDAGFVLGAGKLLLKVPPTLRFVMDGEMPPYLLAKDLILQIIGEITVAGATYKSMEFVGTTVESLNMEERMTLCNMAVEAGGKNGIVPADSTTYKYLEGKTSLSYEPVYSDQQASFLSEYRFDVSKLEPLVAKPHSPDNRALARECKDVKIDRVYIGSCTGGKTEDFMAAAKVFLASGKQVKVPTFLVPATQKVWMDIYSIPVPGSGGKTCSQIFEEAGCDTPASPSCAACLGGPKDTYARLNKPEVCVSTTNRNFPGRMGHKEGEIYLASPYTAAASALTGFVTDPREFLQ

SEQ ID NO: 19548 - protein, 510 aa, Manihot esculenta
MASPTIVPASSSFIANKKDLGLSAFSSSSSSFSIPKCRKSISKKIVSVMAPQQSERKTTTTGSVKTAMTMTEKILARASEKPQLSPGENVWVNVDILMTHDICGPGSIGIFKREFGENAKVWDHEKIVIIPDHYIFTADERSNRNVDILRDFCLEQNIKYFYDIKDISNFKVNPDYKGVCHVALAQEGHCRPGEVLLGTDSHTCTAGAFGQFATGIGNTDAGFVLGAGKLLLKVPPTLRFVMDGEMPDYLLAKDLILQIIGEISVAGATYKSMEFVGTTVESLSMEERMTLCNMVVEAGGKNGVVPADSTTFKYLEDKTSVPYEPVYSDEQARFLSEYRFDISKLEPLVAKPHSPDNRALARECKDVKIDRVYIGSCTGGKTEDFMAAAKVFLASGKKVKVPTFLVPATQKVWMDVYSLPVPGSSGKTCSQIFEEAGCDTPASPSCGACLGGPKDTYARMNEPMVCVSTTNRNFPGRMGHKEGQIYLASPYTAAASALTGYVTDPREFLQ

SEQ ID NO: 19549 - protein, 507 aa, Humulus lupulus
MASAIAPTSAPFLKKKELGLSSFSSSPEFSVQRCKRTVSKKICSVMTPQQSERKPATTGSVKTAMTMTEKIFAKSSEKSHLSPGENVWVNVDVLMTHDVCGPGSFGIFKKEFGENAKVWDREKIVIIPDHYIFTSDERANRNVDILRDFCTEQNIKYFYDIKDLGNFKANPDYKGVCHVALAQEGHCRPGEVLLGTDSHTCTAGAFGQFATGIGNTDAGFVLGTGKSLLKVPPTLKFVMDGEMPDYILAKDLILQIIGEISVAGATYKAMEFVGSTVESLSMEERMTLCNMVVEAGGKNGIVPADNTTYKYLEDKTSVPYEPVFSDAQARFLSEYRFDITKLEPLVAKPHSPDNRALARECRDVKIDRVYIGSCTGGKTEDFLAAAKVFVASGKKVKVPTFLVPATQKVWMDLYSLPVPGSGGKTCSQIFEEAGCDTPASPSCGACLGGPKDTYARMNEPKVCVSTTNRNFPGRMGHKEGEIYLASPYTAAASALTGYVTDPRDFLQ

SEQ ID NO: 19550 - protein, 511 aa, Triphysaria pusilla
MASSHLTPSSSLFVDKKDVGVSAFYSQAASIPFPQPAFKKGASKKIVSVMTPQQSERRPSTTGAVKTGMTMTEKILARASEKTQLSPGENVWVNVDILMTHDVCGPGSIGIFKREFGENAKVWDREKLVIIPDHYIFTSDERANRNVDILRDFCNEQNIKYFYDIKDLGNFKANPDYKGVCHVALAQEGHCRPGEVLLGTDSHTCTAGAFGQFATGIGNTDAGFVLGTGKLLLKTPPTLRFVLDGEMPDYLLAKDLILQIIGEISVAGATYKAMEFVGSTVESLTMEERMTLCNMVVEAGGKNGVVPADSTTFKYLEDKTSLPYEPVYSDGQARFLSEYRFDVSKMEPLVAKPHSPDNRALARECKDVKIDRVYIGSCTGGKTEDFMAAAKVFLASGKKVKVPTFLVPATQKVWMDVYSLPVPGSGGKTCSQIFEEAGCDTPTSPSCGACLGGPRDTYARMNEAQVCVSTTNRNFPGRMGHKEGQIYLASPYTAAASALTGFVTDPREFLQ

SEQ ID NO: 19551 - protein, 508 aa, Amsonia hubrichtii
MASSAIASTHTPLINKKDVSLSALSSQASFSIKCPKKRVSKKIVSVMAPKQSERRPSTTGAVKTGMTMTEKIFAKASEKSQLSPGENVWVNVDVLMTHDVCGPGSIGIFKKEFGEDAKVWDREKVVIIPDHYIFTADERANRNVDILRDFCTEQNIKYFYDIKDLGNFKANPDYKGVCHIALAQEGHCRPGEVLLGTDSHTCTAGAFGQFATGIGNTDAGFVLGAGKLLLKVPPTLRFVMDGEMPSYLLAKDLILQIIGEISVAGATYKAMEFVGSTVESLTMEERMTLCNMVVEAGGKNGVVPADSTTYKYLEDKTSVPYEPVYSDEQARFLSEYRFDISKLEPLVAKPHSPDKRALARECKDVKIDRVYIGSCTGGKTEDFMAAAKVFLASGKKVKVPTFLVPATQKVWMDVYALPVPGSGGKTCSQIFEEAGCDTPASPSCGACLGGPRDTYARMNEPQVCVSTTNRNFPGRMGHKEGQIYLASPYTAAASALTGFVTDPREFLQ

SEQ ID NO: 19552 - protein, 510 aa, Rosmarinus officinalis
MASSAVAPISSFLGDKKDVGFSAFCTQPSFPCSAQQSKKRASKKIVSVMAPQQSERKPSTTGAVKTGMTMTEKILARASEKSQLVPGENAWVNVDILMTHDVCGPGSIGIFKKEFGQNAKVWDREKVVIIPDHYIFTTDERANRNVDILRDFCNEQNIKYFYDIKDLGNFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVAGATYKAMEFVGSTVESLTMEERMTLCNMVVEAGGKNGVVPADSTTYKYLEDKTSLPFEPVFSDGGARFLQEYRFDISKLEPLVAKPHSPDNRALARECKDVKIDRVYIGSCTGGKTEDFMAAAKVFLASGKKVKVPTFLVPATQKVWMDVYSLPVPGSGGKTCSQIFEEAGCDTPASPSCGACLGGPRDTYARMNEAQVCVSTTNRNFPGRMGHKEGQIYLASPYTAAASALTGFVTDPREFLQ

SEQ ID NO: 19553 - protein, 478 aa, Vigna unguiculata
AFSSQRCFKAVPKGIRCSVAAPQRQPSTTGSVRTAMTMTEKILARASEKAQLSPGDNVWVNVDILMTHDVCGPGSIGIFKKEFGEDAKVWDREKLVIIPDHYIFTSDERANRNVDILRDFCHEQNIKYFYDIKDLSNFKANPDYKGVCHVALAQEGHCRPGEVLLGTDSHTCTAGAFGQFATGIGNTDAGFVLGTGKLLLKVPPTLRFVMDGEMPDYLLSKDLILQIIGEISVAGATYKAMEFVGTTVESLTMEERMTLCNMVVEAGGKNGVVPADSTTFKYLEGKTSLPYEPVYSDQKAGFLSEYRFDVSKLEPVVAKPHSPDNRALARECKDVKINRVYIGSCTGGKTEDFMAAAKVFLASGKKVKVPTFLVPATQKVWMDIYSIPVPGSGGKTCSQIFEEAGCDTPASPSCGACLGGPKDTYARMNEPQVCVSTTNRNFPGRMGHKEGQIYLASPYTAAASALTGYVTDPREFLQ

SEQ ID NO: 19554 - protein, 495 aa, Euphorbia peplus
DLGFSSISSSSSSSFCIPKCRRKSISKKIKSVMTPPQQLDRKPASTGSVKTAMTMTEKILARASDKSHLSPGENVWVNIDVLMTHDVCGPGSIGIFKREFGQNAKVWDREKLVIIPDHYIFTTDERANRNVDILRDFCQEQNIKYFYDIKDLGDFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVSGATYKSMEFVGTTVESLNMEERMTLCNMVVEAGGKNGVIPADSTTFKYLEDKTSVPYEPVYSDQQARFLSEYRFDVSKLEPLVAKPHSPDNRALARECKDVKIDRVYIGSCTGGKTEDFMAAAKVFLASGKKVKVPTFLVPATQKVWMDVYSLPVPGSGGKTCSQIFEEAGCDTPASPSCGACLGGPKDTYARMNEPIVCVSTTNRNFPGRMGHREGQIYLASPYTAAASALTGYVTDPREFLN

SEQ ID NO: 19555 - protein, 508 aa, Panax ginseng
MASSATASSFTPFINQKDVGLSAFSGNSSFYLPKWKKYFSREVVSVMAPQQSERKPSTTGSVKTGMTMTEKILARASEKPQLSPGENVWVNVDILMTHDVCGPGSIGIFKREFGQNAKVWDCEKLVIIPDHYIFTTDERANRNVDILRDFCTEQNIKYFYDIKDLGNFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVSGATYKSMEFVGSTVESLTMEERMTLCNMVVEAGGKNGVVPADATTYKYLEDKTSLPYEPVYSDGQARFLSEYRFDISKLEPLVAKPHSPDNRALARECKDVKIDRVYIGSCTGGKTEDFLASAKVFLASGKKVKVPTFLVPSTQKVWMDVYSLPVPGSGGKTCSQIFEEAGCDTPASPSCGACLGGPKDTYARMNEAQVCVSTTNRNFPGRMGHKEGQIYLASPYTAAASALTGFVTDPREFLQ

SEQ ID NO: 19556 - protein, 507 aa, Fragaria vesca
MSYSTLASPSTSFLNDTTTTKKDLGLSAFSSTFQRCRRSVSKKSCSVMAPSERKPATTGSVKTGMTMTEKILARASERTHLSPGDNVWVNIDVLMTHDVCGPGSFGIFKKEFGQNAKVWDREKIVIIPDHYIFTTDERANRNVDILRDFCTEQNIKYFYDIKDLGNFKANPDYKGVCHVALAQEGHCRPGEVLLGTDSHTCTAGAFGQFATGIGNTDAGFVLGTGKLLLKVPPTLRFVLDGEMPDYLLAKDLILQIIGEISVAGATYKAMEFVGSTVESLSMEERMTLCNMVVEAGGKNGIVPADSTTYKYLEDKTSVPYEPVYSDDKARFLTEYRFDISKLEPLVAKPHSPDNRALARECKDVKIDRVYIGSCTGGKTEDFMAAAKVFLASGKKVKVPTFLVPATQKVWMDVYSRPVPGSGGKTCSQIFEEAGCDTPASPSCGACLGGPKDTYARLNEPQVCVSTTNRNFPGRMGHKEGQIYLASPYTAAASALTGYVTDPREFLQ

SEQ ID NO: 19557 - protein, 508 aa, Coffea canephora
MASSTITSPPTPLINKKDAGLSAFSSQASFSVRKSQKRACKKIVSVMAPQQSERRPATTGSVKTGMTMTEKIFAKASEKSQLSPGENVWVNVDVLMTHDVCGPPAIGIFKREFGENAKVWDREKLVIIPDHYIFTTDERANRNVGILRDFCNEQNIKYFYDIQDLGNFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVAGATYKSMEFVGTTVESLTMEERMTLCNMVVEAGGKNGVVPADSTTYKYLEDKTSVPYEPVYSDEQARFLSEYRFDISKLEPLVAKPHSPDNRALARECKDVKIDRVYIGSCTGGKTEDFMAAAKVFLASGKKVKVPTFLVPATQKVWMDVYALPVPGSGGKTCAQIFEEAGCDTPASPSCGACLGGPKDTYARMNEPQVCVSTTNRNFPGRMGHKEGQIYLASPYTAAASALTGYVTDPREFLQ

SEQ ID NO: 19558 - protein, 511 aa, Euonymus alatus
MASSSVVAPFPSSSFISNNRDGSLSAFSSPVPFAIPKCKKQALRRIVSVMAPQQAERRPATSGSVKTAMTMTEKIFAKASEKPQLSPGENVWVNVDTLMTHDVCGPGSIGIFKKEFGQNAKVWNREKIVIIPDHYIFTSDERANRNVDILREFCMEQNIKYFYDIKDLSNFKANPDYKGVCHIALAQEGHCRPGEVLLGTDSHTCTAGAFGQFATGIGNTDAGFVLGTGKLLLKVPPTLRFVMDGEMPDYLLAKDLILQIIGEISVSGATYKSMEFVGSTVESLSMEERMTLCNMVVEAGGKNGVVPADSTTYKYLENRTTVPYEPVYSDSQARFLSEYRFDISKLEPLVAKPHSPDKRALARECKDVKIDRVYIGSCTGGKTEDFMAAAKIFLASGKRVKVPTFLVPATQKVWMDVYSLPVPGSGGKTCSQIFEEAGCDTPASPSCGACLGGPKDTYARMNEPKVCVSTTNRNFPGRMGHKEGQIYLASPYTAAASALTGYVTDPREFLQ

SEQ ID NO: 19559 - protein, 507 aa, Olea europaea
MASLTIFPSSSAFIKKDVSLSAFSSQPSFYVKSSKKRVCKKIASVMAPQQSERKPSTTGSVKTGLTLTEKILARASEKTQLVPGENVWVNVDILMTHDVCGPGAFGIFKKEFGENAKVWDREKVVIIPDHYIFTTDERANRNVDILRDFCTEQNIKYFYDIKDLGNFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVAGATYKAMEFVGTTVESLTMEERMTLCNMVVEAGGKNGVVPADNTTYKYLEEKTNLPYEPVYSDGQARFLQEYKFDVSKLEPLVAKPHSPDNRALARECKDVKIDRVYIGSCTGGKTEDFMAAAKVFLASGKKVKVPTFLVPATQKVWMDVYSLPVPGSGGKTCSQIFEEAGCDTPASPSCGACLGGPRDTYARMNEPQVCVSTTNRNFPGRMGHKEGQVYLASPYTAAASALTGFVTDPREFLQ

SEQ ID NO: 19560 - protein, 510 aa, Ocimum basilicum
MASSAVAPTSSFLSDKKDVGFSTFCTQPSFPCSAQLSKRRASKKIVSVMAPQQSERKPSMTGAVKNAMTMTEKILARASEKSQLVPGENAWVNVDILMTHDVCGPGSIGIFKKEFGQNAKVWDREKVVIIPDHYIFTTDERANRNVDILRDFCNEQNIKYFYDITDLGNFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVAGATYKAMEFVGSTVESLTMEERMTLCNMVVEAGGKNGVVPADSTTYKYLEGKTSLPFEPVFSDGQARFLQEYRFDISKLEPLVAKPHSPDNRALARECKDVKIDRVYIGSCTGGKTEDFMAAAKVFLAAGKKVKVPTFLVPATQKVWMDVYTLPVPGSGGKTCSQIFEEAGCDTPASPSCGACLGGPRDTYARMNEPQVCVSTTNRNFPGRMGHKEGQIYLASPYTAAASALTGFVTDPREFLQ

SEQ ID NO: 19561 - protein, 510 aa, Vaccinium corymbosum
MASSAIAPSSSPFISKVQKDVGLSAFSSQPSFSIRNAKKRVSRKITCVMAPQQTERKPATSGSVKTAMTMTEKILARASEKQQLSPGENVWVNVDVLMTHDVCGPGTFGIFKKEFGQNAKVWDREKVVIIPDHYIFTTDDRANRNVDICREFCMEQNIKYFYDIKDLGNFKANPDYKGVCHVALAQEGHCRPGEVLLGTDSHTCTAGAFGQFATGIGNTDAGFVLGAGKLLLKVPPTLRFVMDGEMPDYLLAKDLILQIIGEISVSGATYKAMEFVGSTVESLSMEERMTLCNMVVEAGGKNGVVPADSTTYKYLEGKTDTPYEAVYSDDQARFLSQYRFDVSKLEPLVAKPHSPDKRALARECKDVKIDRVYIGSCTGGKTEDFLAAAKVFLASGKKVKVPTFLVPATQKVWMDVYSLPVPGSGGKTCSQIFEEAGCDTPASPSCGACLGGPKDTYARLNEPQVCVSTTNRNFPGRMGHKEGQIYLASPYTAAASALTGFVTDPREFLQ

SEQ ID NO: 19562 - protein, 508 aa, Trifolium pratense
MASSLVPSPSTSFFHTKKDLNLSAFSSSSSSQICHKHASRKICCSVAAPQQTQRQPSTTGSVKTAMTMTEKIMARASEKQQVRPGDNIWTNVDILMTHDVCGPGSIGIFKKEFGEDAKVWDREKVVIIPDHYIFTSDERANRNVDILRDFCNEQDIKYFYDIKDLSNFKANPDYKGVCHIALAQEGHCRPGEVLLGTDSHTCTAGAFGQFATGIGNTDAGFVLGAGKLLLKVPPTLRFVMDGEMPDYLLAKDLILQIIGEITVAGATYKSMEFVGSTVESLNMEERMTLCNMVVEAGGKNGVIPPDSVTYKYLEGKTSVPYEPVYSDQQARFLSEYRFDVTKLEPLVAKPHSPDNRALARECKDVKINRVYIGSCTGGKTEDFMAAAKVFLASGKKVKVPTFLVPATQKVWMDVYSLPVPGSGGKTCSQIFEEAGCDTPASPSCGACLGGPKDTYARMNEPQVCVSTTNRNFPGRMGHREGEIYLASPYTAAASALTGYVTDPREFLQ

SEQ ID NO: 19563 - protein, 510 aa, Mimulus guttatus
MGSSALPPTSSFLSDKKDVGFSSFCTQPSFPCSAQVSKKMVSKKVVSVMTPQQSERKPSTTGAVKTGMTMTEKIFARASEKSQLIPGENVWVNVDILMTHDVCGPGSIGIFKKEFGKNAKVWDREKIVIIPDHYIFTADERANRNVDILRDFCNEQDIKYFYDIKDLGNFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVAGATYKAMEFVGSTVESLTMEERMTLCNMVVEAGGKNGIVPADSTTFKYLEDKTSLPYEPVYSDGQARFLQEYRIDVSKLEPLVAKPHSPDNRALARECKDVKIDRVYIGSCTGGKTEDFMAAAKLFHASGKRVKVPTFLVPATQKVWMDVYSLPVPGAGGKTCSQIFEEAGCDTPASPSCGACLGGPRDTYARMNEAQVCVSTTNRNFPGRMGHKEGQIYLASPYTAAASALTGFVTDPRDFLQ

SEQ ID NO: 19564 - protein, 511 aa, Petroselinum crispum
MASAAIASSSSSSFINQRKDVGLSAFPTNSSFYPSNSKKKLFSKNNIVSVMAPQSQRTPSTTGSVKTGMTMTEKILARASEKPQLSPGENVWVNVDILMTHDVCGPGSIGIFKKEFGQDAKVWDREKLVIIPDHYIFTKDERANRNVDILRDFCNEQNIKYFYDINDLGNFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVSGATYKSMEFVGSTVESLSMEERMTLCNMVVEAGGKNGVIPADATTYKYLEGKTSLPYEALYSDEKARFLSEYRFDISKLEPLVAKPHSPDNRALARECKDVKIDRVYIGSCTGGKTEDFLAAAKVFLASGKKVKVPTFLVPATQKVWMDVYSLPVPGSGGKTCSQIFEEAGCDTPASPSCGACLGGPKDTYARMNEAQVCVSTTNRNFPGRMGHKDGQIYLASPYTAAASALTGYVTDPREFLQ

SEQ ID NO: 19565 - protein, 511 aa, Triphysaria pusilla
MASSHLTPSSSLFVDKKDVGVSGFYSQASSIPFPQPAFKKEACKKIVSVMTPQQSERRPSTTGAVKTGMTMTEKILARASEKTQLSPGENVWVNVDILMTHDVCGPGSIGIFKREFGENAKVWDREKLVIIPDHYIFTSDERANRNVDILRDFCNEQNIKYFYDIKDLGNFKANPDYKGVCHVALAQEGHCRPGEVLLGTDSHTCTAGAFGQFATGIGNTDAGFVLGTGKLLLKTPPTLRFVLDGEMPDYLLAKDLILQIIGEISVAGATYKAMEFVGSTVESLTMEERMTLCNMVVEAGGKNGVVPADSTTFKYLEDKTSLPYEPVYSDGQARFLSEYRFDVSKMEPLVAKPHSPDNRALARECKDVKIDRVYIGSCTGGKTEDFMAAAKVFLASGKKVKVPTFLVPATQKVWMDVYSLPVPGSGGKTCSQIFEEAGCDTPTSPSCGACLGGPRDTYARMNEAQVCVSTTNRNFPGRMGHKEGQIYLASPYTAAASALTGFVTDPREFLQ

SEQ ID NO: 19566 - protein, 515 aa, Amaranthus tuberculatus
MAISSSISPPSSSFLPKNDVGLSAFPSSTFNCTQFAIAASKYKQMSLKNIVSVMAPHQTQRKPSTTGSVKNAMTMTEKILARASEKTQLNPGDNVWVNVDVLMTHDVCGPGSFGIFKKEFGQNAKVWDREKIVIIPDHYIFTSDERANRNVDILRDFVKEQNIKYFYDITDLSDFKVNPDYKGVCHVALAQEGHCRPGEVLLGTDSHTCNAGAFGQFATGIGNTDAGFVLGTGKILLKVPPTLRFVLDGEMPDYLLAKDLILQIIGEISVSGATYKSMEFVGSTVEGLTMEERMTLCNMVVEAGGKNGVVPADTTTFKYLEDKTSIPYEPVYSDDQARFLSEYRFDVSKLEPLVAKPHSPDNRALARQCKDVKIDRVYIGSCTGGKIEDFMAVAKVFLAAGKKVKVPTFLVPATQKVWLDVYTLPVPGSGGKTCAQIFEEAGCDTPGSPGCGACLGGPRDTYARMNEPMVCVSTTNRNFPGRMGHKEGQIYLASPYTAAASALTGFVTDPREFLQ

SEQ ID NO: 19567 - protein, 494 aa, Allium cepa
ASNSALLGKKIELGYLVTTNKYPVKISTKISSVMTPTQLKRTPSATGAVKHAMTMTEKILARASERSSLEPGDNIWVNIDTLMTHDVCGPGTIGIFKREFGQNAKVWDREKIIIIPDHYIFTSDERANRNVDILRDFCHEQNIKYFYDIKDLGNFKANPDYKGVCHVALAQEGHCRPGEVLLGTDSHTCNAGAFGQFATGIGNTDAGFVMGTGKLLLKVPPTLRFVLDGDMPDYLLSKDLILQIIGEISVAGATYKAMEFVGSTIESLTMEDRMTLCNMVVEAGGKNGVIPADATTFNYLEGKTSVGYEPVYSDEYARFFQDYKFDVSKLEPVVAKPHSPDNRALARECKDVKIDRVYIGSCTGGKTEDFLAAAKLFLAAGKKVKVPTFLVPATQKVWMDIYALPVPGSGGKTCSQIFEEAGCDTPASPSCGACLGGPLDTYARMNEPLVCVSTTNRNFPGRMGHKEGQIYLASPYTAAASALTGYVTDPREFL

SEQ ID NO: 19568 - protein, 508 aa, Amorphophallus konjac
MASTAMASSAVTFTGKREIGLYSSFSPSISTPNRCKKQATKKVVAVMAPTTQSRPPSTTGSVKHALTMTEKILAKASERTHLEPGENIWVNVDVLMTHDICGPGTIGIFKKEFGENAKVWDREKIVIIPDHYIFTSDERANRNVDILRDFCMEQNIKYFYDIKDLSNFRVNPDYKGVCHIALAQEGHCRPGEVLLGTDSHTCNAGAFGQFATGIGNTDAGFVMGTGKVLLKVPPTLRFILDGQMPSFLLAKDLILQIIGEITVSGATYRSMEFVGSTVESLSMEERMTLCNMVVEAGGKNGVVPADSTTFKYLEGKTSGDFEPVYSDENARFIRDYKIDVSKLEPLVAKPHSPDNRALARECKDVNIDRVYIGSCTGGKTEDFMAAAKVFLASGGKVKVPTFLVPATQKVWMDLYTLPVPGSDGKTCSQIFEEAGCDVPASPSCGACLGGPQDTYGRMNEPKVCVSTTNRNFHGRMGHKEGQIYLASPYTAAASALTGFVTDPRDFLQ

SEQ ID NO: 19569 - protein, 508 aa, Fagus grandifolia
MASSTIASNPTSFIPTKKDLGFTAISTPSLFSIPKCKRTISTKICSVMAPQQSERKPATTGSVKTAMTMTEKIFARSSKKTQLSPGENVWVNVDTLMTHDVSGPGSIGIFKKEFGENAKVWDKEKIVIIPDHYIFTRDERANRNVDILRDFCMEQNIKYFYDIKDLSNFKANPDYKGVCHIALAQGHCRPGEVLLGTDSHTCTAGAFGQFATGIGNTDAGFVLGTGKLLLKVPPTLRFTMDGEMPSYLLAKDLILQIIGEISVSGATYKAMEFDGTTVESLTMEERMTLCNMVVEAGGKNGLVPADSTTYKYLEDKTSVAYEPVYSDEQARFLSEYRFDVSKLEPLVAKPHSPDNRALARECKDVKIDRVYIGSCTGGKTEDFMAAAKIFLASGKKVKVPTFLVPATQKVWMDVYSLPVPGSGGKTCSQIFEEAGCDTPASPSCGACLGGPKDTYARMNEPMVCVSTTNRNFPGRMGHKEGQIYLASPYTAAASALTGYVTDPREFLQ

SEQ ID NO: 19570 - protein, 508 aa, Vitis vinifera
MASSAIASNSPAFIKKDVDLSAFSSSASSFSIQKTNKRNSRKIVSVMAPQQSPRSPSTSGSVKTAMTMTEKILARASEKPQLSPGENVWVNVDLLMTHDVCGPGSFGIFKKEFGENAKVWDREKIVIIPEHYIFTKDERANRNVDILREFCTEQNIKYFYDIKDLGNFRANPDYKGVCHVALAQEGHCRPGEVLLGTDSHTCTAGAFGQFATGIGNTDAAFVLGTGKILLKVPPTLRFVMDGEMPNYLLAKDLILQIIGEISVSGATYKSMEFVGTTVESLTMEERMTLCNMVIEAGGKNGVVPADSTTHKYLEDKTSLPYEPVYSDEQARFLSEYRFDISKLEPLVAKPHSPDKCALARECKDVKIDRVYIGSCTGGKTEDFLAAAKVFHASGKKVKVPTFLVPATQKVWMDVYSLPVPGCGGKTCSQIFEEAGCDTPASPTCGACMGGPRDTYARMNEPQVCVSTTNRNFPGRMGHKESQIYLASPYTAAASALRGYVTDPREFLI

SEQ ID NO: 19571 - protein, 510 aa, Lippia dulcis
MASSAIAYSSSFLVDKKDVGFAAFCKQPSFPCSAQVNKKRVSRKIVSVMAPQQSERSPSTTGGVKTAMTLTEKILARAAEKTQLVPGENAWVNVDILMTHDVCGPGSIGIFKKEFGENAKVWDCEKVVIIPDHYIFTTDERANRNVDILRDFCTEQNIKYFYDIKDLGNFKANPDYKGVCHVALAQEGHCRPGEVLLGTDSHTCTAGAFGQFATGIGNTDAGFVLGTGKLLLKVPPTLRFVMDGEMPDYLLAKDLILQIIGEISVAGATYKAMEFVGSTVESLTMEERMTLCNMIVEAGGKNGVVPADSTTYKYLEGKTSLPYEPVYSDGQARFLKEYRFDISKLEPLVAKPHSPDNRALARECKDVKIDRVYIGSCTGGKTEDFMAAAKVFLASGKKVKVPTFLVPATQKVWMDVYALPVPGSGGKTCSQIFEEAGCDTPASPSCGACLGGPRDTYARMNEAQVCVSTTNRNFPGRMGHKEGQIYLASPYTAAASALTGFVTDPREFLQ

SEQ ID NO: 19572 - protein, 508 aa, Trifolium pratense
MASSLVPSPSTSFFHTTKKDLNLSSFSSSSQRCHKHASRKIYCSVAAPQQTQRTPSTTGSVKTAMTMTEKIMARASEKQQVRPGDNIWTNVDILMTHDVCGPGSIGIFKKEFGEDAKVWDREKVVIIPDHYIFTSDERANRNVDILRDFCNEQDIKYFYDIKDLSNFKANPDYKGVCHIALAQEGHCRPGEVLLGTDSHTCTAGAFGQFATGIGNTDAGFVLGAGKLLLKVPPTLRFVMDGEMPDYLLAKDLILQIIGEITVAGATYKSMEFVGSTVESLNMEERMTLCNMVVEAGGKNGVIPPDSVTYKYLEGKTSVPYESVYSDQQARFLSEYRFDVTKLEPLVAKPHSPDNRALARECKDVKINRVYIGSCTGGKTEDFMAAAKVFLASGGKKVKVPTFLVPATQKVWMDVYSLPVPGSGGKTCSQIFEEAGCDTPASPSCGACLGGPKDTYARMNEPQVCVSTTNRNFPGRMGHREGEIYLASPYTAAASALTGYVTDPREFLQ

SEQ ID NO: 19573 - protein, 506 aa, Chrysanthemum coronarium
MAASSAISSPFIIPKDGGVSSLSAQSSGSIKVMQKKVSKKIVSVMTPQQSERKPSTTGSVKTGMTMTEKIFSRASEKSQLVPGENVWVNIDILMTHDVCGPGSIGIFKKEFGNDAKIWDREKVVIIPDHYIFTSDERANRNVDIIREFSHEQGIKYFYDIKDLSNFKANPDYKGVCHVALAQEGHCRPGEVLLGTDSHTCTAGAFGQFATGIGNTDAGFVLGTGKLLLKVPPTLRFVLDGEMPDYLLAKDLILQIIGEISVSGATYKAMEFVGSTVESLTMEERMTLCNMVVEAGGKNGIVPADATTFKYLEGKTSLPYEPVYSDGEARFLEEYRIDVSKLEPLVAKPHSPDNRALARECKDVKIDRVYIGSCTGGKTEDFMAAARVLLASGEKVKVPTFLVPATQKVWMDIYSLPVPGSGGKTCSQIFEAAGCDTPTSPSCGACLGGPKDTYARINEPQVCVSTTNRNFPGRMGHKDGQIYLASPYTAAASALTGFVTDPRDFLH

SEQ ID NO: 19574 - protein, 506 aa, Chrysanthemum coronarium
MAASSAISSPFIIPKDGGVSSLSAQSSGSIKVMQKKVSKKIVSVMTPQQSERKPSTTGSVKTGMTMTEKIFSRASEKSQLVPGENVWVNIDILMTHDVCGPGSIGIFKKEFGNDAKIWDREKVVIIPDHYIFTSDERANRNVDIIRDFSHEQGIKYFYDIKDLSNFKANPDYKGVCHVALAQEGHCRPGEVLVGTDSHTCTAGAFGQFATGIGNTDAGFVLGTGKLLLKVPPTLRFVLDGEMPDYLLAKDLILQIIGEISVSGATYKAMEFVGSTVESLTMEERMTLCNMVVEAGGKNGIVPADATTFKYLEGKTSLPYEPVYSDGEARFLEEYRIDVSKLEPLVAKPHSPDNRALARECKDVKIDRVYIGSCTGGKTEDFMAAARVLLASGEKVKVPTFLVPATQKVWMDIYSLPVPGSGGKTCSQIFEAAGCDTPTSPSCGACLGGPKDTYARINEPQVCVSTTNRNFPGRMGHKDGQIYLASPYTAAASALTGFVTDPRDFLH

SEQ ID NO: 19575 - protein, 518 aa, Citrus clementina
MASSVISPAPTSSFINNKKDLGSFCFSSTSQFSVNKCKKLAVSKKIVSVMAPQQSERRPATTGSVKNAMTLTEKIFARASEKPQLSPGDNVWVNVDILMTHDVCGPGSFGIFKKEFGENAKVWDREKIVIIPDHYIFTSDERANRNVDILRDFCMEQNIKYFYDIKDLGNFKANPDYKGVCHIALAQEGHCRPGEVLLGTDSHTCTAGAFGQFATGIGNTDAGFILGTGKVLLKVPPTLRFVLDGEMPDYLLAKDLILQIIGEISVAGATYKSMEFVGTTVERLSMEERMTLCNMVVEAGGKNGVVPADGTTFKYLEDKTSLPYEPVYSDEKASFLSEYRFDISKLEPLVAKPHSPDNRALARECKDVKIDRVYIGSCTGGKTEDFLAAAKVFLASGKKVKVPTFLVPATQKVWMDVYTLPVPGSGGKTCSQIFEEAGCDTPASPSCGACLGGPKDTYARMNEPMASCLSLQVCVSTTNRNFPGRMGHKEGQIYLASPYTAAASALTGYVTDPREFLE

SEQ ID NO: 19576 - protein, 507 aa, Cocos nucifera
MASPIMAPSSSIFGRKMDPGLMSRFNPSISAHRCRKQAMNRVLAVMAPTQPQRSPATTGSVKHAMSMTEKILARASERAQLAPGENVWVNVDVLMTHDVCGPGTIGIFKREFGQNAKVWDREKIVIIPDHYIFTSDERANRNVDILRDFCTEQNIKYYYDIKDIGNFRANPDYKGVCHIALAQEGHCRPSEVLLGTDSHTCNAGAFGQFASGIGNTDAGFVMGTGKILLKVPPTMRFILDGEMPKYLLAKDLILQIIGEITVAGATYKSMEFVGSTVESLNMEERMTLCNMVVEAGGKNGVVPVDKTTLKYLEDKTTLTFEPVYSDDCARFIQEYKFDVSKLEPLVAKPHSPDNRALARECKDVKIDRVYIGSCTGGKTEDFLAAAKVFLASGKKVKVPTFLVPATQKVWMDIYGLPVPGSGGKTCSQIFEEAGCEVPASPSCAACLGGPRDTYARMNEPQVCVSTTNRNFPGRMGHKEGQVYLASPYTAAASALTGYVTDPREFLL

SEQ ID NO: 19577 - protein, 518 aa, Citrus sinensis
MASSVISPAPTSSFINNKKDLGSFCFSSTSQFSVNKCKKLAVSKKIVSVMAPQQSERRPATTGSVKNAMTLTEKIFSRASEKPQLSPGDNVWVNVDILMTHDVCGPGSFGIFKKEFGENAKVWDREKIVIIPDHYIFTSDERANRNVDILRDFCMEQNIKYFYDIKDLGNFKANPDYKGVCHIALAQEGHCRPGEVLLGTDSHTCTAGAFGQFATGIGNTDAGFVLGTGKVLLKVPPTLRFVLDGEMPDYLLAKDLILQIIGEISVAGATYKSMEFVGTTVERLSMEERMTLCNMVVEAGGKNGVVPADGTTFKYLEDKTSLPYEPVYSDEKASFLSEYRFDISKLEPLVAKPHSPDNRALARECKDVKIDRVYIGSCTGGKTEDFLAAAKVFLASGKKVKVPTFLVPATQKVWMDVYTLPVPGSGGKTCSQIFEEAGCDTPASPSCGACLGGPKDTYARMNEPMASCLSLQVCVSTTNRNFPGRMGHKEGQIYLASPYTAAASALTGYVTDPREFLE

SEQ ID NO: 19578 - protein, 510 aa, Populus trichocarpa
MASSTISPNSTFFITKKDPGLSAFSSSSPSPFSIPKCKKSISKKIVSVMAPQQSERRPATTGSVKTALTMTEKIFARASEKPQLIPGENVWVNVDILMTHDVCGPGSIGIFKKEFGQDAKVWDREKVVIIPDHYIFTKDERANRNVDILRDFCNEQNIKYFYDIKDLGNFKANPDYKGVCHVALAQEGHCRPGEVLLGTDSHTCTAGAFGQFATGIGNTDAGFVLGTGKLLLKVPPTLRFVMDGEMPDYLQAKDLILQIIGEISVAGATYKSMEFVGSTVESLTMEERMTLCNMVVEAGGKNGVVPADSTTFKYLEDKTTLPYEPVYSDAQARFLSEYRFDISKLEPLVAKPHSPDNRALARECSDVKIDRVYIGSCTGGKTEDFMAVAKVFLASGKKVKVPTFLVPATQKVWMDVYTLPVPGSGGKTCAQIFEEAGCDTPASPSCGACLGGPKDTHARMNEPMVCVSTTNRNFPGRMGHKEGQIYLASPYTAAASALTGFVTDPREFLQ

SEQ ID NO: 19579 - protein, 509 aa, Solanum tuberosum
MAASSAIASSSTAFINKKNVGLSAFSSQSSFSVQTARKRISKKIVSVMTPQQTERKPATTGSVKTGMTMTEKILAKASDKPDVSPGDNVWVNVDVLMTHDVCGPGSIGIFKKEFGQNAKVWDREKLVIIPDHYIFTTDERANRNVDILRDFCNEQNIKYFYDIKDLGNFRANPDYKGVCHVALAQEGHCRPGEVLLGTDSHTCTAGAFGQFATGIGNTDAGFVLGTGKILLKVPPTLRFVMDGEMPDYLLAKDLILQIIGEISVAGATYKAMEFVGTTVESLTMEERMTLCNMVVEAGGKNGVIPADKTTYDYLEGRTSVPYEPVYSDEGARYLKEYRFDVSKLEPLVAKPHSPDNRALARECKDVKIDRVYIGSCTGGKTEDFMAAAKVFLASGKKVKVPTFLVPATQKVWMDVYSLPVPGSGGKTCSQIFEEAGCDTPASPSCGACLGGPKDTYARMNEAQVCVSTTNRNFPGRMGHKEGQIYLASPYTAAASALTGYVTDPREFLQ

SEQ ID NO: 19580 - protein, 509 aa, Solanum phureja
MAASSAIASSSTAFINKKDVGLSAFSSQSSFSVQTARKRISKKIVSVMTPQQTERKPATTGSVKTGMTMTEKILAKASDKPDVSPGDNVWVNVDVLMTHDVCGPGSIGIFKKEFGQNAKVWDREKLVIIPDHYIFTTDERANRNVDILRDFCNEQNIKYFYDIKDLGNFRANPDYKGVCHVALAQEGHCRPGEVLLGTDSHTCTAGAFGQFATGIGNTDAGFVLGTGKILLKVPPTLRFVMDGEMPDYLLAKDLILQIIGEISVAGATYKAMEFVGTTVESLTMEERMTLCNMVVEAGGKNGVIPADKTTYDYLEGRTSVPYEPVYSDEGARYLKEYRFDVSKLEPLVAKPHSPDNRALARECKDVKIDRVYIGSCTGGKTEDFMAAAKVFLASGKKVKVPTFLVPATQKVWMDVYSLPVPGSGGKTCSQIFEEAGCDTPASPSCGACLGGPKDTYARMNEAQVCVSTTNRNFPGRMGHKEGQIYLASPYTAAASALTGYVTDPREFLQ

SEQ ID NO: 19581 - protein, 509 aa, Solanum lycopersicum
MAASSAIASSSTTFINKKDVGLSAFSSQASFSVQTARKRISKRIVSVMTPQQTERKPATTGSVKTGMTMTEKILAKASDKPDVSPGDNVWVNVDVLMTHDVCGPGSIGIFKKEFGQNAKVWDREKLVIIPDHYIFTTDERANRNVDILRDFCNEQNIKYFYDIKDLGNFRANPDYKGVCHVALAQEGHCRPGEVLLGTDSHTCTAGAFGQFATGIGNTDAGFVLGTGKILLKVPPTLRFVMDGEMPDYLLAKDLILQIIGEISVAGATYKAMEFVGTTVESLTMEERMTLCNMVVEAGGKNGVIPADKTTYDYLEGRTSVPYEPVYSDEGARYLKEYRFDVSKLEPLVAKPHSPDNRALARECKDVKIDRVYIGSCTGGKTEDFMAAAKVFLASGKKVKVPTFLVPATQKVWMDVYSLPVPGSGGKTCSQIFEEAGCDTPASPSCGACLGGPKDTYARMNEAQVCVSTTNRNFPGRMGHKEGQIYLASPYTAAASALTGYVTDPREFLQ

SEQ ID NO: 19582 - protein, 246 aa, Secale cereale
MTAAPLLSLTDAATVTAVPAPGRAPTRARIQAAPRHPATVSLRCHRARPLTPAAATGDSPSSAAFHGECFVVGDNIDTDQIIPAEHLTLVPSKPDEYRKLGSFAFVGLPSAAYPIPFVAPGEESSRYAVIIGGANFGCGSSREHAPVALGAAGARAVVAEGYARIFFRNSVATGEVYPLELADSGASKECKTGDVVTVDLDNSVLINHTSGKQYKLKPIGDAGPVIEAGGIFAYARKTGMIASKSA

SEQ ID NO: 19583 - protein, 248 aa, Zea mays
MASAGAGEGKETAAGSSLHSKTLLKSQPLYQYILESTVFPREPDCLRELRVATATHPMAGMAASPDEVQLLQLLIEILGAKNAIEVGVFTGYSLLATALALPDDGKIVAIDVTRESYDQIGSPVIEKAGVAHKIDFRVGLALPVLDQMVAEEGNKGKFDFAFVDADKVNFLNYHERLLQLLRVGGLIAYDNTLWGGSVAASPDEPLSERDRALAAATREFNAAVAADPRVHVCQVAIADGLTLCRRVA

SEQ ID NO: 19584 - protein, 242 aa, Panicum virgatum
MAATGAGEGNKAAAGSASLHSKTLLKSEPLYQYILESTVFPREPDCLRELRLATASHPMAAMAASPDEVQLFGLLLEMLGARNAIEVGVFTGYSLLATALALPDDGKIVAIDVTRESYDRIGSPVIEKAGVAHKIDFHVGLALPVLDQMVADEGNKGAFDFAFVDADKVNFLNYHERLLQLVRVGGLIAYDNTLWGGSVVATPDEPLAAATREFNAAIAADRRVRVCQLAIADGLTLCRRVA

SEQ ID NO: 19585 - protein, 73 aa, Zea mays
MAVVRAPLGAVAVAALVVAIFMPAAAAAQAPAPAPTSDGTSIDLGIAYILMLVALVLTYLIHPLDASSPYKLF

SEQ ID NO: 19586 - protein, 73 aa, Sorghum bicolor
MAGMRAPLGVVAVAALVVAIFMPAAAAAQAPAPAPTSDGTSIDLGIAYILMLVALVLTYLIHPLDASSPYKLF

SEQ ID NO: 19587 - protein, 72 aa, Echinochloa colona
MAAARARLGAVAVAALVVAIFMPAAAAQAPAPAPTSDGTSIDLGIAYVLMLVALVLTYLIHPLDASSPYKLF

SEQ ID NO: 19588 - protein, 72 aa, Panicum virgatum
MAAPRAPLGAVAVAALVVAIFMPAAAAQGPAPAPTSDGTSIDLGIAYILMLVALVLTYLIHPLDASSPYKLF

SEQ ID NO: 19589 - protein, 72 aa, Panicum virgatum
MAAARAPLGAVAVAALVVAIFMPAAAAQGPAPAPTSDGTSIDLGIAYVLMLVALVLTYLIHPLDASSPYKLF

SEQ ID NO: 19590 - protein, 73 aa, Saccharum officinarum
MAGVRAPLGAVAVAALVVAIFMPAAAAAQAPAPAPTSDGTSIDLGIAYILMLVALVLTYLIHPLDASSPYKLF

SEQ ID NO: 19591 - protein, 74 aa, Pennisetum glaucum
  Sequence also found in Organisms: Cenchrus ciliaris
MAAAARSRLGAVAVAALVVAIFMPAAAVAQAPAPAPTSDGTSIDLGIAYVLMLVALVLTYLIHPLDASSPYKLF

SEQ ID NO: 19592 - protein, 76 aa, Cenchrus ciliaris
MAAAARSRLGAVAETTLVVAIFMPAAAVAQAQAPAPAPTSDGTSIDLGIAYVLMLVALVLTYLIHPLDASSPYKLF

SEQ ID NO: 19593 - protein, 314 aa, Panicum virgatum
MRLRLRLRGVLLVLALLLAATAVVPVLLLGDADDGAAARVAPAPPFNSSRVKAVSWQPRIFVYRGFLSDAECNHLVELGKKKVQRSMVADNDSGKSVMSEVRTSSGTFLDKRQDPVVTRIEERIAAWTFLPEENAENIQILRYEQGQKYEPHFDYFHDKVNQARGGHRYATVLMYLSTVDKGGETVFPNAKGWESQPKDDTFSDCARKGLAVKPVKGDAVLFFSLHVNGVPDPLSLHGSCPVIEGEKWSAPKWIHVRSYENSPVLATETEGCTDKSEHCAQWAAAGECGKNPVYMVGTEGLPGQCRKSCNVCDS

SEQ ID NO: 19594 - protein, 217 aa, Sorghum bicolor
MSFFGRGSRNQQRTFRPKKSAPSGNKGMQLKRHIDATLGSGNLREAVRLPIGEDLNEWLAVNTVDFFNQVNILYGTLMEFCTPATCPTMSAGPSYEYRWADGAKIKRPIEVSAPKYVEYLMDWIETQLDEETIFPQKLGAPFPPNFRDVVKTIFKRLFRVYAHIYHSHFQMIVKLKEEAHLNTCFKHFTLFTLEFRLIDRAELAPLNELIEPIILGY

SEQ ID NO: 19595 - protein, 216 aa, Zea mays
MSFFGRGSRNQRTFRPKKSAPSGNKGMQLKRHIDATLGSGNLREAVRLPIGEDLNEWLAVNTVDFFNQVNILYGTLMEFCTPATCPTMSAGPSYEYRWADGAKIKRPIEVSAPKYVEYLMDWVEAQLDEETIFPQKLGAPFPPNFRDVVKTIFKRLFRVYAHIYHSHFQVIVRLKEEAHLNTCFKHFTLFTLEFRLIDRAELAPLNELIEPIILGY

SEQ ID NO: 19596 - protein, 216 aa, Panicum virgatum
MSFFARGSRNQRTFRPKKSAPSGNKGMQLKRHIDATLGSGNLREAVRLPIGEDLNEWLAVNTVDFFNQVNILYGTLMEFCTPATCPTMSAGPKYEYRWADGVKIKRPIEVSAPKYVEYLMDWIEAQLDDENIFPQKLGAPFPSNFRDVVKTIFKRLFRVYAHIYHSHFQVIMKLQEEAHLNTCFKHFTLFTLEFRLIDRAELAPLSELIDPIILGR

SEQ ID NO: 19597 - protein, 214 aa, Primula obconica
MSLFGIGRNQRTFRPKKSAPSGSKGAQLRKHIDATLGSGNLREAVRLPPGEDLNEWLAVNTVDFFNQVNLLYGTLTEFCTGETCPTMTAGPKYEYRWADGVVIKKPIEVSAPKYVEYLMDWIESQLDDEAIFPQRLGAPFPPNFREVVKTIFKRLFRVYAHIYHSHFQKIVSLKEEAHLNTCFKHFILFTCEFGLIDKKELAPLQELIESIVPY

SEQ ID NO: 19598 - protein, 698 aa, Setaria italica
MNPYFVGFLVPVAVSLLLHKRRKAERKRGVQVEVGGEPGYAVRNYRFEQPVETHWEGVSTLAELFERSCKEYVYMPLLGTRKLISRETESAPGGRSFEKLHLGEYEWKCYAEAFKSVCNFSSGLIRLGHQKNERVAIFAETRAEWQVALQACFRQNITVVTIYASLGEEALCHSLNETEVTTVICGQKELKKLIDISGQLDTVTRVVYINEEGISDEVSLARNSTSWIIESFDEVGRLGTEAPVEANMPLPSDVAVIMYTSGSTGLPKGVMMTHCNVLATLSAVMTIVPVLGSKDIYLAYLPLAHILELAAEALMAAVGASIGYGSPLTLTDTSSKIKKGTLGDASALKPTLMTAVPAILDRVRDGVRKKVDGTGGAAKKLFDIGYNRRLAAINGSWLGAWGLEKLLWDTLVFGKVRAILGGKIRFVLSGGAPLSGDTQRFINICLGAPIGQGYGLTETCAGGTFSEYDDTSVGRVGAPLPCSYIKLIDWPEGGYLTTDSPMPRGEIVIGGPNVTKGYFKNEAKTNEVYKDDEKGMRWFYSGDIGRFHPDGCLEIIDRKKDIVKLQHGEYVSLGKVEAALIVSPYVENIMVHADPFHNYCVALVVAAHNELENWASQQGIKYSDFSDLCQKQEAVKEVLGSIAKAGKQARLEKFEIPAKIKLIPEPWTPESGLVTAALKLKREVIRKTYENDLAQLYA

SEQ ID NO: 19599 - protein, 695 aa, Pennisetum glaucum
YFVGFLVPVAVSLLIRKRRKAERKRGVQVEVGGEPGYAVRNYRFEQPVETHWEGVSTLAELFERSCKEYVYMPLFGTRKLISRETESAPGGRSFEKLHLGEYEWKCYAEAFKSVCNFSSGLIQLGHQKNERVAIFAETRAEWQIALQACFRQNITVVTIYASLGEEALCHSLNETEVTTVICGQKELKKMIDISGQLDTVTRVVYINEEGISDEVSLARNSTSWIIESFDEVGRLGTEAPVEANMPLPSDVAVIMYTSGSTGLPKGVMMTHRNVLATLSAVMTIVPVLGSKDIYLAYLPLAHILELAAEALMAAVGASIGYGSPLTLTDTSNKIKKGTLGDASALKPTLMTAVPAILDRVRDGVRKKVDGTGGAAKKLFDIGYNRRLAAINGSWLGAWGLEKLLWDRLVFRKVRAILGGKIRFVLSGGAPLSGDTQRFINICLGAPIGQGYGLTETCAGGTFSEYDDTSVGRVGAPLPCSYIKLIDWPEGGYLTTDSPMPRGEIVIGGPNVTKGYFKNEAKTNEVYKDDEKGMRWFYSGDIGRFHPDGCLEIIDRKKDIVKLQHGEYVSLGKVEAALIVSPYVENIMVHADPFHNYCVALVVAAHNELENWASQQGIKYSDFSDLCQKQEAVKEVLGSIAKAAKQARLEKFEIPAKIKLIPEPWTPESGLVTAALKLKREVIRKTYENDLAQLYA

SEQ ID NO: 19600 - protein, 698 aa, Panicum virgatum
MNPYFVGLLVPVAVSLLLRKRRKAEMKRGVRVEVGGDPGYAVRNYRFEQPVETHWEGVSTLAELFEQSCKEYVYMPLLGTRKLISREIESAPGGRSFEKLHLGEYEWKCYAEVFKSVCNFSSGLIRLGHQKNERVAIFAETKAEWQIALQACFRQNITVVTIYASLGEEALCHSLNEAEVTTVICDQKELKKLIHISGQLDTVTRIVYINEEGISDEVSLARNSTSWIIETFDEVGRLGTEAPVEANMPLPSDVAVIMYTSGSTGLPKGVMMTHGNVLATLSAVMTIVPALGSKDIYLAYLPLAHILELAAEALMAAVGASIGYGSPLTLTDTSSKIKKGTLGDASALKPTLMTAVPAILDRVRDGVRKKVDATGGVAKKLFDIGYNRRLAAINGSWLGAWGLEKLLWDTLVFGKVRAILGGKIRFVLSGGAPLSGDTQRFINICLGAPIGQGYGLTETCAGGTFSEYDDTSVGRVGAPLPCSYIKLIDWPEGGYLTTDSPMPRGEIVIGGPNVTKGYFKNEAKTNEVYKDDEKGMRWFYSGDIGRFHPDGCLEIIDRKKDIVKLQHGEYVSLGKVEAALIVSPYVENIMVYADPFHNFCVALVVAAHNELESWASQQGIKYSDFSDLCQKEEAVKEVLGSLAKAAKQARLEKFEVPAKIKLMPEPWTPESGLITAALKLKREVIRKTNENDLAQLYA

SEQ ID NO: 19601 - protein, 698 aa, Panicum virgatum
MNPYFVGFLFPVAVSLLLRKRRKAEMKRGVQVEVGGEPGYAVRNYRFEQPVETHWEGVSTLAELFEQSCKEYVYMPLLGTRKLISREIESAPGGRSFEKLHLGEYEWKCYAEAFKSVCNFSSGLIRLGHQKNERAAIFAETKAEWQVALQACFRQNITVVTIYASLGAEALCHSLNEAEVTTVICDQRELKKLIDISGQLDTVTRIVYINEKGIPDEVSLARNSTSWIIESFDEVVRLGTEAPVEANMPLPSDVAVIMYTSGSTGLPKGVMMTHRNVLATLSAVMTIVPALGSKDIYLAYLPLAHILELAAETLMAAVGASIGYGSPLTLTDTSNKIKKGTLGDASALKPTLMTAVPAILDRVRDGVRKKVDATGGVAKKLFDIGYNRRLAAINGSWLGAWGLEKLLWDTLVFGKVRAILGGKIRFVLSGGAPLSGDTQRFINICLGAPIGQGYGLTETCAGGTFSEYDDTSVGRVGAPLPCSYVKLIDWPEGGYLTTDSPMPRGEIVIGGPNVTKGYFKNEAKTNEVYKDDEKGMRWFYSGDIGRFHPDGCLEIIDRKKDIVKLQHGEYVSLGKVEAALIVSPYVENIMVHADPFHNFCVALVVAAHNELESWASQQGIKYSDFSDLCQKEEAVKEVLGSLAKAGKQARLEKFEIPAKIKLIPEPWTPESGLVTAALKLKREVIRKMYDNDLAQLYA

SEQ ID NO: 19602 - protein, 698 aa, Oryza sativa
MNPYFVGLLVPIAVSLLLRKRRMVGKMRALPVDVGGEPGYAIRNYRFKQPVETHWEGVTTLAELFEQSCKDYVNMPLLGTRKLISREQESSLDGRSFEKLHLGEYDWKCYAEVFKSVCNFASGLIRLGHQKTDRVAIFAETRAEWQIALQACFRQNITVVTIYASLGEEALCHSLNETEVTTVVCGQKELKKMIDISGQLDTVKRVIYINEEGISAEVSLAQKSTSWIIEPFEDVGRLGDTAPVDANMPLPSDVAVIMYTSGSTGLPKGVMMTHRNVLATLSAVMTIVPEIGKKDVYLAYLPLAHILELAAEALIAAVGASIGYGSPLTLTDTSNKIKKGTLGDASALKPTLMTAVPAILDRVRDGVRKKVDTKGGVAKQLFDVAYNRRLAAVNGSWLGAWGLEKLLWDMLVFKKVRAVLGGKIRFVLSGGAPLSGDTQRFINICLGVPIGQGYGLTETCAGGTFSEYDDPSVGRVGAPLPCSYIKLIDWSEGGYLTSDSPMPRGEIVIGGPNVTKGYFKNEAKTNEVYKDDEKGMRWFYSGDIGRFHPDGCLEIIDRKKDIVKLQHGEYVSLGKVEAALIVSPYVENIMIHADPFHSYCVALVVAAHNELENWASQQGVTYTDFVDLCQKPEAVKEVLGSLSKAAKQARLEKFEIPAKIKLISEPWTPESGLVTAALKLKREVLRKTYEDDLAKLYA

SEQ ID NO: 19603 - protein, 698 aa, Oryza sativa
MNPYFVGLLVPIAVSLLLRKRRMVGKMRALPVDVGGEPGYAIRNYRFKQPVETHWEGVTTLAELFEQSCKDYVNMPLLGTRKLISREQESSLDGRSFEKLHLGEYDWKCYAEVFKSVCNFASGLIRLGHQKTDRVAIFAETRAEWQIALQACFRQNITVVTIYASLGEEALCHSLNETEVTTVVCGQKELKKMIDISGQLDTVKRVIYINEEGISAEVSSAQKSTSWIIEPFEDVGRLGDTAPVDANMPLPSDVAVIMYTSGSTGLPKGVMMTHRNVLATLSAVMTIVPEIGKKDVYLAYLPLAHILELAAEALIAAVGASIGYGSPLTLTDTSNKIKKGTLGDASALKPTLMTAVPAILDRVRDGVRKKVDTKGGVAKQLFDVAYNRRLAAVNGSWLGAWGLEKLLWDMLVFKKVRAVLGGKIRFVLSGGAPLSGDTQRFINICLGVPIGQGYGLTETCAGGTFSEYDDPSVGRVGAPLPCSYIKLIDWSEGGYLTSDSPMPRGEIVIGGPNVTKGYFKNEAKTNEVYKDDEKGMRWFYSGDIGRFHPDGCLEIIDRKKDIVKLQHGEYVSLGKVEAALIVSPYVENIMIHADPFHSYCVALVVAAHNELENWASQQGVTYTDFVDLCQKPEAVKEVLGSLSKAAKQARLEKFEIPAKIKLISEPWTPESGLVTAALKLKREVLRKTYEDDLAKLYA

SEQ ID NO: 19604 - protein, 698 aa, Hordeum vulgare
MNPYFVGLLVPIAVSLLLQKKRKVEKKRGVPVDVGGEPGYAIRNHRFERPVETHWEGVNTLAELFEHACKEYVYMPLLGTRKLISREIESSPDGRSFEKLHLGDYEWKCYAEAFKSVCNFSSGLVNLGRQNNERVAIFAETQAEWQIALQACFRQNITVVTIYASLGEEALCHSLNETEVTTVVCGRKEFKKLIDIGWQLDTVKRVIYINEDGISAEVSIAQNSTSWSVKSFEEVGKLGAEAPVDANMPLPSDVAVIMYTSGSTGLPKGVMMTHRNVLATLSAVMTIVPELGRKDIYMAYLPLAHILELAAETLMAAVGASIGYGSALTLTDTSSKIKKGTLGDASALRPTLMTAVPAILDRVRDGVRKKVDAKGGVAKKLFDIGYSRRLAAISGSWLGAWGVEKLLWDRLVFMKVRAILGGNIRFVLSGGAPLSGDTQRFINICLGAPIGQGYGLTETCAGGTFSEYDDTSVGRVGAPLPCSYIKLIDWAEGGYLTTDSPMPRGEIVIGGPNVTKGYFKNEAKTNEVYKDDEKGLRWFYSGDIGRFHPDGCLEIIDRKKDIVKLQHGEYVSLGKVEAALAMNPYVENIMIHADPFHSYCVALVVAAQNELEKWALQQGLAYTDFADLCQKQEAVVEVLGSLTKAAKQARLEKFETPAKVKLMPDPWTPESGLVTAALKLKREVIRKTYEDDLAQLYA

SEQ ID NO: 19605 - protein, 698 aa, Secale cereale
MNPYFVGLLVPIAVSLLLQKRRKVEKKRGVPVDVGGEPGYAIRNHRFERPVETHWEGVNTLAELFEHACKEYVYMPLLGTRKLISREIESSPDGRSFEKLHLGDYEWKCYAEAFKSVCNFSSGLVNLGRQNNERVAIFAETQAEWQIALQACFRQNITVVTIYASLGEEALCHSLNETEVTTVVCGRKEFKKLIDIGWQLDTVKRVIYINEDGISAEVSIAQNSTSWSVKSFEEVGKLGAEAPVDANMPLPSDVAVIMYTSGSTGLPKGVMMTHRNVLATLSAVMTIVPELGRKDIYMAYLPLAHILELAAETLMAAVGASIGYGSALTLTDTSSKIKKGTLGDASALRPTLMTAVPAILDRVRDGVRKKVDAKGGVAKKLFDIGYSRRLAAISGSWLGAWGVEKLLWDRLVFTKVRAILGGNIRFVLSGGAPLSGDTQRFINICLGAPIGQGYGLTETCAGGTFSEYDDTSVGRVGAPLPCSYIKLIDWAEGGYLTTDSPMPRGEIVIGGPNVTKGYFKNEAKTNEVYKDDGRGLRWFYSGDIGRFHPDGCLEIIDRKKDIVKLQHGEYVSLGKVEAALAMSPYVENIMIHADPFHSYCVALVVAAQTELEKWALQQGLAYTDFADLCQKEEAVVEVLGSLTKAAKQARLEKFETPAKVKLIPDPWTPESGLVTAALKLKREVIRKTYEDDLAQLYA

SEQ ID NO: 19606 - protein, 698 aa, Triticum aestivum
MNPYFVGLLVPIAVSLLLQKRRKVEKKRGVPVDVGGEPGYAIRNHRFERPVETHWEGVNTLAELFEHACKEYLYMPLLGTRKLISREIESSPDGRSFEKLHLGEYEWKCYAEAFKSVCNFSSGLVNLGRQDNERVAIFAETQAEWQIALQACFRQNITVVTIYSSLGEEALCHSLNETEVTTVICGRKELKKLIDIGWQLDTVKRVIYINEEGISAEVSIAQNSTSWSVKSFEEVGKLGAEAPVDANMPLPSDVAVIMYTSGSTGLPKGVMMTHRNVLATLSAVMTIVPELGKKDIYMAYLPLAHILELAAETLMAAVGASIGYGSALTLTDTSSKIKKGTLGDASALRPTLMTAVPAILDRVRDGVRKKVDAKGGVAKKLFDIGYSRRLAAINGSWLGAWGVEKLLWDRLVFTKVRAILGGNIRFVLSGGAPLSGDTQRFINICLGAPIGQGYGLTETCAGGTFSEYDDTSVGRVGAPLPCSYIKLIDWAEGGYLTTDSPMPRGEIVIGGPNVTKGYFKNEAKTSEVYKDDERGLRWFYSGDIGRFHPDGCLEIIDRKKDIVKLQHGEYVSLGKVEAALAMSPYVENIMIHADPFHSYCVALVVAAQNELERWALQQGLAYTDFADLCQKQEAVVEVLESLTKAAKQARLEKFETPAKVKLIPDPWTPESGLVTAALKLKREVIRKTFEDDLAQLYA

SEQ ID NO: 19607 - protein, 698 aa, Hordeum vulgare
MNPYFVGLLVPIAVSLLLQKKRKVEKKRGVPVDVGGEPGYAIRNHRFERPVETHWEGVNTLAELFEHACKEYVYMPLLGTRKLISREIESSPDGRSFEKLHLGDYEWKCYAEAFKSVCNFSSGLVNLGRQNNERVAIFAETQAEWQIALQACFRQNITVVTIYASLGEEALCHSLNETEVTTVVCGRKEFKKLIDIGWQLDTVKRVIYINEDGISAEVSIAQNSTSWSVKSFEEVGKLGAEAPVDANMPLPSDVAVIMYTSGSTGLPKGVMMTHRNVLATLSAVMTIVPELGRKDIYMAYLPLAHILELAAETLMAAVGASIGYGSALTLTDTSSKIKKGTLGDASALRPTLMTAVPAILDRVRDGVRKKVDAKGGVAKKLFDIGYSRRLAAISGSWLGAWGVEKLLWDRLVFMKVRAILGGNIRFVLSGGAPLSGDTQRFINICLGAPIGQGYGLTETCAGGTFSEYDDTSVGRVGAPLPCSYIKLIDWAEGGYLTTDSPMPRGEIVIGGPNVTKGYFKNEAKTNEVYKDDEKGLRWFYSGDIGRFHPDGCLEIIDRKKDIVKLQHGEYVSLGKVEAALAMNPYVENIMIHADPFHSYCVALVVAAQNELEKWALQQGLAYTDFADLCQKQEAVVEVLGSLTKAAKQGRLEKFETPAKVKLMPDPWTPESGLVTAALKLKREVIRKTYEDDLAQLYA

SEQ ID NO: 19608 - protein, 692 aa, Avena sativa
GLLVPIAVSLLLQKRRKVEKKRGVPVDVGGEPGYAIRNHRFEHPVETHWEGVTTLAELFEHACKEYVYMPLLGTRKLISREIESSPDGRSFEKLHLGEYEWKCYAEAFKSVSNFSSGLIQLGHQKDERVAIFAETRAEWQIALQACFRQNISVVTIYASLGEEALCHSLNETEVTTVVCGQKEFKKLIDIGWQLDTVKRVIYINEEGISAEVSLAKNSTSWTVASFEEVCKLGIEAPIDANMPLPSDVAVIMYTSGSTGLPKGVMMTHRNVLATLSAVMTIVPELGKKDIYMAYLPLAHILELAAETLMAAVGASIGYGSALTLTDTSSKIKKGTLGDASALKPTLMTAVPAILDRVRDGVRKKVDANGGVAKKLFDIGYSRRLAAMNGSWLGAWGVEKLLWDRLVFTKVRAILGGKIRFVLSGGAPLSGDTQRFINICLGAPIGQGYGLTETCAGGTFSEYDDTSVGRVGAPLPCSYIKLIDWAEGGYLTTDSPMPRGEIVIGGPNVTKGYFKNEAKTSEVYKDDERGLRWFYSGDIGRFHPDGCLEIIDRKKDIVKLQHGEYVSLGKVEAALAMSPYVENIMIHADPFNSYCVALVVAAQSELEKWASQQRLAYSDFCDLCQKQEAVKEVLGSLATVAKQARLEKFETPAKVKLIPDPWTPESGLVTAALKLKREVIRKKYENDLAELYA

SEQ ID NO: 19609 - protein, 698 aa, Brachypodium distachyon
MNPYFVGFLVPIVVSLLLQKRRKVGNKRGVPVDVGGEPGYAIRNHRFEHPVETHWEGITTLAELFEKSCNEYLHMPLLGTRKLISKEMESSPDGRSFEKLHLGEYEWKCYAEAFKSVCNFSSGLIRSGHQNNERVAVFAETRAEWQIALQACFRQNITVVTIYASLGEEALCHSLNETEVTTVVCGQKELKKLIDISWQLDTVKRVIYINEEGISAELSLARNSTSWALESFDEIDRLGSEAPVDASMPLPSDVAVIMYTSGSTGLPKGVMMTHRNVLATLSAVMTVVPELGRKDIYMAYLPLAHILELAAEALMAAVGASIGYGSALTLTDTSSKIKKGTLGDASALKPTLMTAVPAILDRVRDGVRKKVDAKGGVVKKLFNIGYNRRLSAINGSWLGAWGVEKLLWDRLIFTNVRAILGGKIRFVLSGGAPLSGDTQRFINICLGAPIGQGYGLTETCAGATFSEYDDTSVGRVGAPLPCSYIKLIDWAEGGYLTTDSPMPRGEIVIGGPNVTKGYFKNEAKTNEVYKEDERGLRWFYSGDIGRFHPDGCLEIIDRKKDIVKLQNGEYVSLGKVEAALAMSPYVENIMVHADPFHSYCVALVVAARNELEKWALQQGVTYTDFTELCQNKEAVQEVLGSLAQAAKQTRLEKFEMPAKVKLISDPWTPESGLVTAALKLKREVLRKKYEDDLAQLYA

SEQ ID NO: 19610 - protein, 697 aa, Oryza sativa
MNPYFIGFAIPFLASLLFTKRKGEKKRGVPVDVGGEPGYVIRNHKFERPVETHWEGVSTLAELFEQSCEQYVYMPLLGTRKLISREMEAARDGRSFEKLHLGQYEWKSYADAFKTVCNFSSGLVRIGHQRDERVAIFADTRAEWQIALQACFRQSITVVTIYSSLGEGALCHSLNETEVTTVICGRKELKKLLDISGQLDTVKHVIYVNEEGVSSEVSLAQKCTSWRVESFEEVERLGLETPVEAKLPLPSDTAVIMYTSGSTGMPKGVMMSHRNVLAVVSAVMTIVPALGKKDVYLAYLPLAHILELAAETVMSAVGASIGYGSPLTLTDTSNKIKKGTQGDASALKPTLMTAVPAILDRVRDGVRKNVDAKGGAAKKLFDIAYSRRLAAINGSWFGAWGLEKHLWDMLVFQKVRAILGGRIRFILSGGAPLSGDTQRFINICLGAPIGQGYGLTETCAGGTFSEYDDNSVGRVGAPLPCSYIKLIDWAEGGYLTNDSPMPRGEIVIGGPNVTKGYFKNEAKTNEVYKDDERGMRWFYSGDIGRLHPDGCLEIIDRKKDIVKLQHGEYVSLGKVEAALSVCPYVDNIMIHADPFHNYCVALVVVAHSELKSWASQQGITYSDVSDLCEKQETVKEVLQCLAKAAKQARLEKFEIPAKVKLVPEPWTPESGLVTAALKLKREAIKKAYEDDLAALYS

SEQ ID NO: 19611 - protein, 697 aa, Oryza sativa
MNPYFIGFAIPFLASLLFTKRKGEKKRGVPVDVGGEPGYAIRNHKFERPVETHWEGVSTLAELFEQSCEQYVYMPLLGTRKLISREMEAARDGRSFEKLHLGQYEWKSYADAFKTVCNFSSGLVRIGHQRDERVAIFADTRAEWQIALQACFRQSITVVTIYSSLGEGALCHSLNETEVTTVICGRKELKKLVDISEQLDTVKHVIYVNEEGVSSEVSLAQKCTSWRVESFEEVERLGLETPVEAKLPLPSDTAVIMYTSGSTGMPKGVMMSHRNVLAVVSAVMTIVPALGKKDVYLAYLPLAHILELAAETVMSAVGASIGYGSPLTLTDTSNKIKKGTQGDASALKPTLMTAVPAILDRVRDGVRKNVDAKGGAAKKLFDIAYSRRLAAINGSWFGAWGLEKHLWDMLVFQKVRAILGGRIRFILSGGAPLSGDTQRFINICLGAPIGQGYGLTETCAGGTFSEYDDNSVGRVGAPLPCSYIKLIDWAEGGYLTNDSPMPRGEIVIGGPNVTKGYFKNEAKTNEVYKDDERGMRWFYSGDIGRLHPDGCLEIIDRKKDIVKLQHGEYVSLGKVEAALSVCPYVDNIMIHADPFHNYCVALVVVAHSELKSWASQQGITYSDVSDLCEKQETVKEVLQCLAKAAKQARLEKFEIPAKVKLVPEPWTPESGLVTAALKLKREAIKKAYEDDLAALYS

SEQ ID NO: 19612 - protein, 697 aa, Secale cereale
MNPYFIGFVIPFVASLMLTKRKAEKKRGLPVDVGGEPGYAIRNYRSEQPVETHWEGIFTLAELFEQSCKQYAYMPLHGTRKLISRETEVAADGRSFEKLHLGEYEWKSYIEAFKAVCNFSSGLMQIGHLKDERVAIFADTRAEWQIALQACFRQSITVVTIYASLGEGALCHSLNETEVTTVICGRKELKKLIDINGQLDTLKHVVYINEEGVSSEVSLAKQCTSWRVESFEEVERLGLETPIEANLPLPSDTAVIMYTSGSTGMPKGVMMSHRNVLATVSAVMTIVPALGKKDVYLAYLPLAHILELAAETIISAVGASIGYGSPLTLTDTSNKIKRGTQGDASALKPTLMTAVPAILDRVRDGVRKNVDAKGGAAKKLFDIAYSRRLAAVNGSWFGAWGLEKLVWDMLVFQKVRAILGGRIRFILSGGAPLSGETQRFINICLGAPIGQGYGLTETCAGGTFSEYNDTSVGRVGAPLSCSFIKLIDWVEGGYLTSDSPMPRGEIVIGGPNVTKGYFKNEAKTNEVYKDDERGMRWFYSGDIGRLHPDGCLEIIDRKKDIVKLQHGEYVSLGKVEATLSVSPYVDNIMVHADPSQNYCVALVVAAHGELENWASKQGIAYSDFANLCQKQETIKEVLQSLAKAGKQSRLEKFEIPARIKLIPEPWTPESGLVTAALKLKREVIKKGYQDDLAKLYR

SEQ ID NO: 19613 - protein, 697 aa, Secale cereale
MNPYFIGFVIPFVASLMLTKRKTEKKRGLPVDVGGEPGYAIRNYRSEQPVETHWEGIFTLAELFEQSCKQYAYMPLHGTRKLISRETEVAADGRSFEKLHLGEYEWKSYIEAFKAVCNFSSGLMQIGHLKDERVAIFADTRAEWQIALQACFRQSITVVTIYASLGEGALCHSLNETEVTTVICGRKELKKLIDINGQLDTLKHVVYINEEGVSSEVSLAKQCTSWRVESFEEVERLGLETPIEANLPLPSDTAVIMYTSGSTGMPKGVMMSHRNVLATVSAVMTIVPALGKKDVYLAYLPLAHILELAAETIISAVGASIGYGSPLTLTDTSNKIKRGTQGDASALKPTLMTAVPAILDRVRDGVRKNVDAKGGAAKKLFDIAYSRRLAAVNGSWFGAWGLEKLVWDMLVFQKVRAILGGRIRFILSGGAPLSGETQRFINICLGAPIGQGYGLTETCAGGTFSEYNDTSVGRVGAPLSCSFIKLIDWVEGGYLTSDSPMPRGEIVIGGPNVTKGYFKNEAKTNEVYKDDERGMRWFYSGDIGRLHPDGCLEIIDRKKDIVKLQHGEYVSLGKVEATLSVSPYVDNIMVHADPSQNYCVALVVAAHGELENWASKQGIAYSDFADLCQKQETIKEVLQSLAKAGKQSRLEKFEIPARIKLIPEPWTPESGLVTAALKLKREVIKKGYQDDLAKLYR

SEQ ID NO: 19614 - protein, 697 aa, Brachypodium distachyon
MNPYFIGFVVPFVASLLFTKRKAERKRGVPVDVGGEPGHAIRNYRFEQPVETHWDGIFTLAELFEQSCKQYVHMPLLGTRKLISRESEVASDGRSFEKLHLGQYEWKSYSKAFKAVCNFSSGLVRIGHLRDERVAIFADTQAEWQMALQACFRQNITVVTIYASLGEGALCHSLNETEVTTVICGRKELKKLIDINGQLDTLKHVVYINEEGVSSEVSLAKQCTRWRVESFEEVERLGLETPVQANLPLPSDTAVIMYTSGSTGMPKGVMMSHRNVLATVSAVMTIVPGLGKKDVYLAYLPLAHILELAAETVILAVGASIGYGSPLTLNDTSNKIKRGTQGDASALKPTLMTAVPAILDRVRDGVRKNVDAKGGLAKRLFDIAYSRRLAAVNGSWFGAWGLEKLLWDVLVFQKVRAILGGQIRFILSGGAPLSGDTQRFINICLGAPIGQGYGLTETCAGGTFSEYDDTSVGRVGAPLSCSYIKLIDWVEGGYLTTDSPMPRGEIVIGGPNVTKGYFKNETKTNEVYKDDERGMRWFYSGDIGRLHPDGCLEIIDRKKDIVKLQHGEYVSLGKVEASLSLSPYVDNIMVHADPSQNYCVALVVAAHSELENWASKQGITYTDLSDLCQKQVAVKEVLQSLVKAGKQSRLEKFEIPARIKLIPEPWTPESGLVTAALKLKREVIKKGYGTDLAQLYS

SEQ ID NO: 19615 - protein, 697 aa, Triticum aestivum
MNPYFIGFVIPFVASLMLTKRKAEKKRGLPVDVGGEPGYAIRNYRSEQPVETHWEGVFTLAELFEQSCKQYAYMPLHGTRKLISRETEVAADGRSFEKLHLGEYEWKSYIEAFKAVCNFSSGLIQIGHQKDERVAIFADTRAEWQIALQACFRQNITVVTIYASLGEGALCHSLNETEATTVICGRKELKKLIDINGQLDTLKHVVYINEEGVSSEVSLAKQCTNWRVESFEEVERLGLETPIEANLPLPSDTAVIMYTSGSTGMPKGVMMSHRNVLATASAVMTIVPALGKKDVYLAYLPLAHILELAAETIISAVGASIGYGSPLTLTDTSNKIKRGTQGDASALKPTLLTAVPAILDRVRDGVRKNVDAKGGAAKKLFDIAYSRRLAAVNGSWFGAWGLEKLVWDMLVFQKVRAILGGRIRFILSGGAPLSGETQRFINICLGAPIGQGYGLTETCAGGTFSEYNDSSVGRVGAPLSCSFIKLIDWVEGGYLTSDSPMPRGEIVIGGPNVTKGYFKNEAKTNEVYKDDERGMRWFYSGDIGRLHADGCLEIIDRKKDIVKLQHGEYVSLGKVEATLSVSPYVDNIMVHADPSQNYCVALVVAAHGELENWASKQGIVYSDFADLCQKQETVKEVLQSLVKAGKQSRLEKFEIPARIKLIPEPWTPESGLVTAALKLKREVIKKGYQDDLAKLYR

SEQ ID NO: 19616 - protein, 697 aa, Setaria italica
MNPYFFGFILPFVASLLLTKRKSEKKRGVPVDVGGEPGCAVRNHRFERPVESHWEGVSTLAELFEQSCEQFAYMPLYGTRKLIARELEVAPDGRSFEKLHLGNYEWKSYADAFKTVCNFASGLLRVGHLKDERVAIFADTRAEWQIALQACFRQNIAVVTIYSSLGEGALCHSLNETEVTTVVCGRKELKKLVDISGQLDTVKHVIYINEEGVSTEVSLAEKCTSWTIKSFEEVESLGLERPVEANLPLPSDTAVIMYTSGSTGMPKGVMMSHRNVLAVVSAVMTIVPYLGKKDVYLAYLPLAHILELAAEAIITGVGASIGYGSPLTLTDTSNKIKKGTRGDASALKPTLMTAVPAILDRVRDGVRKNVDAKGGLAKKLFNIAYSRRLAAVNGSWLGAWGLEKLLWDMLVFQKVRAILGGRIRFILAGGAPLSGDTQRFINICLGAPISQGYGLTETCAGGTFSEYDETSVGRVGPPLPCSYIKLIDWAEGGYLTTDSPMPRGEIVIGGPNVTKGYFKNEAKTNEVYKDDERGMRWFYSGDIGRLHPDGCIEIIDRKKDIVKLQHGEYVSLGKVEAALSVCPYVDQIMIHADPFHSYCVALVVAAHSELKGWASKQGITYRDFADLCQKQQIVKEVLQSLAKAAKQARLEKFEIPAKIKLIPEPWTPESGLVTAALKLKREIIKKAYEKDLAQLYS

SEQ ID NO: 19617 - protein, 697 aa, Pennisetum glaucum
MNPYFFGFILPFVASLLLTKRKSEKKRGVPVGVGGEPGCTIRNHRFERPVESHWEGVSTLAELFEQSCEQFAYMPLYGTRKLIARELEVAPDGRSFEKLHLGNYEWKSYADAFKTVCNFASGLLRVGHLKDERVAIFADTRAEWQIALQACFRQNIAVVTIYASLGEGALCHSLNETEVTTVVCGRKELKKLVDISGQLDTVKHVIYINEEGVSTEVSLAEKCTSWTVKSFDEVESLGLERPVELNLPLPSDTAVIMYTSGSTGMPKGVMMSHRNVLAVVSAVMTIVPDLGKKDKYLAYLPLAHILELAAEAIITGVGASIGYGSPLTLTDTSNKIKKGTQGDASALKPTLMTAVPAILDRVRDGVRKNVDAKGGLAKKLFDIAYSRRLAAVNGSWLGAWGLEKLLWDMLVFQKVRAILGGRIRFILAGGAPLSGDTQRFINICLGAPISQGYGLTETCAGGTFSEYDETSVGRVGPPLPCSYIKLIDWAEGGYLTTDSPMPRGEIVIGGPNVTKGYFKNEAKTNEVYKDDERGMRWFYSGDIGRLHPDGCIEIIDRKKDIVKLQHGEYVSLGKVEAALSVCPYVDQIMIHADPFHSYCVALVVAAHSELKGWASKQGIAYSDFADLCQKQQIVKEVLQSLAKAAKQARLEKFEIPAKIKLIPEPWTPESGLVTAALKLKREIIRKAYDKDLAQLYS

SEQ ID NO: 19618 - protein, 697 aa, Triticum aestivum
MNPYFIGFVIPFVASLMLTKRKAEKKRGLPVDVGGEPGYAIRNYRSEQPVETHWEGIFTLAELFEQSCKQYAYMPLHGTRKLISRETEVAADGRSFEKLHMGEYEWKTYIEAFKAVCNFSSGLIQIGHQKDERVAIFADTRAEWQIALQACFRQNITVVTIYASLGEGALCHSLNETEVTTVICGRKELKKLIDINGQLDTLKHVVYISEDDVSSEVSLAKQCTNWRVESFEEVERLGLETPIEANLPLPSDTAVIMYTSGSTGMPKGVMMSHRNVLATASAVMTIVPALGKKDVYLAYLPLAHILELAAETIISAVGASIGYGSPLTLTDTSNKIKRGTKGDASALRPTLMTAVPAILDRVRDGVRKNVDAKGGVAKKLFDIAYSRRLAAVNGSWFGAWGLEKLVWDMLVFQKVRAILGGRIRFILSGGAPLSGETQRFINICLGAPIGQGYGLTETCAGGTFSEYNDTSVGRVGAPLSCSFIKLIDWVEGGYLTSDSPMPRGEIVIGGPNVTKGYFKNEAKTNEVYKDDERGMRWFYSGDIGRLHPDGCLEIIDRKKDIVKLQHGEYVSLGKVEATLSVSPYVDNIMVHADPSQNYCVALVVTAHGELENWASKQGIAYSDFADLCQKQETVKEVLQSLAKAGKQSRLEKFEIPARIKLIPEPWTPESGLVTAALKLKREVIKKGYQDDLAKLYR

SEQ ID NO: 19619 - protein, 697 aa, Sorghum bicolor
MNPYFLGFILPFVASLLLTKRKSEKKRGVPVNVGGEPGCAIRNHRFERPVETRWEGISTLAELFEQSCKQFACMPLLGTRKLIAREMVVAADGRSFEKLHLGNYEWKSYADAFKTVCNFASGLLRIGHLKDERVAIFADTRAEWQIALQACFRQNIAVVTIYASLGEGALCHSLNETEVTTVVCGRKELKKLIDISGQLDTVKHVIYINEEGVSAEVSLAQNCTSWTVMSFEEVESIGLQRPVEENLPLASDTAVIMYTSGSTGMPKGVMMSHRNVLAVVSAVMTIVPGLGKKDVYLAYLPLAHILELAAEAIITGVGASIGYGSPLTLTDTSNKIKKGTQGDASVLKPTLMTAVPAILDRVRDGVRKNVDAKGGLAKRLFDIAYSRRLAAVNGSWLGAWGLEKLLWDMLVFQKVRAILGGRIRFILAGGAPLSGDTQRFINICLGAPISQGYGLTETCAGGTFSEYDETSVGRVGPPLPCSYIKLVDWAEGGYLTTDSPMPRGEIVIGGPSVTKGYFKNEAKTNEVYKVDERGMRWFYSGDIGRLHPDGCLEIIDRKKDIVKLQHGEYVSLGKVEAALSVCSYVDQIMIHADPFHNYCVALIVAAQSELKNWASKQGMTYSDFSDLCQKQGTVKEVLQSLVKAAKQARLEKFEIPAKIKLIPEPWTPESGLVTAALKLKREVIKKAYEIDLAQLYS

SEQ ID NO: 19620 - protein, 698 aa, Zea mays
MNPYFLGFILPFVASLLLTKRKSEKKRGVPVNVGGEPGCAIRNHRFERPVKTRWEGISTLAELFEQSCKQFASTPLFGTRKLIAREMVVAADGRSFEKLHLGNYEWRSYADAFKTVCNFASGLLRIGHLKDERVAIFADTRAEWQIALQACFRQNIAVVTIYASLGEGALCHSLNETEVTTVVCGRKEFKKLIDISGQLDTVKHVIYIDEEGISVEVSLAENCTSWTVKSFEEVESIGLQRPVEANLPLPSDTAVIMYTSGSTGMPKGVMMSHQNVLAVVSAVMTIVPGLGKKDVYLAYLPLAHILELAAEAIITGVGASIGYGSPLTLTDTSNKIKKGTQGDASVLKPTLMTAVPAILDRVRDGVRKNVDAKGGLAKRLFDIAYSRRLAAVNGSWLGAWGLEKLLWDMLVFRKVRAILGGRIRFILAGGAPLSGETQRFINICLGAPISQGYGLTETCAGGTFSEYDETSVGRVGPPLPCSYIKLIDWAEGGYLTTDSPMPRGEIVIGGPNVTKGYFKNEAKTNEVYKVDERGMRWFYSGDIGRLHPDGCLEIIDRKKDIVKLQHGEYVSLGKVEATLSVCSYVDQIMIHADPFHSYCVALVVAAQSELKSWASKQGMTYSDFSDLCHKQGTVKEVLQSLVKAGKQARLEKFEIPAKIKLIPEPWTPESGLVTAALKLKREVIKKAYEMDLAQLYSQ

SEQ ID NO: 19621 - protein, 670 aa, Avena sativa
GVPVNVGGEAGYAIRNYRFEQPVETHWEGIFTLAELFEQSCKQYAHMPLHGTRKLISRETEVASDGRSFEKLHLGQYEWKSYIEAFKAVCNFSSGLVQIGHQKDERVAIFADTRAEWQIALQACFRQNITVVTIYASLGEGALCHSLNETEVTTVICGRKELKKLIDINGQLDTLKHVIYINEEGVSSEVSMAKQCTSWRVESFEEVERLGLETPVEANLPLPSDTAVIMYTSGSTGMPKGVMMSHRNVLATVSAVMTIVPALGKKDVYLAYLPLAHILELAAETIISAVGASIGYGTPLTLTDTSNKIKKGTQGDASALKPTLMTAVPAILDRVRDGVRKNVDAKGGVAKKLFDIAYSRRLAAVNGSWFGAWGLEKLMWEKLVFQKVRAILGGRIRFILSGGAPLSGDTQRFINICLGAPIGQGYGLTETCAGGTFSEYDDTSVGRVGAALSCSYIKLIDWVEGGYLTTDSPMPRGEIVIGGPNVTKGYFKNEAKTNEVYKDDERGMRWFYSGDIGRLHPDGCLEIIDRKKDIVKLQHGEYVSLGKVEATLSVSPYVDNIMVHADPSQNYCVALVVAAPGELENWASKQGLAYTDMSDLCQKQEAVREVLQSLTKAGKQAHLEKFEIPARIKLIPEPWTPESGLVTAALKLKREVIKKGYESELAKLYR

SEQ ID NO: 19622 - protein, 696 aa, Zea mays
MHRAAAATVAAPQATDAQLLAGAVEAAIATRSARLGRAAHARALRLLSPALPPFLCAHLVNLYSKLDLPGAAAASLAADPSPTVVSYTAFISGAAQHARPLQALSAFAAMLRLGLRPNDFTFPSAFKAAASAPPRSAAGTQLHALALRFGYLPDDAFVSCAALDMYFKTGCLALARRLFDEMPNRNVVAWNAVMTNAVLDGRPLETVEAYFGLRGAGGMPNVVSVCAFFNACAGMTNLSLGEQFYGFVAKCGFGKDVSVSNSVVDFYGKCRCVGKARAVFDGMGVRNNVSWCSMVVAYAQNGAEEEAFFVYLGARRAGEEPTDFMVSSVLTTCAGLLGLDLGRALHAVAVRSCIDSNIFVASALVDMYGKCGGIEDAEQVFFEMPQRNLVTWNAMIGGYAHIGDAHNALSVFDKMIMGQETAPNYITLVNVLTACSRGGLTKEGYELFQTMKWRFGIEPRIEHYACVVDLLCRAGMEERAYKIIQGMPMRPSISVWGALLGGCKMHGKTELGRIAAEKLFELDPQDSGNHVLLSNMLASAGRWAEATDVRKEMKNVGIKKDPGRSWITWKNVVHVFQAKDTTHDMNREIQALLAKLKGQMQAAGYMPDTQYALYDLEEEEKESEVFQHSEKLALAFGLICIPPGIPIRIMKNLRICVDCHRAFKFISGIAGREIIVRDNNMFHHFKNYECSCKDYW

SEQ ID NO: 19623 - protein, 695 aa, Panicum virgatum
MRRAAAAVAAPLATDPQLLAAAVETAIASRSPRLGRAAHARALRLLAPAIPPFICAHLVNLYSKLDLPGPAAAALASDTSPTVVSYTAFISGAAQHGRPALALSAFAAMLRLGLRPNDFTFPSAFKAAASAPPRSTIGPQVHALALRFGYLPDDAFVACAALDMYFKTGRLALARRLFEEMPYRNVVAWNAVMTNAVLDGRSLETVEAYFGLREAGGMPNVVSVCAFFNACAGATYLSLGEQFHGFVVKCGFEMDVSVSNSMVDFYGKCRCVEKAKAVFDGMGVRNSVSWCCMVVAYAQNGGEEEAFSVYLGARRAGEEPTDFMVSSVLTTCAGLLGLDQGRALHAVAVRSCIDANIFVASALVDMYGKCGGIEDAEQVFLDMPQRNLVTWNAMVGGYAHIGDAWNAFAVFNDMIKCGETAPNYITLVNVLAACSRGGLTNEGYELFKTMNDRFGIKPRIEHYACVVDLLGRAGMEEQAYEIIQGMPMRPSISVWGALLGACKMHGKTELGKIAAEKLFELDPQDSGNHVLLSNMLASAGRWAEATDVRKEMKNVGIKKDPGRSWITWKNAVHVFQAKDTKHEMNNEIQALLAKLKSQMQAAGYMPDTQYALYDLEEEEKESEVFQHSEKLALAFGLICIPNGVPIRIMKNLRICVDCHRAFKFISGIVGREIIVRDNNRFHHFKDYECSCKDYW

SEQ ID NO: 19624 - protein, 695 aa, Setaria italica
MRSAAAAAAPVAATDPQLLAAAVEAAIASRSPRLGRAAHARAIRLLAPAIPPFIRAHLVNLYSKLDLPGPAAAALASDPSPTVVSYTAFISGAAKHGRPAPALSAFAAMLRLGLRPNDFTFPSAFKAAAIAPPSSAIGPQVHSLALRFGYLPDDAFVSCAALDMYFKTGRLALARRLFEEMPNRNVVAWNAVMTNALLDGRPLETVEAYFGLREAGGMPNVVSVCAFFNACAGATYLSLGEQFHGFVVKCGLERDVSVSNSMVDFYGKCRCVGKAKVVFDGMGVRNSVSWCCMVVAYAQNGGEEEAFSVYLRARRAGEEPTDFMVSSVLTTCAGLLGLDLGRALHAVAVRSCIDANIFVASALVDMYGKCGGIEDAEQVFFEMPQRNLVTWNAMVGGYAHIGDARNALAVFDDMIKCGETAPNYITLVNVLAACSRGGLTKEGYELFKTMNDRFGIKPQIEHYACVVDLLGRAGMEEQAYEIIQGMPMRPSISVWGALLGACKMHGKTELGKIAAEKLFELDPQDSGNHVLLSNMFASAGRWAEATDVRKEMKNVGIKKEPGRSWITWKNVVHVFQAKDTKHEMNNEIQALLAKLKSQLQAAGYMPDTQYALYDLEEEEKESEVFQHSEKLALAFGLICIPPGVPIRIMKNLRICVDCHRAFKFISGIVGREIIVRDNNRFHHFKSYKCSCKDYW

SEQ ID NO: 19625 - protein, 691 aa, Setaria italica
MRRAAAPLATEPQLLAAAVEEAIASRSPRLGRAAHARALRLLAPAIPPFICAHLVNLYSKLDLPGPAAAALASDPSPTVVSYTAFISGAAQHGRPATALSAFAAMLRLGLRPNDFTFPSAFKAAASAPSWSTIGPQVHALALRFGYLPDDPFVACAALDMCFKTDRLALARRLFEEMPNRNVVAWNAVMTNAVLDGRPLETVEAYFGLRKAGGMPNVVSVCAFFNACAGATYLSLGEQFHGFVVKCGFEMDVSVSNSMVDFYGKCRCVGKAKAVFDGMRVRNSVSWCCMVVAYAQNGGEEEAFSLYLGARRAGEEPTDFMVSSVLTTCAGLLGLDLGRALHAVAVRSCIDANIFVASALVDMYGKCGDIENAEQVFFEMPQRNLVTWNAMVGGYAHIGDARNALAVFDGMMKCGETAPNYITLVNVLTACSRGGLTKEGYELFKTMHERFGIKPRIEHYACVVDLLGRAGMEEQAYEIIQGMPMRPSISVWGALLGACKMHGKTELGKIAAEKLFELDPQDSGNHVLLYNMFASASRWAEATDVRKEMKNVGIKKDPGRSWITWKNAVHVFHAKDTKHEMNNEIQALLAKLKSQMQAAGYMPDTQYALYDLEEEEKESEVFQHSEKLALAFGLICIPPGVPIRIMKNLRICVDCHRAFKFISAIVGREIIVRDNNRFHHFKNYECSCKDYW

SEQ ID NO: 19626 - protein, 695 aa, Panicum virgatum
MRRAAAAVAASLATDPELLAAAVETAIASRSPRLGRAAHARALRLLAPAIPPFIRAHLVNLYSKLDLPGPAAAALASDPSPTVVSYTAFISGASQHGRPAQALSAFAAMLQLGLRPNDFTFPSAFKAAASAPSRSTIGPQVHALALRFGYLPDDAFVACAALDMYFKTGRLALARRLFEEMPYRNVVAWNAVMTNAVLDGRPLETVEAYFGLREAGGMPNVVSVCAFFNACAGATYLSLGEQFHGFVVKCGFETDVSVSNSMVDFYGKCRCVEKAKAVFDGMGIRNNVSWCCMVVAYAQNGGEEEALSVYLGARRAGEEPTDFMVSSVLTTCAGLLGLDQGRALHAVAVRSCIDANIFVASALVDMYGKCGGIEDAEQVFLDMPQRNLVTWNVMVGGYAHIGDAWNALAVFDDMIECGETAPNYITLVNVLAACSRGGLTKEGYELFKTMNDRFGIKPRIEHYACLVDLLGRAGMEEQAYEIIQGMPMRPSISVWGALLGACKMHGKTELGKIAAEKLFELDPQDSGNHVLLSNMLASAGRWAEATDVRKEMKNVGIKKDPGRSWITWKNVVHVFQAKDTKHEMSNEIQALLAKLKSQMQAAGYMPDTQYALYDLEEEEKESEVFQHSEKLALAFGLICIPPGVPIRIMKNLRICVDCHRAFKFISGIVGREIIVRDNNRFHHFKNYECSCKDYW

SEQ ID NO: 19627 - protein, 694 aa, Oryza sativa
MRRAAAAAAVAPADPQLLAAAFESAIASRSPRLGRAAHARALRLIAPALSPFICAHLVNLYSKLDLPAAAAAALASDPHPTVVSYTAFISGAAQHGRPLPALSAFAGMLRLGLRPNDFTFPSAFKAAASAPPRSTIGPQIHSLAIRFGYLPVDPFVSCAALDMYFKTGRLKLARHLFGEMPNRNVVAWNAVMTNAVLDGRPLETIEAYFGLREAGGLPNVVSACAFFNACAGAMYLSLGEQFHGFVVKCGFEMDVSVLNSMVDFYGKCRCAGKARAVFDGMGVRNSVSWCSMVAAYAQNGAEEEAFAAYLGARRSGEEPTDFMVSSALTTCAGLLGLHLGRALHAVAVRSCIDANIFVASALVDMYGKCGCVEDAEQIFYETPQRNLVTWNAMIGGYAHIGDAQNALLVFDDMIRSGETAPNYITLVNVITSCSRGGLTKDGYELFETMRERFGIEPRTEHYACVVDLLGRAGMEEQAYEVIQGMPMRPSISVWGALLGACKMHGKTELGRIAAEKLFELDPQDSGNHVLLSNMFASAGRWAEATDIRKEMKNVGIKKDPGCSWVTWKNVVHVFRAKDTKHEMYNEIQALLSKLRKQMQAAGYMPDTQYSLYDLEEEEKESEVFQHSEKLALAFGLICIPPGVPIRIMKNLRICVDCHRAFKFISGIVGREIIVRDNNRFHHFKQYQCSCGDYW

SEQ ID NO: 19628 - protein, 690 aa, Hordeum vulgare
MRAGAAMSADPQRLAAAVEAAIASRCPLLGRAAHARALRVLSPSIPPFIYAHLVNLYSKLDLPAAAASALASDPNPTVVSFTAFISGAAQHARPLPALSAFAAMLRLGLRPNDFTFPSAFKAAASAPPRSAVGPQIHALAIRFGYLPADAFVSCAALDMYFKTGRLGLARRLFEEMPNRNVVAWNAVMTNAVLDGRPLETVQAYFGLREAGGMPNVVSVCAFFNACAGAMLLLPGAQFHGFVVKCGFDMDVSVSNAMVDFYGKCRCAEKAKMVFDAMRVRNSVSWCSMVVAYAQNGAEEDAFAVYLGARSAGEEPTDFMVSSVLTTCAGLLGLDLGRALHAVAVRSCIDANIFVASALVDMYGKCGGIEDAQHVFFDMPQRNLVTWNAMIGGHANIGDAINALAVFSDMIASGETAPNYITLVNVITACSRGGLTKEGYELFETMKERFGIEPRTEHYACVVDLLARAGMEERAYEIIQRMPMRPSISLWGALLGACKMHGKTELGRIAAEKLFELDPQDSGNHVLLSNMLASAGRWAEATYVRKEMKDVGIKKDPGCSWITWKNGVHVFHAKDTKHEMNSEIRALLARLKKQMLASGYMPDTQYSLYDLEEEEKESEVFQHSEKLALAYGLIHIPPGVPIRITKNLRICVDCHRAFKFISGIVDREIIVRDNNRFHHFKQYECSCKDYW

SEQ ID NO: 19629 - protein, 689 aa, Brachypodium distachyon
MRPAAAADPQLLGAAFEAAISSRSPRLGRAAHARALRLLSPGLPPFICAHLVNLYSKLDLPAAAASALASDPNPTVVSFTAFISGAAQHARPLAALSAFAAMLRVGLRPNDFTFPSAFKAAACAPPRCSTVGPQIHALALRFGYLPGDPFVSCAAMDMYFKTGCLGLARRLFEEMPNRNVIAWNAVMTNAVIDGRPLETFKAYFGLREAGGMPNVVSVCAFFNACAGAMFLSLGEQFHGFVVTCGFDMDVSVSNAMVDFYGKCRCAGKARAVFDGMRVRNSVSWCSMIVAYAQHGAEEDALAVYMGARNTGEEPTDFMVSSVLTTCAGLLGLNFGRALHAVAVRSCIDANIFVASALVDMYGKCGGVEDAEQVFLDMPERNLVTWNAMIGGYAHIGDAQNALAVFDAMIRSGGTSPNHITLVNVITACSRGGLTKDGYELFDTMRERFGVEPRTEHYACVVDLLGRAGMEERAYEIIQRMPMRPSISVWGALLGACKMHGKTELGRIASEKLFELDPQDSGNHVLLSNMLASAGRWAEATDVRKEMKNVGIKKEPGCSWITWKNVVHVFYAKDTKHDRNSEIQALLAKLKKQMQASGYMPDTQYSLYDVEEEEKETEVFQHSEKLALAFGLIHIPPSVPIRITKNLRICVDCHRAFKFVSGIVGREIIVRDNNRFHYFKQFECSCKDYW

SEQ ID NO: 19630 - protein, 415 aa, Glycine max
MEGSKENRVPPLPLIPSSNLQQGGGPRMKRLLHHHHRLPLGNISQNVMPHSHVNKLDLARKFTPHTVQHHFPQPHPQPQENKKQNLLAPTPSYQLDCDIVDIDDDDGDGSDDAVPVFVKHTEAMLDEIDKIEEVEMEDVEEEPVLDIDACDRKDTLAVVEYIDDIYSFYKDIENSSRVSPNYMNSQFDINERMRAILIDWLVEVHYKFELLEETLFLTVNLIDRFLERQAVIRKKLQLVGVTAMLIACKYEEVSVPTVEDFILITDKAYTRNEVLDMEKLMMNILQFKLSVPTPYMFMRRFLKAAHSDKKLELLSFFLVELCLVECKMLKFSPSLLAAAAIYTAQCSLYQFKQWTKTTEWYTDYSEEKLLECSRLMVTFHQKAGSGKLTGVYRKYNTWKYGCAAKIEPALFLLDN

SEQ ID NO: 19631 - protein, 389 aa, Cajanus cajan
GGSRMESKKPIHHRLPLGNINLNVMPNKNPSHVNKPDLSRKCTAHPVLHHHPLPQETKKQNLLAPTPSYQLDHDIIDIDDDEDAGDNAVPVFVKHTEAMLDEIDRIEEVEMEDVEEPVMDIDACDRKDPLAVVEYIDDLYRFYKDTENSSCVSPNYMISQLDINERMRAILIDWLIEVHYKFELLEETLFLTVNLIDRFLELQAVIRKKLQLVGVTAMLIACKYEEVSVPTVEDFILITDKAYTRNEVLDMEKLMMNILQFKLSVPTPYVFMRRYLKAAHSDKKLELLSFFLVELCLVECKMLKFSPSLLAAAAIYTAQCSLYQFKQWTKTSEWYTAYSEEQLLECSRLMVTFHRKAGSGKLTGVYRKYSTWKYGCAARIEPALFLLEH

SEQ ID NO: 19632 - protein, 463 aa, Glycine max
MVPQPLLTLFLFLSLLSIVNSSPSQHLQIANAERRIDLTSHIIKVYLTLKVENLGTSPTSEVHIAFSPTEVEHLAIVRAAATSGKRKKKTYVPLDVKSAELPDGPNGTKFFSITLLTPLSKGETTTLEVLYILTHSLEPFPVEISQSESQLVYFRDSAILLSPYHVKQQTTFIKTPSTRVESFTVMDPTKRAGTELKYGPYENHPPYSYSPVLIHFENNNAFAVVEELEREIEISHWGSVQVTERYSLVHAGARHKGVFSRVEYQTKPGGTGVSSFKHLLAKLPPRVHSVYYRDGIGNISSSHLRTDSWKSELEIEPRYPLFGGWKSTFVIGYGLPLQDFLFESPDGRRYLNFTFGCPLVETVVDKLIVKVVLPEGSKDPTVEIPFEVKQHLEIKYSYLDVVGRTVVVLEKRNAVPEHNTPFQVYYRFNPIFMLAEPLMLVSAFFLFFVASVAYLHIDLSIRK

SEQ ID NO: 19633 - protein, 463 aa, Cajanus cajan
MAMQPLLTLLLFLSLLSVANSSPSQHLQIANAERRIDLASHIIKVYLTLKVENLGTSPASEVHLALSPTEVEHLAIVKAAATSGKRKKKTYVPLDVKSAELPDGPNGTKFFSITLLTPLSKGETTTLEVLYILTHSLEPFPVEISQSEPQLVYFRDSAILLSPYHVKQQTTFIKTPSTRVESFTVVDPTKHAGTELKYGPYDNHPPYSYSPVLVHFENNNPFAVVEELEREIEISHWGNLQVTERYSLVHAGARHKGAFSRVEYQTRPGGTGVSSFKHLLAKLPPRVHSVYYRDGIGNISSSHLRTDSRKSELEIEPRYPLFGGWKATFVIGYGLPLQDFLFESPDGRRYLNFTFGCPLAETVVDKLIVKVVLPEGSKDPTAVIPFEVEQHLEIKYSYLDVVGRTVVVLEKRNVVPEHNTPFQVYYTFNPIFMLAEPLMLVSAFFLLFATSVAYLHIDLSIRK

SEQ ID NO: 19634 - protein, 465 aa, Phaseolus vulgaris
MAMVPQPLLILLFSLSLLSIVNSSPSQHLQIVDAERRIDLTSHIIKVYLTLKVENLGTSAASEVHLAFSPTEVEHLATLKAAATSGKRKKKTYVPLDVKSAEVPDGPNGTKLFSITLLTPLSKGGTTTLEVLYILTRSLEPFPVEISQSESQLVYFRDSAILLSPYHVKQQTTFIKTPSTRVESFTVVDPTKRAGTELKYGPYENHPPYSYSPVLVHFENNNPFAVVEELEREIEISHWGSIQVTERYSLVHAGAQHKGVFSRVDYQTRSGRSGVSSFKYLLAKLPPRVHSVYYRDGIGNISSSHLRTDSRKSELEIEPRYPLFGGWKATFVIGYGLPLQDFLFESPDGRRYLNFTFGCPLVETVVDKLIVKVVLPEGSKDPTAQIPFEVKQHLEIKYSYLDVVGRTVVVLEKRNVVPEHNTPFQVYYGFNPIFMLAEPLMLVSAFFLLFVASVAYLHIDLSIRK

SEQ ID NO: 19635 - protein, 465 aa, Vigna unguiculata
MATVPQPLLILLFFLSLLSIVNSSPSQHIQIVDAERRIDLTSHIIKVYLTLKVENLGTSAASEVLLAFSPTEVEHLALLKAAATSGKRKKKTYVPLDVKSAKQPDGPNGTKFFSITLLTPLSKDETTTLEVLYMLTRSLEPFPVEISQSESQLVYFRDSAILLSPYHVKQQTTFLKTPSTRVESFTVVDPTKRAGTELKYGPYENHPPYSYSPVLVHFENNNPFAVVEELEREIEISHWGSIQVTERYSLVHAGAQHKGVFSRVEYQTRPAGTGVSSFKHLLAKLPPRVHSVYYRDGIGNISSSHLRTDSRKSELEIEPRYPLFGGWKATFVIGYGLPLQDFLFESPDGRRYLNFTFGCPLVETVVDKLIVKVVLPEGSKDPTAEIPFEVKQHLEIKYSYLDVVGRTVVVLEKRNVVPEHNIRLQVYYGFNPIFMLAEPLMLVSAFFLLFVASVAYLHIDLSIRK

SEQ ID NO: 19636 - protein, 464 aa, Cicer arietinum
MEPLLRIALLFLFFHLSILVNSSPSQHLQIINAERRIDLNSHIIKVYLTLKVENSGTSPTSEVHLAFSPAEAEHLAVVKAAATTGKRKKKTYVPLDVKSAELPEGPNGTKFFSITLLTPLSKGETITLEVLYILTHSLEPFPVEISQSESQLVYFRDSAILLSPYHVKQQTTFIKTPSARVESHTVVDPTKRVGTELKYGPYENHSPYSYSPVLVHFENNNPFAVVEELEREIEISHWGSLQITERYKLVHAGAKHKGVFSRVEYQTRSGASGVSSFKHLLAKLPPRVHSVYYRDEIGNISSSHLRTDFLKSELEFEPRYPLFGGWKSTFLIGYGLPLQDFLFESPDGRRYLNFTFGCPLAETVVDKLILKVVLPEGSKDPAAVIPFQVEQHLETKYSYLDIVGRTVVVLEKRNVVPEHNIPFQVYYNFNPIFMLAEPLMLASVFFLLFAASVAYLHMDISIRK

SEQ ID NO: 19637 - protein, 464 aa, Lotus japonicus
MEPLLRVPLLFIFISLFINLANSSSSQDVHIVNAERRIDLTSHIVKVYLTLKVENLGTSPVSEVHLAFSPTESEHLAIVKAAATSGKRKKKTYVPLDVKSAELPDGPNGTKFFSIALLTPLSKGETTTLEVLYRLTHSLEPFPVEISQSESQLVYFRDSAILLSPYHVKQQTTFIKTPSTRVESFTVVEPTKRAGTELKYGPYDSYSPYSYSPVLVHFENNNPFAVVEELEREIEISHWGSVQVTERYRLVHAGARHKGVFSRVEYQTRSGGSGVSSFKNLLLKLPPRVHSVYYRDEIGNISSSHLRTDFLKSELEIEPRYPLFGGWKSTFVIGYGVPLQDFLFESPDGRRYLNFTFGCPAEAVVDKLIVKVVLPEGSKDPAAVIPFEVEQHLETKYSYLDVVGRTVVALEKRNVVPEHNTPFQVYYNFNPIFMLAEPLMLVSVFFFLFMSAVAYLHMDISIRK

SEQ ID NO: 19638 - protein, 468 aa, Trifolium pratense
MAMEPLLRIGVLFLFLYFSILVNSSPAQHLQIINAERRIDLTSHIIKVYLTLKVENLGTSPTSEVRLAFSPAEAEHLAVVKAAITTGKRKKKTYVPLDVKSAGPPDGPNGSKFFSVTLLNPLGKGETTTLEVLYILTNSLEPFPVEISQSESQLVYFRDSAILLSPYHVKQQTTFIKTPSARVESFTVVEPTKRAGTELKYGPYDNHAPYSYSPVLVHFENNNPFAVVEELEREIEISHWGSIQVIERYRLTHAGARHKGVFSRVEYQTRSGVSGVSSFKHLLARLPPRVHSVYYRDEIGNISSSHLRKDFLKSELEFEPRYPLFGGWKSTFLIGYGLPLQDFLFESPDGKRYLNFTYGCPLSDTVVDKLIIKVVLPEGSKDPAAVIPFQVDQHLETKYSYLDIVGRTVVVLEKKNVVPEHNIPFQVYYNFNPIFMLAEPLMLASVFFLLFAASVAYLHVDLSIRKSS

SEQ ID NO: 19639 - protein, 470 aa, Lupinus angustifolius
MGSSFSQPLFFFFFFFLHLFLFAHSSSSSFQHLQIINAERRIDLNSHIIKVYLTLKVENSGTSPASEVHLAFSPTEVEHLAIVKAAATSGKQKKKTYTRLGVKSAELPDGPNGTKFFSITLLTPLSKGETITLEVLYQLTHSLEPFPVEISQSESQLVYFRDSAILLSPYHVKEQTTFIKTPSTRVESFTVVDPIKRSGTELKYGPYDDQLPYSYSPVLVHFENNNPFTVVEELEREIEVSHWGSVQVTERYRLVHGGARHKGVFSRVEYQSRQGSSGASSFKYLLARLPAKVHSVYYRDGIGNISSSHLRTGFVKSELEFEPRYPLFGGWKSTFVIGYGVPLQDFLFESPDGRRYLNFTFGCPLAEAVVDKLTVKVVLPEGSRDPTAVVPFQVEQRLEIKHSYLDVVGRTVVVLEKRNAVPEHNTPFQVYYSFNPIFMLAEPLMLVTAFFLFFVGSVAYLHIDLSIRKS

SEQ ID NO: 19640 - protein, 468 aa, Trigonella foenum-graecum
MVMEQPLLRIALFFLFLHFSILVNSSPSQHLQIINAERRIDLNSHIIKVYLTLKVENSGTTPASEVHLAFSPFEAEHLAVLKAAATTGKRKKKTYVPLDVKSAEIPDGPNGAKFFPITLLTPLSKGDTTTLEVLYILTHSLEPFPVEISQSESQLVYFRDSAILLSPYHVKQQTTFIKTPTARVESFTVVDPSKRAGTELKYGPYDDQTPYSYSPVLVHFENNNPFAVVEELEREIEISHWGSIQITERYKLVHAGARHKGVFSRVEYQTRSGASGVSSFKHLLAKLPPRVHSVYYRDEIGNISTSHLRTDFLKSELEFEPRYPLFGGWKSTFLLGYGLPLQDFLFESPDGRRYLNFTYGCPLAQTVVDKLIIKVVLPEGSKDPAAVIPFQVDQHLETKYSYLDIVGRPVVVLEKRNVVPEHNIPFQVYYNFNPIFMLAEPLMLASVFFLLFAASVAYLHVDLSIRKS

SEQ ID NO: 19641 - protein, 468 aa, Trifolium pratense
MAMEPLLRIGVLFLFLHLSVLVNSSPSHHLQIINAERRIDLTSHIIKVYLTLKVENLGTSPTSEVRLAFSPAEAEHLAVVKAAITTGKRKKKTYVPLDVKPVGPPDGPNGTKFFSVTLLTPLGKGETTTLEVLYILTHSLEPFPVEISQSESQLVYFRDSAILLSPYHVKQQTTFIKTPSSRVESFTVVEPTKRAGTELKYGPYDNHAPYSYSPVLVHFENNNPFAVVEELEREIEISHWGSIQVIERYRLTHAGARHKGVFSRVEYQTRSGVSGVSSFKHLLAKLPPRVHSVYYRDEIGNISSSHLRKDFLKSELEFEPRYPLFGGWKSTFLIGYGLPLQDFLFESPDGKRYLNFTYGCPLSDTVVDKLIIKVVLPEGSKDPAAVIPFQVDQHLETKYSYLDIVGRTVVVLEKKNVVPEHNIPFQVYYNFNPIFMLAEPLMLASVFFLLFAASVAYLHVDLSIRKSS

SEQ ID NO: 19642 - protein, 466 aa, Medicago truncatula
MEQPLLRIALLFLFLHFSILVNSFPSQHLQIINAERRIDLNSHIIKVYLTLKVENSGTTPASEVHLAFSPAEAEHLAVLKAAATTGKRKKKTYVPLDVKSAEIPDGPNGSKFFPVTLLTPLSKGETTTLEVLYILTHSLEPFPVEISQSESQLVYFRDSAILLSPYHVKQQTTFIKTPTARVESFTVVEPTKRAGTELKYGPYDEQTPYSYSPVLVHFENNNPFAVVEELEREIEISHWGSLQITERYKLVHAGARHKGVFSRVEYQTRSGASGVASFKHLLAKLPPRVHSVYYRDEIGNISSSHLRTDFLKSELEFEPRYPLFGGWKSTFLLGYGLPLQDFLFESPDGRRYLNFTYGCPLAQTVVDKLIIKVVLPEGSKDPAAVIPFQVDQHLETKYSYLDIVGRTVVVLEKRNVVPEHNIPFQVYYNFNPIFMLAEPLMLASVFFLLFAASVTYLHMDLSIRKS

SEQ ID NO: 19643 - protein, 467 aa, Trifolium pratense
MAMEPLLRIAVVFLFLYLSVLVNSSPAQHLQIINAERRIDLTSHIIKVYLTMKVENSGTSPTSEVRLAFSPAEAEHLAVVKAAITTGKRKKKTYVPLDVKSTGPPDGPNGSKFFSVTLLNPLGKGETTTLEVLYILTNSLEPFPVEISQSESQLVYFRDSAILLSPYHVKQQTTFIKTPSARVESFTVVEPTKRAGTELKYGPYDNHAPYSYSPVLVHFENNNPFAVVEELEREIEISHWGSIQVIERYRLTHAGARHKGVFSRVEYQTRSGASGVSSFKHLLAKLPPRVHSVYYRDEIGNISSSHLRKDFLKSELEFEPRYPLFGGWKSTFLIGYGLPLQDFLFESPDGKRYLNFTYGCPLSDTVVDKLIIKVVLPEGSKDPAAVIPFQVDQHLETKYSYLDIVGRTVVVLEKKNVVPEHNIPFQVYYNFNPIFMLAEPLMLASVFFLLFAASVAYLHVDLSIRKS

SEQ ID NO: 19644 - protein, 468 aa, Lupinus angustifolius
MEAAQRKPFFFFISLFHLFLFANSLSNFQDLHIINAERRIDLSSHIIKVYLTLKVENLGTSPASEVHLAFSPTEVEHLAIVKAAATSGKRKKKTYTPLGVKSADLPDGPNETKFFSIALLTPLSKGETITLEVLYQLTHSLEPFPVEISQSESQLVYFRDSAILLSPYHVKQQTTFIKTPSTRVESFTVVDPIKRSGTELKYGPYDNQLPYSYSPVLVHFENNNPFTVVEELEREIEVSHWGSVQVTERYRLVHGGARHKGVFSRVEYQTRQGGGAGASSFKHLLARLPAKVHSVYYRDQIGNISTSHLRTGFVKSELEFEPRYPLFGGWKSTFVIGYGVPLQDFLFESSDGRRYLNFTFGCPLLEAVVDKLTLKVVLPEGSKNATAVVPFQVEQRLETKHTYLDVVGRTVVVLEKRNAVPDHSIPFQVYYSFNPIFMLAEPLMLVFAFFLFFVASVAYLHIDLSIRK

SEQ ID NO: 19645 - protein, 518 aa, Flaveria ramosissima
MCRVEERDKKKKRRFAIGEMGLKTLGEIRVEKLKSSMANARSPRMKIWLIRATTTVLLWTCVVQLTALGGSWGPRVLKGWPSCFTQDSHSAAALDIKLLPSVPARVLPPKRVYKNNGYLVVSCNGGLNQMRSAICDMVAIARYLNVTLIVPELDKTSFWADPSEFEDIFDVDHFITSLRDEVRILKQLPPRLKKRVELGIVHTMPPVSWSDISYYHNQILPLIQKYKVVHLNRTDARLANNGQPLELQKLRCRVNFSALRFTTQIEELGRRVVKLLRQNGPFLVLHLRYEMDMLAFSGCTQGCNDEEVEELTRMRYAYPWWKEKIINSDLKRKDGLCPLTPEETALTLKALDIDRDIQIYIAAGEIYGGKRRMDSLADAYPKLVRKETLLGPADLQYFQNHSSQMAALDYLVSLESDIFVPTYDGNMAKVVEGHRRFLGFKKTILLDRRVLVELIDKYTSGVLSWDEFSSAVKDTHAQRMGAPTKRLVIADRPKEEDYFYANPEECLQPSDDEPVSIL

SEQ ID NO: 19646 - protein, 518 aa, Flaveria ramosissima
MCRVDDRGKKRRRFAIGTMGLEKLGEIRVEKLKNSVANVRSPKMMMVLIRATTMVLLWTCFVQLTAFGGDWGPRVLKGWPSCFTQDSHAAAVLDDKLLPNAPARVLPPKRVYKNNGYLVVSCNGGLNQMRSAICDMVAIARYLNVTLIVPELDKTSFWADPSDFEDIFDVDHFITSLRDEVRILKQLPPRLKRRVELGIVHTMPPVSWSDISYYHNQILPLIQKYKVVHLNRTDARLANNGQPLELQKLRCRVNFNALRFTHQIEELGRRVVQLLRQNGPFLVLHLRYEMDMLAFSGCTQGCNAEEVEELTRMRYAYPWWKEKIINSDLKRKDGLCPLTPEETALTLKALDIDRDIQIYIAAGEIYGGKRRMDSLAEAYPKLVRKETLLGADDLQYFQNHSSQMAALDYLVSLESDIFVPTYDGNMAKVVEGHRRFLGFKKTILLDRRVLTELIDKYTSGSLSWDEFSSAVKDTHAQRMGNPSKRTVIPDRPKEEDYFYANPEECLQPSADDEPVNIL

SEQ ID NO: 19647 - protein, 521 aa, Cichorium intybus
MYDREMCRVEDRDKKKSKRFSIGTMGLKTLGVSRVEKLKIMANTRSPRMKLWLIRATTTVLLWTCFIQLTALGGSWGPRVLKGWPSCFTQDSHSATALDIKLLPSVPARVLPPKRVYKNNGYLMVSCNGGLNQMRSAICDMVAIARYLNVTLIVPELDKTSFWSDPSEFEDIFDVDHFITSLRDEVRVLKQLPPRLKKRVELGIVHTMPPVSWSDISYYHNQILPLIQKYKVVHLNRTDARLANNGQPLDLQKLRCRVNFGALRFTTQIEELGKRVVNLLRKNGPFLVLHLRYEMDMLAFSGCTQGCNTEEIEELTRMRYAYPWWKEKIINSDLKRKDGLCPLTPEETALTLQALDIDRDIQIYIAAGEIYGGKRRMDSLQNAYPKLVRKETLLGPNDLQYFQNHSSQMAALDYLVSLESDIFVPTYDGNMAKVVEGHRRFLGFKKTILLDRRLLVDLIDKYTSGVLNWDQFSISVKEVHQERMGNPTKRLVIPDRPKEEDYFYANPEECLQPSDDETFVD

SEQ ID NO: 19648 - protein, 496 aa, Helianthus annuus
MGLKKFGEIRVEKLKNSMVNVRSTKMKMWLIRATTMVLLWTCLVQLTALGGGSWGPRVLKGWPSCFTQDSALDVKLLPTVPVRVLPHKRVYKNNGYLVVSCNGGLNQMRSAICDMVAIARDLNVTLIVPELDKTSFWADPSEFEDIFDVDHFITSLRDEVRILKELPPRLKQRVELGIVHTMPPVSWSDISYYHNQILPLIKKYKVVHLNRTDARLANNGQPLELQKLRCRVNFDALRFTPQIEELGRRVVKLLRQNGPFLVLHLRYEMDMLAFSGCTQGCNDEEIEELTRMRYAYPWWKEKIINSDLKRKDGLCPLTPEETALTLKALDIDRDIQIYIAAGEIYGGKRRMDSLADAYPRLVRKETLLGPADLQYFQNHSSQMAALDYLVSLESDIFVPTYDGNMAKVVEGHRRFLGFKKTILLDRKILVDLIDKYTSGVLSWDEFSGAVKDTHAQRMGAPTKRLVMPDRPKEEDYFYANPEECLQPSDDEPLSIL

SEQ ID NO: 19649 - protein, 520 aa, Ambrosia trifida
MCKVEERDNNDNNNNMKKKKKRFVIGKIRVEKLKSCNIMNGRSCKMKMWLVRATTMVLFWTCLVQLTALGGGSWGPRVLKGWPSCFTQDPHTASALDIKLLPSVPARVLPHKRVYKNNGYLVVSCNGGLNQMRSAICDMVAIARYLNVTLIVPELDKTSFWADPSEFEDIFDVDHFITSLRDEVRILKQLPPRLKKRVELGIVHTMPPVSWSDISYYHNQILPLIQKYKVVHLNRTDARLANNGQPLELQKLRCRVNFNALRFTTQIEELGRRVVKLLRQNGPFLVLHLRYEMDMLAFSGCTQGCNDEEIEELTRMRYAYPWWKEKIINSDLKRKDGLCPLTPEETALTLKALDIDRDIQIYIAAGEIYGGQRRMDSLADAYPRLVRKETLLGPADLQYFQNHSSQMAALDYLVSLESDIFVPTYDGNMAKVVEGHRRFLGFKKTILLDRKILVDLIDRYTSGALSWDEFSDAVKETHAQRMGAPTKRLVMLDRPKEEDYFYANPEECLQPSDDEPVSIL

SEQ ID NO: 19650 - protein, 514 aa, Artemisia annua
MCRLEDKNRNKIKARFVIGTMGLKKRLSEIRVDKFRNSMRSSSKMKMWLIRATTTVLLWTCVVQLTALGGTWGPRVLKGWPSCFSVDDHVAKSLDIAVPAKVLPPKRVYKNNGYLVVSCNGGLNQMRSAICDMVAIARYLNVTLIVPELDKTSFWADPSEFQDIFDVDHFITSLRDEVRVLKQLPPRLKTRVELGHVHTMPPVSWSDISYYHNQILPLIQKFKVVHLNRTDARLANNFQPLELQKLRCRANFDALRFTPQIEDLGKRVVRLLRQNGPFLVLHLRYEMDMLAFSGCTQGCNTEEVEELTRMRYAYPWWKEKIINSELKRKDGLCPLTPEETALTLKALDIDRDIQIYIAAGEIYGGKRRMDSLAEAFPKLVRKETLLGPDDLQYFQNHSSQMAALDYLVSLESDIFVPTYDGNMAKVVEGHRRFLGFKKTILLDRRLLVELIDKYTSGSLNWDEFSSGVKEAHAQRMGNPTKRLVIPDRPKEEDYFYANPEECLQPSDDEPLSIM

SEQ ID NO: 19651 - protein, 511 aa, Lactuca sativa
MGLKSLGVCRVEKLKSSMVNARSPRMKLWLIRATTTVLLWTCFVQLTALGGTWGPRVLKGWPSCFTQDSHSASALDLKLLPTVPARVLPPKIMNLTFSFYVGVYKNNGYLVVSCNGGLNQMRSAICDMVAIARYLNVTLIVPELDKTSFWSDPSEFEDIFDVDHFITSLRDEVRILKELPPRLKKRVELGIVHTMPPVSWSDISYYHNQILPLIQKYKVVHLNRTDARLANNNQPLELQKLRCRVNFGALRFTTQIEELGKRVVNLLRKNGPFLVLHLRYEMDMLAFSGCTQGCNNEEIEELTRMRYAYPWWKEKIINSDLKRKDGLCPLTPEETALTLRALDIDHDIQIYIAAGEIYGGKRRMDSLQDAFPKLVRKETLLGADDLQYFQNHSSQMAALDYLVALESDIFVPTYDGNMAKVVEGHRRFLGFKKTILLDRRVLVDLIDKYTNGILNWDEFSISVKQVHQERMGNPTKRLVISDKPKEEDYFYANPEECLHLQTSDDQTVSIL

SEQ ID NO: 19652 - protein, 514 aa, Vitis vinifera
MCRLERSEKKGVVIGMGLKALSASRVEKLKSSMVTSRSRMKLWMIRATTSVLLWTCIVQLTALGDMWGPRVLKGWPSCFTQDSSAAASALDDKLGWSAPPRVLPPKRVYKNNGYLMVSCNGGLNQMRAAICDMVAIARYLNVTLIVPELDKTSFWADPSEFEDIFDVDHFITSLRDEVRVLKELPPRLKKRVEQGVFYSMPPISWSDISYYRNQILPLIQKYKVVHLNRTDARLANNGQPLEIQKLRCRVNFSALRFTSQIEELGRRVIRLLRQNGPFLVLHLRYEMDMLAFSGCTQGCNEDEVEELTRMRYAYPWWKEKIINSDLKRKDGLCPLTPEETALTLRALDIDRNIQIYIAAGEIYGGERRMATLAAAYPKLVRKETLLESSDLRFFQNHSSQMAALDYLVSLESDIFVPTYDGNMAKVVEGHRRFLGFKKTILLDRRLLVDLIDQYTKGSLSWDEFSSAVKESHGDRMGNPIKRLVIPDRPKEEDYFYANPQECLQPLNEPLSSSS

SEQ ID NO: 19653 - protein, 511 aa, Valeriana officinalis
MCKVEREKSEETKISWGMGLKTLGEGRVEKLKTSMVSRSRMKLWMIRAMTTILLWTCLVQLMALGESWGPRVLKGWPSCFSQDSLAMDIKLPPPLPVRVLPPKRVYKNNGYLMVSCNGGLNQMRAAICDMVAIARQLNVTLIVPELDKTSFWADPSEFKDIFDVDHFITSLRDEVRVLKELPPRLKRRVELGRVYTMAPISWSDISYYQNQILPLIQKYKIVHLNRTDARLANNGQLLEIQKLRCRVNFSALKFTTQIEELGKRVIKLLRRNGPFLVLHLRYEMDMLAFSGCTQGCNSEEVEDLTRLRYAYPWWKEKIINSDLKRKDGLCPLTPEETALTLRALDIDSNIQIYIAAGEIYGGERRMASLAAAYPKLVRKETLLEPSDLQYFQNHSSQMAALDYLVSLESDIFVPTYDGNMAKVVEGHRRYLGFKKTILLDRKLLVDLIDQYTNGSLNWPEFSSAVKEIHEERMGNPTRRVVIPDRPKEEDYFYANPEECLQPSDETLSSML

SEQ ID NO: 19654 - protein, 392 aa, Flaveria ramosissima
MMAVGASALQITAARPSVFLTQRSLGATMASFVHESERSLSSKLTSSSHMSSVLNFKHKFTTSRPRFQKFVTRSMSEASGSKSVSQLSIDLKGKRAFIAGVADDNGYGWAIAKSLAAAGAEILVGTWVPALNIFEMSLRRGKFDESRVLPDGSLMEITKVYPLDAVFDSPEDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSFANAPLQKELAAEEVGNTAAFLASPLASAITGALIYVDNGLNAMGVGVDSPLFKDLNVPSDKH

SEQ ID NO: 19655 - protein, 392 aa, Ambrosia trifida
MMAIGASALQITAARPSVFLTQRSLGATMASFVHESDRILSSKLTSSSHLSSVLNFKHKSTTRYPRFRKFVTKSMSEASGSKSGSQLSIDLKGKRAFIAGVADDNGYGWAIAKSLAAAGAEILVGTWVPALNIFEMSLRRGKFDESRVLPDGSLMEITKVYPLDAVFDNPEDVPEDIKANKRYAGASKWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTKVLAFEAGRKHKIRVNTISAGPLGSRAAKAIGFIDTMIDYSFANAPLQKELSADEVGNTAAFLASPLASAITGALIYVDNGLNAMGVGVDSPLFKDLNIPTDKH

SEQ ID NO: 19656 - protein, 391 aa, Echinacea purpurea
MMAIGASALQITAARPPVFLTQRSLGATMASFVHESDRILSSKLTSPSHLSSVLKYKHECTSRPRFQKFVTRSMSEAAGSKSVSQLSIDLRGKRAFIAGVADANGYGWAIAKSLAAAGAEILVGTWVPALNIFEMSLRRGKFDDSRVLPDGSLMEIAKVYPLDAVFDNPEDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSFANAPLQKELSADEVGNTAAFLASPLASAITGALIYVDNGLNAMGVGVDSPLFKDLNVPTDKH

SEQ ID NO: 19657 - protein, 392 aa, Flaveria ramosissima
MISVGASALQITAARPSVFLTQRSLGATMASFVHESERSLSSRLTGSSPLSSVLNFKHKFTRSRPRLQRFVTSSMSEASGSKSASQLSIDLRGKRAFIAGVADDNGYGWAIAKSLAAAGAEILVGTWVPALNIFEMSLRRGKFDESRVLPDGSLMEITKVYPLDAVFDCPEDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSFANAPLQKELAAEEVGNTAAFLASPLASAITGALIYVDNGLNAMGVGVDSPLFKDLNVPTDKH

SEQ ID NO: 19658 - protein, 392 aa, Cirsium arvense
MMAIGASALQITAARPSIFLTQRSLGVTMASVVHESDRTLSSKLTSSSHMSYVLKFKKSFTTSRPRFEKFVTRSMSEASESKSSSQLSIDLKGKRAFIAGVADDNGYGWAIAKSLAAAGAEILVGTWVPALNIFEMSLRRGKFDGSRVLPDGSLMEITKVYPLDAVFDNPEDVPEDIKANKRYAGSSNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKRKIRVNTISAGPLGSRAAKAIGFIDTMIDYSFANSPLQKTLSADEVGNTAAFLASPLASAITGALIYVDNGLNAMGVGVDSPLFKDLDIPTDKH

SEQ ID NO: 19659 - protein, 392 aa, Artemisia annua
MMAIGASALQITAARPSMFLTQRSLGVTMASFVNETDRILSSKLTSSSHLSSVLNVKRSFTTSRPKYEKFVTKSMSEASESKPVSQLSIDLKGKRAFIAGVADDNGYGWAIAKSLAAAGAEILVGTWVPALNIFEMSLRRGKFDGSRVLPDGSLMEITKVYPLDAVFDNPDDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKKKIRVNTISAGPLGSRAAKAIGFIDTMIDYSYANAPIQKELFADEVGNTAAFLASPLASAITGALIYVDNGLNAMGVGVDSPLFKDLNIPTDKH

SEQ ID NO: 19660 - protein, 392 aa, Chrysanthemum coronarium
MMAIGASALQITAARPSMFLTQRSLGVTMASFVNETDRILSSKLTSSSHVSSVLNGKRSFTTSRPKFEKFVTKSMSEASESKPVSQLSIDLKGKRAFIAGVADDNGYGWAIAKSLAAAGAEILVGTWVPALNIFEMSLRRGKFDASRVLPDGSLMEITKVYPLDAVFDNPDDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKKKIRVNTISAGPLGSRAAKAIGFIDTMINYSYANAPLQKELFADEVGNTAAFLASPLASAITGALIYVDNGLNAMGVGVDSPLFKDLNIPTDKH

SEQ ID NO: 19661 - protein, 392 aa, Chrysanthemum coronarium
MMAIGASALQITAARPSMFLTQRSLGVTMASFVNETDRILSSKLTSSSHVSSVLNVKRSFTTSRPKFEKFVTKSMSEASESKPVSQLSIDLKGKRAFIAGVADDNGYGWAIAKSLAAAGAEILVGTWVPALNIFEMSLRRGKFDGSRVLPDGSLMEITKVYPLDAVFDNPDDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKKKIRVNTISAGPLGSRAAKAIGFIDTMIDYSYANAPIQKELFADEVGNTAAFLASPLASAITGALIYVDNGLNAMGVGVDSPLFKDLNIPTDKH

SEQ ID NO: 19662 - protein, 392 aa, Flaveria ramosissima
MMAVGASALQITAARPSVFLTQRSLGATMASFVHESERSLSSKLTSSSHMSSVLNFKHKFTTSRPRFQSLLQGQCRKLLEASLLPSLSIDLKGKRAFIAGVADDNGYGWAIAKSLAAAGAEILVGTWVPALNIFEMSLRRGKFDESRVLPDGSLMEITKVYPLDAVFDSPEDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSFANAPLQKELSADEVGNTAAFLASPLASAITGALIYVDNGLNAMGVGIDSPLFKDLNVPTDKH

SEQ ID NO: 19663 - protein, 392 aa, Chrysanthemum coronarium
MMAIGASALQITAARPSMFLTQRSLGVAMASFVNESDRIFSSKLTSSSNVSSVLNVKRSFTTSRPKYEKFVTKSMSEASESKPVSQLSIDLKGKRAFIAGVADDNGYGWAIAKSLAAAGAEILVGTWVPALNIFEMSLRRGKFDGSRVLPDGSLMEITKVYPLDAVFDNPDDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKKKIRVNTISAGPLGSRAAKAIGFIDTMIDYSYANAPIQKELFADEVGNTAAFLASPLASAITGALIYVDNGLNAMGVGVDSPLFKDLNIPTDKH

SEQ ID NO: 19664 - protein, 392 aa, Chrysanthemum coronarium
MMAIGASAMPITAARPSMFLTQRSLRVTMASFVNATDRILSSKLTSSSHLSSVLNVKRSFTTSRPKFEKFVTKSMSEASESKPVSQLSIDLKGKRAFIAGVADDNGYGWAIAKSLAAAGAEILVGTWVPALNIFEMSLRRGKFDGSRVLPDGSLMEITKVYPLDAVFDNPDDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKKKIRVNTISAGPLGSRAAKAIGFIDTMIDYSYANAPLQKELFADEVGHTAAFLASPLASAITGALIYVDNGLNAMGVGVDSPLFKDLNIPTEKH

SEQ ID NO: 19665 - protein, 392 aa, Chrysanthemum coronarium
MMAIGASAMPITAARPSMFLTQRSLRVTMASFVNATDRILSSKLTSSSHMSSVLNVKRSFTTSRPKFEKFVTKSMSEASESKPVSQLSIDLKGKRAFIAGVADDNGYGWAIAKSLAAAGAEILVGTWVPALNIFEMSLRRGKFDGSRVLPDGSLMEITKVYPLDAVFDNPDDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKKKIRVNTISAGPLGSRAAKAIGFIDTMIDYSYANAPIQKELFADEVGNTAAFLASPLASAITGALIYVDNGLNAMGVGVDSPLFKDLNIPTDKH

SEQ ID NO: 19666 - protein, 392 aa, Cirsium arvense
MMSIGASVLHVTAARPSIFLTQRSLGVTMASVVHESDRTLSSKLTSSSHVSTVLKFKQNFTTSRPKFEKFVTRSMSEASESKSTSQLAIDLKGKRAFIAGVADDNGYGWAIAKSLAAAGAEILVGTWVPALNIFEMSLRRGKFDGSRVLPDGSLMEITKVYPLDAVFDNPEDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSYANSPIQKELSADEVGNTAAFLASPLASAITGALIYVDNGLNAMGVGVDSPLFKDLNIPTDKH

SEQ ID NO: 19667 - protein, 392 aa, Centaurea maculosa
MMSIGASVLHVTAARPSIFLTQRSLGVTMASVVHESDRTLSSKLTSSSHVSSVLKFKRSFTTSQPRFEKFVTRSMSEASESKPTSQLAIDLKGKRAFIAGVADDNGYGWAIAKSLAAAGAEILVGTWVPALNIFEMSLRRGKFDGSRVLPDGSLMEITKVYPLDAVFDNPEDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSYANSPIQKELSADEVGNTAAFLASPLASAITGALIYVDNGLNAMGVGVDSPLFKDLNIPSEKH

SEQ ID NO: 19668 - protein, 392 aa, Centaurea maculosa
MMSIGASVLHVTAARPSIFLTQRSLGVTMASVVHESDRAFSSKLTSSSHVSSVLKLKQSFTTSQPRFEKFVTRSMSEASESKSTSQLAIDLKGKRAFIAGVADDNGYGWAIAKSLAAAGAEILVGTWVPALNIFEMSLRRGKFDGSRVLPDGSLMEITKVYPLDAVFDNPEDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKRKIRVNTISAGPLGSRAAKAIGFIDTMIDYSYANSPIQKELSADEVGNTAAFLASPLASAITGALIYVDNGLNAMGVGVDSPLFKDLNIPTDKH

SEQ ID NO: 19669 - protein, 392 aa, Chrysanthemum coronarium
MMAIGASAMPITAARPSMFLTQRSLRVTMASFVNATDRILSSKLTSSSHMSSVLNVKRSFTTSRPKFEKFVTKSMSEASESKPVSQLSIDLKGKRAFIAGVADDNGYGWAIAKSLAAAGAEILVGTWVPALNIFEMSLRRGKFDGSRVLPDGSLMEITKVYPLDAVFDNPDDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKKKIRVNTISAGPLGSRAAKAIGFIDTMIDYSYANAPLQKELFADEVGHTAAFLASPLASAITGALIYVDNGLNAMGVGVDSPLFKDLNIPTEKH

SEQ ID NO: 19670 - protein, 392 aa, Chrysanthemum coronarium
MMAIGASALPITAAKPSMFLTQRSLGVTMTCFVNATDRILSSKLTSSSHLSSVLNVKRSFTTSRPKFEKFVTKSMSEASESKPVSQLSIDLKGKRAFIAGVADDNGYGWAIAKSLAAAGAEILVGTWVPALNIFEMSLRRGKFDGSRVLPDGSLMEITKVYPLDAVFDNPDDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKKKIRVNTISAGPLGSRAAKAIGFIDTMIDYSYANAPLQKELFADEVGHTAAFLASPLASAITGALIYVDNGLNAMGVAVDSPLFKDLNIPTEKH

SEQ ID NO: 19671 - protein, 392 aa, Lactuca sativa
MMAIGASALQITFTRPSVLLTQRNLGVTMASFVQESDRALSSKLTSSSHLSSMLNSNQSFTINRPRFRKFVTRSMSEASETKSTSQLSIDLKGKRAFIAGVADDNGYGWAIAKSLAAAGAEILVGTWVPALNIFEMSLRRGKFDASRVLPDGTLMEITKVYPLDAVFDNPEDVPEDIKANKRYAGASNWTVQEVAELVKKDFGSIDILVHSLANGPEVTKPLLETSRKGYLAAVSASSYSYVSLLKHFLPIMNPGGSSISLTYIASERIIPGYGGGMSSAKAALESDTKVLAFEAGRKHKIRVNTISAGPLGSRAAKAIGFIDTMISYSFANAPLQKELSADEVGNTAAFLASPLASAITGALIYVDNGLNAMGVGVDSPLFKDLNIPTSEH

SEQ ID NO: 19672 - protein, 392 aa, Conyza canadensis
MMAMGASALQITTVRPSVFLTQRSIGIKVASFVQESDRILSSSLTSSSHVSSVLKTRRRFTDSRTRFETFVTRAMSEVAESKSVSQLSINLKGKRAFIAGVADDNGYGWAIAKSLAAAGAEILVGTWVPALNIFEMSLRRGKFDESRVLPDGSLMEIAKVYPLDAVFDNPEDVPEDIKTNKRYAGASNWTVQECAETVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSFANAPLQKELSADEVGNTAAFLASPLASAITGALIYVDNGLNAMGVGVDSPLFTDLNIPKDKH

SEQ ID NO: 19673 - protein, 393 aa, Cichorium intybus
MMAIGASALQTTFTRPPIFLTQRTLGVTMATFIHESDRAFSSKLTSSSHVSSMSNFNQSFTTSRQRFQKFVTKSMSKEASESKSVSQLSIDLKGKRAFIAGVADDNGYGWAIAKSLAAAGAEILVGTWVPALNIFEMSLRRGKFDTSRVLPDGSLMEITKVYPLDAVFDNPEDVPEDIKANKRYAGASNWTVQEVAELVKKDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSYANAPLQKELFADEVGNTAAFLASPLASAITGALVYVDNGLNAMGVGVDSPLFKDLNIPKSEH

SEQ ID NO: 19674 - protein, 393 aa, Cichorium intybus
MMAIGASALQTTFTRPPVFLTQRSLGVTMATFIHESDRAFSSKLTSSSHVSSMSNFSQSFTTSRQRFQNFVTKSMSKEASESKSGSQLSIDLKGKRAFIAGVADDNGYGWAIAKSLAAAGAEILVGTWVPALNIFEMSLRRGKFDTSRVLPDGSLMEITKVYPLDAVFDNPEDVPEDIKANKRYAGASNWTVQEVAELVKKDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSYANAPLQKELFADEVGNTAAFLASPLASAITGALVYVDNGLNAMGVGVDSPLFKDLNIPKSEH

SEQ ID NO: 19675 - protein, 393 aa, Cichorium intybus
MMAIGASALQTTFTRPPIFLTQRTLGVTMATFIHESDRAFSSKLTSSSHVSSMSNFSQNFTTNRQRFQKFVTKSMSKEASESKSVSQLSIDLKGKRAFIAGVADDNGYGWAIAKSLAAAGAEILVGTWVPALNIFEMSLRRGKFDTSRVLPDGSLMEITKVYPLDAVFDNPEDVPEDIKANKRYAGASNWTVQEVAELVKKDFGSIDILVHSLANGPEVTKPLLETSRKGYLAAVSASSYSYVSLLKHFLPIMNPGGSSISLTYIASERIIPGYGGGMSSAKAALESDTRVLAFEAGRKLKIRVNTISAGPLGSRAAKAIGFIDTMIDYSYANAPLQKELFADEVGNTAAFLASPLASAITGALVYVDNGLNAMGVGVDSPLFKDLNIPKSEH

SEQ ID NO: 19676 - protein, 411 aa, Flaveria ramosissima
HTDPPLSVGASCCKIAYSKNDGSWCFCPANNCSEAVCFLTQRSLGATMASFVHESERSLSSKLTSSSHMSSVLNFKHKFTTTRPRFQKFVTRSMSEASGSKSASQLSIDLKGKRAFIAGVADDNGYGWAIAKSLAAAGAEILVGTWVPALNIFEMSLRRGKFDESRVLPDGSLMEITKVYPLDAVFDSPEDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSFANAPLQKELAAEEVGNTAAFLASPLASAITGALIYVDNGLNAMGVGVDSPLFKDLNVPTDKH

SEQ ID NO: 19677 - protein, 403 aa, Cichorium intybus
MNSRKIAFTKMMAIGASALQTTFTRPPIFLTQRSLGVTMATFIHESDRAFSSKLTSSSHVSSMSNFSQSFTTSRQRFQNFVTKSMSKEASESKSGSQLSIDLKGKRAFIAGVADDNGYGWAIAKSLAAAGAEILVGTWVPALNIFEMSLRRGKFDTSRVLPDGSLMEITKVYPLDAVFDNPEDVPEDIKANKRYAGASNWTVQEVAELVKKDFGSIDILVHSLANGPEVTKPLLETSRKGYLAAVSASSYSYVSLLKHFLPIMNPGGSSISLTYIASERIIPGYGGGMSSAKAALESDTRVLAFEAGRKLKIRVNTISAGPLGSRAAKAIGFIDTMIDYSYANAPLQKELFADEVGNTAAFLASPLASAITGALVYVDNGLNAMGVGVDSPLFKDLNIPKSEH

SEQ ID NO: 19678 - protein, 403 aa, Cichorium intybus
MNSRKIAFTKMMAIGASALQTTFTRPPIFLTQRSLGVTMATFIHESDRAFSSKLTSSSHVSSMSNFSQSFTTNRQRFQNFVTKSMSNEASESKSVSQLSIDLKGKRAFIAGVADDNGYGWAIAKSLAAAGAEILVGTWVPALNIFEMSLRRGKFDTSRVLPDGSLMEITKVYPLDAVFDNPEDVPEDIKANKRYAGASNWTVQEVAELVKKDFGSIDILVHSLANGPEVTKPLLETSRKGYLAAVSASSYSYVSLLKHFLPIMNPGGSSISLTYIASERIIPGYGGGMSSAKAALESDTRVLAFEAGRKLKIRVNTISAGPLGSRAAKAIGFIDTMIDYSYANAPLQKELFADEVGNTAAFLASPLASAITGALVYVDNGLNAMGVGVDSPLFKDLNIPKSEH

SEQ ID NO: 19679 - protein, 340 aa, Arnica chamissonis
VLNFKHKFTTSRPRFQKFVTRSMSEASGSKSVSQLSIDLKGKRAFIAGVADDNGYGWAIAKSLAAAGAEILVGTWVPALNIFEMSLRRGKFDESRVLPDGSLMEITKVYPLDAVFDNLEDVPEDIKANKRYAGASKWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSFANAPLQKELSADEVGNTAAFLASPLASAITGALIYVDNGLNAMGVGVDSPLFKDLNVPTDKH

SEQ ID NO: 19680 - protein, 389 aa, Echinacea purpurea
MATANLSAHIALAKPLTYASCEVSKTSVAVVSSGVKETSWMKLKSSWHISSRYVNATTSKNVKFSKLVTKAMSESNDIKPLPGLPVDLRGKRAFIAGIADDNGYGWAIAKSLAAAGAEILVGTWVPALNIFEMSLRRGKFDESRVLPDGSLMEIAKVYPLDAVFDNPEDVPEDIKANKRYAGASNWTVQEVAESVKQDFGSIDILVHSLANGPEVTKPLLETSRKGYLAAVSASSYSYVSLLKHFLPIMNPGGSSISLTYIASERIIPGYGGGMSSAKAALESDTRVLAFEAGRKHKIRVNTISAGPLGSRAAKAIGFIDTMIDYSFANAPLQKELSADEVGNTAAFLASPLASAITGALIYVDNGLNAMGVGVDSPLFKDLNVPTDKH

SEQ ID NO: 19681 - protein, 391 aa, Tabernaemontana elegans
MAVTAASSLQITAARPSFFSAQKMLGPAVSTVVAESNKAPWVKLSSGCHISSIQRFQRSFMSSPPKFDRVVTKAMSEAGEKQPSSGLSINLKGKRAFIAGVADDNGYGWAIAKSLAAAGAEILVGTWVPALNIFETSLRRGKFDESRVLPDGSLMEITKVYPLDAVFDSPEDVPEDIKTNKRYAGSSNWTVKEVAESVKQDFGTIDILVHSLANGPEVTKPLLETSRNGYLAAISASSYSYVSLLKHFIPIMNPGGSSISLTYIASERIIPGYGGGMSSAKAALESDTRVLAFEAGRKHKIRVNTISAGPLRSRAAKAIGFIDMMIDYSLANAPLQKELSADEVGNTAAFLASPLASAITGAVIYADNGLNAMGVGVDSPIFEKLDIPKDK

SEQ ID NO: 19682 - protein, 387 aa, Amsonia hubrichtii
MAVTAASSLQITAARPSIFSARKMLGAAVTNVGSESWVKLSSACHISSVQQFQRSIMSSPPKFDRVAPKAMSEAGEKQPSSGLSIDLKGKRAFIAGVADDNGYGWAIAKSLAAAGAEILVGTWVPALNIFETSLRRGKFDESRVLPDGSLMEITKVYPLDAVFDSPEDVPEDIKANKRYAGSSNWTVKEVAESIKQDFGTIDILVHSLANGPEVTKPLLETSRNGYLAAISASSYSYVSLLKHFVPIMNPGGSSISLTYIASERIIPGYGGGMSSAKAALESDTRVLAFEAGRKHKIRVNTISAGPLRSRAAKAIGFIDMMIDYSLANAPLQKELSADEVGNTAAFLASPLASAITGAVIYVDNGLNAMGVGVDSPIFEKLDIPKDK

SEQ ID NO: 19683 - protein, 392 aa, Theobroma cacao
MAATAASSLQIAAARPCISSPHRFVEAGVSILGANSKSVSWTKLTSACNISSLEPFRRSFTSSPAKFKKVVTKAMSESSEKKPVSGLAIDLKGKRAFIAGVADDNGYGWAIAKSLAAAGAEILVGTWVPALNIFETSLRRGKFDESRVLPDGSLMEITKVYPLDAVFDNLDAVPEDIKTNKRYAGSSNWTVQEVAESVKQDFGSIDILVHSLANGPEVSKPLLETSRNGYLAALSASSYSYVSLLKHFLPLMKPGGSSISLTYIASERIIPGYGGGMSSAKAALESDTRVLAFEAGRKNKIRVNTISAGPLRSRAAKAIGFIDTMIEYSMANAPLQKELSADEVGNTAAFLASPLASAITGAVIYVDNGLNAMGVGIDSPIFKDLNIPSDKH

SEQ ID NO: 19684 - protein, 392 aa, Vitis vinifera
MAATAVSGLQMATARSHISSSHRIFKAGAAVLGTNSKGRSWAKLASACHISYFHHFQHSFSSSPIRFDKVVTRAMSEASEKKPTSGLPIDLKGKRAFIAGVADDNGYGWAIAKSLAAAGAEILVGTWVPALNIFETSLRRGKFDESRVLPDGSLMEITKIYPLDAVYDTLEDVPEDVKANKRYAGSSNWTVQEVAESVKQDFGSIDILVHSLANGPEVTKPLLETSRKGYLAAISASSYSYVSLLKCFIPIMNPGGSSISLTYIASERIIPGYGGGMSSAKAALESDTRVLAFEAGRKHKIRVNTISAGPLRSRAAKAIGFIDTMIEYSLANAPLQKELSADEVGNTAAFLASPLASAITGAVIYVDNGLNAMGVGVDSPMFADLNIPKDKH

SEQ ID NO: 19685 - protein, 392 aa, Panax ginseng
MAGVAASGLQITAARPSIFFTHSIFKSAVANVLVKSNESSWVKLANSRHVSSVKHFQKNFKSNSARFKNFATKAKTEVSDNKPASVLPIDLRGKRAFIAGVADDNGYGWAIAKSLAAAGAEILVGTWVPALNIFEMSLRRGKFDESRVLPDGSLMDITKVYPLDAVFDNLEDVPEDIKANKRYAGSTKWTVQEVAESVKQDFGSIDVLVHSLANGPEVTKPLLETSRKGYLAAISASSYSYVSLLKHFLPIMNPGGSSISLTYIASERIIPGYGGGMSSAKAALESDTRVLAFEAGRKRKIRVNTISAGPLRSRAAKAIGFIDMMIDYSLENAPLQKELSADEVGNTAAFLASPLASAITGAVIYVDNGLNTMGVGVDSPLFKDLDIPKDKH

SEQ ID NO: 19686 - protein, 392 aa, Panax ginseng
MVGVAASGLQITAARPSIFFTHSIFKSAVANVLVKSNESSWVKLANSRHVSSVKHFQKNFKSNSARFKNFATKAKTEVSDNKPASVLPIDLRGKRAFIAGVADDNGYGWAIAKSLAAAGAEILVGTWVPALNIFEMSLRRGKFDESRVLPDGSLMDITKVYPLDAVFDNLEDVPEDIKANKRYAGSTKWTVQEVAESVKQDFGSIDVLVHSLANGPEVTKPLLETSRKGYLAAISASSYSYVSLLKHFLPIMNPGGSSISLTYIASERIIPGYGGGMSSAKAALESDTRVLAFEAGRKRKIRVNTISAGPLRSRAAKAIGFIDMMIDYSLENAPLQKELSADEVGNTAAFLASPLASAITGAVIYVDNGLNTMGVGVDSPLFKDLDIPKDKH

SEQ ID NO: 19687 - protein, 392 aa, Panax ginseng
MVGVAASGLQITAARPSIFFTHSIFKSAVVNVLVKSNESSWVKLANSRHVSSVKHFQKNFKSNSARFKNFATKAKTEVSDNKPASVLPIDLRGKRAFIAGVADDNGYGWAIAKSLAAAGAEILVGTWVPALNIFEMSLRRGKFDESRVLPDGSLMDITKVYPLDAVFDNLEDVPEDIKANKRYAGSTKWTVQEVAESVKQDFGSIDVLVHSLANGPEVTKPLLETSRKGYLAAISASSYSYVSLLKHFLPIMNPGGSSISLTYIASERIIPGYGGGMSSAKAALESDTRVLAFEAGRKCKIRVNTISAGPLRSRAAKAIGFIDMMIDYSLENAPLQKELSADEVGNTAAFLASPLASAITGAVIYVDNGLNTMGVGVDSPLFKDLDIPKDKH

SEQ ID NO: 19688 - protein, 391 aa, Citrullus lanatus
MAAAASNLQIATLRHCQLPSRKGFKPCGTILSGSSKVSSWAKLSSSSNISSALFFQRKFVSSSVKNEITVTKAMAEANDSKPVSGLSIDLKGKRAFIAGVADDNGYGWAIAKSLAAAGAEILVGTWVPALNIFESSLRRGKFDESRVLPDGSLMEITKVYPLDAVFDSPEDVPEDIKTNKRYAGSSNWTVKEVAESVKQDFGSIDILVHSLANGPEVTKPLLETSRNGYLAALSASSYSYISLLKHFIPIINPGGSSLSLTYIASERIIPGYGGGMSSAKAALESDTRVLAFEAGRKHKIRVNTISAGPLRSRAAKAIGFIDMMIDYSTANAPLQKELSAEEVGNAAAFLASPLASAITGAVIYVDNGLNAMGVGVDSPVFKDLDIPTDKH

SEQ ID NO: 19689 - protein, 393 aa, Euonymus alatus
MAATTASGLQMAAARPCISSSHRVSKASAATFGANSKGPSWANQLTSASHISSVQPFQWNSRSRSIKFNKFVTKAMSESTENKPASGLPIDLRGKRAFIAGVADDNGYGWAIAKSLAAAGAEILLGTWVPALNIFESSLRRGKFDESRVLPDGSLMEITKVYPLDAVFDSPEDVPEDVKSNKRYAGSSKWTVQEVAESVKQDFGSIDILVHSLANGPEVTKPLLETSRKGYLAAISASSYSYVSLLKHFAPIMNPGGSSISLTYIASERIIPGYGGGMSSAKAALESDTKVLAFEAGRKHRIRVNTISAGPLSSRAAKAIGFIDMMIDYSSANAPLQKELSADEVGNTAAFLASPLASAITGGVIYVDNGLNAMGVGVDSPIFKDLDIPTDKH

SEQ ID NO: 19690 - protein, 392 aa, Castanea mollissima
MATTAASSLQIATARPCISSSRRIFKAGAAIFGGNSKAVSWNKLTSACHISSVQPFQRSFTSSSVKFDKVVTKAMSETTENKPISGLPIDLRGKRAFIAGVADDNGYGWAIAKSLAAAGAEILLGTWVPALNIFESSLRRGKFDESRVLPDGSLMEITKVYPLDAVFDNLEDVPEDIKANKRYAGSSKWTVQEVAESVKNDFGSIDILVHSLANGPEVTKPLLETSRNGYLAAISASSYSYVSLLKHFIPIMNPGGSSISLTYIASERIIPGYGGGMSSAKAALESDTRVLAFEAGRKHKVRVNAISAGPLRSRAAKAIGFIDMMIDYSIVNAPLQKELSADEVGNTAAFLASPLASAITGAVIYVDNGLNAMGVGVDSPIFKDLDIPTDKH

SEQ ID NO: 19691 - protein, 757 aa, Echinacea purpurea
MTVGAGISVTDRKLNVFGNRVLTDVHDNVFVTSSTGDGMINGAFIGIRSDQTGSRMVFPVGKLEGLRFMCVFRFKLWWMTQRMGNCGQDIPTETQFLIVETSEGSNFGEDNEIDDGSHQSALYTVFLPILEGDFRAVIQGNSNNELEICLESGDPAVKDFEGSHLVFVAAGPDPFDVITNAVKSVERHLQTFSHRERKKMPDMLNWFGWCTWDAFYTDVTSEGVKQGLESFQKGGISPKFVIIDDGWQSVDMDPTSVEAKADNTANYANRLTHIKENHKFQKDGKEGHRVEDPSMGLRYVVTDIKDHHNVKYVYVWHALTGYWGGVRPGTEDYDSKLSFPISSPGILSIENCDAFIAIAKNGLGLVDPEKVFNFYNDLHSYLAFAGVDGVKVDVQNILETLGAGHGGRVKLTRKYHQALEASVARNFPDNGIISCMCHNTDGLYSAKRTAVMRASDDFWPRVTASHTVHVASVAYNTIFLGEFMQPDWDMFHSLHPMAEYHGAARAVGGCAIYVSDKPGHHDFNLLKKLVLPDGSILRAKLPGRPTRDCLFTDPTRDGKSLLKIWNLNNFTGVVGVFNCQGAGWCKDGKKILTHDEQPSTITGVIRAKDVNYLPKVADSKWDGDAVVYSHLGGRLVYLPKNASIPVTLKPREYEVFTVVPISKLSCGVTFAPIGLMEMFNSGGAISELRYETEKEGNVELKVRGSGVFGAYSSRKPSRVIIDSKETEFGYEERSGLISIKLSVPEKEMYLWDIIIQV

SEQ ID NO: 19692 - protein, 757 aa, Flaveria ramosissima
MTVGAGISVADRKLNVFGNAVLTDVSDNVCVTSSADDGMINGAFIGVRSEESGSRLVFPVGKLEGLRFMCVFRFKLWWMTQRMGNCGQDIPTETQFLIVETSQGSHFGEDNEIDDGSHQSALYTVFLPILEGDFRAVIQGNSNNELEICLESGDPAVKDFEGSHLVFVAAGPDPFDAITNAVKSVERHLQTFSHRERKKMPDMLNWFGWCTWDAFYTDVTSEGVKQGLESFQKGGISPKFVIIDDGWQSVGMDPTSIEAKADNTANYANRLTHIKENHKFQKDGKEGHRVEDPSMGLSHVVTDIKDHHNVKYVYVWHALTGYWGGVRPGTGDYDSKLSFPVSSPGINSNENCDALIAITKNGLGLVDPEKVFKFYDELHSYLASAGVDGVKVDVQNILETLGAGHGGRVKLARKYHQALEASVSRNFPDNGIISCMSHNTDGLYSAKKTAVIRASDDFWPRVTASHTVHIASVAYNTIFLGEFMQPDWDMFHSLHPMAEYHGAARAVGGCAIYVSDKPGHHDFNLLKKLVLPDGSILRAKLPGRPTRDCLFTDPTRDGKSLLKIWNLNNFSGVVGVFNCQGAGWCKDGKKILTHDEQPSTITGVIRAKDVNYLPKVADSTWDGDVVAYSHVGGGVVYLPKDASIPVTLKPREYEVFTVVPVSKLSCGVSFAPIGLTEMFNSGGAISELRFETQKQGKVELKVRGCGVFGAYSTRKPIRVTVDSKETEFGYEERSGFISIKLSVPEKEMYLWDIIIQV

SEQ ID NO: 19693 - protein, 761 aa, Chrysanthemum coronarium
MTIGAGISVTDDRNLNVFGTPVLTNVHENIVVTSSSDDGMINGAFIGVRSDQTGSRMVFPVGKLEGLRFMCVFKFKLWWMTQRMGTCGQDIPTETQFLIVETIDGSHFGEDVEVNDGCHQSALYTVFLPILEGNFRAVLQGNSNNELEIVLESGDPAVKDFEGSHLVFVAAGSDPFDAITNAVKSVERHLQTFAHREGKKMPDMLNWFGWCTWDAFYTEVTSEGVKQGLESFEKGEVSPKFVIIDDGWQSVGMDPTSFEAKADNTANFTNRLTHIKENHKFQKDGKEGHRVEDPAMGLRHVVTDIKDHHNLKYVYVWHAITGYWGGVRPGVAEMDHYNSKLSFPVSSPGAESNENCDALKAIIKNGLGLVDPEKVLNFYNELHSYLASAGIDGVKVDVQNILETLGAGHGGRVKLTRKYHQALEASISRNFHDNGIISCMSHNTDGLYSTKRTAVIRASDDFWPHVTPSHTVHIASVAYNTIFLGEFMQPDWDMFHSLHPMAEYHAAARAVGGCAIYVSDKPGHHDFNLLKKLVLPDGSILRAKLPGRPTRDCLFTDPSRDGKSLLKIWNLNSFTGVVGVFNCQGAGWCKDGKTILTHDEQPPTITGFIRAKDVNYLPKVADSTWGGDAIVYSHIGGELVYLPKNASIPVTLKSREYEVFTVVPAKKLSGGVTFAPIGLTKMFNSGGAIVELNYEMEKQGNVELKVRGCGTFGSYSSKRPIRVIIDSKETVFGYEEGTGLISIELSVPEIEMYVWDIIIEV

SEQ ID NO: 19694 - protein, 760 aa, Chrysanthemum coronarium
MTIGAGISVTDDRNLNVFGTPVLTNVHDNIVVTSSSDDGMINGAFIGVRSDQTGSRMVFPVGKLEGLRFMCVFKFKLWWMTQRMGTCGQDIPTETQFLIVEAREGSHLGEDNEVEDGCHQSALYTIFLPILEGDFRAVLQGNSNNELEIVLESGDPDVKIFKGSHLVFVAAGSDPFDTITNAVKSLERHLQTFAHRESKKMPDMLNWFGWCTWDAFYTEVSSEGVKQGLESFKKGGVSPKFVIIDDGWQSVGMDPNSFEAKADNTANYTSRLTHIKENHKFQKDGKEGHRVEDPAMGLRHVVRDIKDHYNLKYVYVWHALTGYWGGVRPGVAEMDHYNSKLSFPVSSPGAEYENCDAVKAITKNGLGLVNPEKVFNFYNELHSYLASAGIDGVKVDAQNILETLGAGHGGRVKLTRKYHQALEASISRNFHDNGIISCMSHNTDGLYSIKRTAVIRASDDFWPHVTPSHTVHIASVAYNTIFLGEFMQPDWDMFHSLHPMAEYHGAARAVGGCAIYVSDKPGHHDFNLLKKLVLPDGSTLRAKLPGRPTRDCLFTDPTSDGKSLLKIWNLNNFTGVVGVFNCQGAGWCKDGKTILTHDEQPPTITGFIQAKDVNYLPKVADSTWSGDAVVYSHIGGELVYLQKDASIPVTLKSREYEVFTVVPVKKLSSGVSFAPIGLTEMFNSGGAIVELNYDVEKQGTVELKARGCGTFGAYSSKRPVRVTIDSKETGFRYEEGTGLISIELSVPEKEMYLWDVIIEV

SEQ ID NO: 19695 - protein, 761 aa, Chrysanthemum coronarium
MTIGAGISVTDDRNLNVFGTPVLTNVHENIVVTSSSDDGMINGAFIGVRSDQTGSRMVFPVGKLEGLRFMCVFKFKLWWMTQRMGTCGQDIPTQTQFLIVETREGSHLGEDNEVEDGCHQSALYTVFLPILEGDFRAVLQGNSNNELEIVLESGDPDVKDLEGSHLVFVAAGSDPFDTITNAVKSLERHLQTFAHRESKKMPDLLNWFGWCTWDAFYTEVTSEGVKQGLESFKKGGVSPKFVIIDDGWQSVGMDPNSFEAKADNTANYTSRLTHIKENHKFQKDGKEGHRVEDPAMGLRHVVTDIKDHYNLKYVYVWHALTGYWGGVRPGVAEMDHYNSKLSFPVSSQGAEYNENCDAVKAITKNGLGLVDPEKVFNFYNELHSYLASAGIDGVKVDAQNILETLGAGHGGRVKLTRKYHQALEASISRNFHDNGIISCMSHNTDGLYSIKRTAVIRASDDFWPHVTPSHTVHIASVAYNTVFLGEFMQPDWDMFHSLHPMAEYHGAARAVGGCAIYVSDKPGNHDFNLLKKLVLPDGSTLRAKLPGRPTRDCLFTDPTSDGKSLLKIWNLNNFTGVVGVFNCQGAGWCKDGKTILTHDEQPPTITGFIQAKDVNYLPKVADSTWSGDAVVYSHIGGELVYLQKDASIPVTLKSREYEVFTVVPVKKLSSGVSFAPIGLTEMFNSGGAIVELNYDVEKQGTVELKARGCGTFGAYASKRPVRVTIDSKETGFRYEEGTGLISIELSVPEKEMYLWDITIEV

SEQ ID NO: 19696 - protein, 715 aa, Chrysanthemum coronarium
GVRSDQTGSRMVFPVGKLEGLRFMCVFKFKLWWMTQRMGTCGQDIPTQTQFLIVETREGSHLGEDNEVEDGCHQSALYTVFLPILEGDFRAVLQGNSNNELEIVLESGDPDVKDFEGSHLVFVAAGSDPFDAITNAVKSVERHLQTFAHRESKKMPDMLNWFGWCTWDAFYTEVSSEGVKQGLESFKKGGVSPKFVIIDDGWQSVGMDPNSFEAKADNTANYTSRLTHIKENHKFQKDGKEGHRVEDPAMGLRHVVRDIKDHYNLKYVYVWHALTGYWGGVRPGVAEMDHYNSKLSFPVSSPGAEYYENCDAVKAITKNGLGLVDPEKVFNFYNELHSYLASAGIDGVKVDAQNILETLGAGHGGRVKLTRKYHQALEASISRNFHDNGIISCMSHNTDGLYSIKRTAVIRASDDFWPHVTPSHTVHIASVAYNTIFLGEFMQPDWDMFHSLHPMAEYHGAARAVGGCAIYVSDKPGHHDFNLLKKLVLPDGSTLRAKLPGRPTRDCLFTDPTSDGKSLLKIWNLNNFTGVVGVFNCQGAGWCKDGKTILTHDEQPPTITGFIRAKDVNYLPKVADSTWSGDAVVYGHIGGELVYLQKNVSIPVTLKSREYEVFTVVPVKKLSSGVSFAPIGLTEMFNSGGAIVELNYDVEKQGTVELKARGCGTFGAYSSKRPVRVTIDSKETGFRYEEGTGLISIELSVPEKEMYLWDIIIEV

SEQ ID NO: 19697 - protein, 702 aa, Chrysanthemum coronarium
MTVGAGISVTDQKLNVFGTPVLTNVHDNVVVTTSSDDGMINGAFLGVRSDQTASIRMVFPVGKLEGLRFMCVFRFKLWWMTQRMGTFGQDIPTETQFLIVETIGGSDFGEDDGCHQSALYTVFLPILEGDFRAVLQGNSNNELEIVLESGDPAVKDFEGSHLVFVAAGSDPFDAITNAVKSVERHLQTFAHRERKKMPDMLNWFGWCTWDAFYTEVTSEGVKQGLESFEKGGVSPKFVIIDDGWQSVGMDPTSFEAKADNTANFTNRLTHIKENHKFQKDGKEGHRMEDPAMGLRHVVTDIKDRHNLKYVYVWHAITGYWGGVRPGVPEMDHYNSKLSFPVSSPGAESNEICDALKAMTKNGLGLVDPEKVFNFYNELHSYLASAGVDGVKVDVQNILETLGAGHGGRVKLTRKYHQALEASISRNFHDNGIISCMSHNTDGLYSTKKTAVIRASDDFWPHVTPSHTVHIASVAYNTIFLGEFMQPDWDMFHSLHPMAEYHAAARAVGGCAIYVSDKPGHHDFNLLKKLVLPDGSILRAKLPGRPTRDCLFTDPSRDGKSLLKIWNLNSFTGVVGVFNCQGAGWCKDGKMTLTHDEQPPTITGFIGAKDVNYLPKVADSTWGGDAIVYSHICGELVYLPKNASIPVTLKSREYEVFTVVPAKRLSGGVSFAPIGLTKMFNSGGAIVKLNYEMEKQGNVELKV

SEQ ID NO: 19698 - protein, 772 aa, Solanum phureja
MAASSDTVTPSSLRLAFGNVFSLFILILIGVLAFSIRIFSVIKYESVIHEFDPYFNYRVTQFLTKNGIYDFWNWFDDRTWYPLGRVIGGTVYPGLTLTAGTLWWILNSLNIPLSVETVCVFTAPTFSAFAAWATYLLTKEVKGAGAGLTAAALLAMVPSYISRSVAGSYDNEAVAIFALIFTFYLYIKTLNTGSLFYATLNALSYFYMVCSWGGYTFIINLIPMHALLCIVTGRYSSRLYIAYAPLVILGTLLAALVPVVGFNAVMTSEHFASFLVFLILNVVGLVYYIKGMLTPKMFKVAVTLVVSAGLIVCCAMVAVLVALVASSPTKGWSGRSLSLLDPTYASKYIPIIASVSEHQPPTWPSYFMDINVLAFLVPAGIIACFLPLTDASSFVILYLVTSVYFSGVMVRLMLVLAPAACIMSGIALSSAFGVFTRSIKFASIGKQADAGDNVDGVTQNDVVKPDRNEELPKEKTSRKKKKEKENVEKAPIATKKSEKRLLMLPMEASVVAILLLILLGAFYVVHCVWAAAEAYSAPSIVLTSQSHDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSMATPTMLNSLMYKLSYYRFVETDGKGYDRVRRTEIGKKHFKLTHFEEVFTTHHWMVRLYKLKPPKNRIRGKTKKSKSKATSTSSKRSATQKKNPWQ

SEQ ID NO: 19699 - protein, 772 aa, Nicotiana benthamiana
MAASSDTVVTPSSLRQAFGNVFSLFILILIGVLAFSIRLFSVIKYESVIHEFDPYFNYRVTQFLTKNGIYDFWNWFDDRTWYPLGRVIGGTVYPGLTLTAGTLWWILNSLNIPLSVETVCVFTAPTFSAFAAWATYLLTKEVKGPGAGLTAAALLAMVPSYISRSVAGSYDNEAVAIFALIFTFYLYIKTLNTGSLFYATLNALAYFYMVCSWGGYTFIINLIPMHALLCIVTGRYSSRLYIAYAPLVILGTLLAALVPVVGFNAVMTSEHFASFLVFIILNVVGLVYYIKGILTPKMFKVAVTLVISAGLIVCCAVVAVLIALVASSPTKGWSGRSLSLLDPTYASKYIPIIASVSEHQPPTWPSYFMDINVLAFLVPAGIIACFLPLTDASSFVILYLVTSVYFSGVMVRLMLVLAPAACIMSGIALSSAFGVFTQSIKFASIGKQVDAGDTGNGVTQNDVVKPDKTEEAPKEKASRKKKKEKENVEKTPIVAKSERRLLMLPMEASVVAILLLMLLGAFYVVHCVWAAAEAYSAPSIVLTSHSHDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSMATPTMLNCLMYKLSYYRFVETDGKGFDRVRRTEIGKKHFKLTHFDEVFTTHHWMVRIYKLKPPKNRIRGKTKKSKSKSNSASSKRSATRKKNPWH

SEQ ID NO: 19700 - protein, 771 aa, Nicotiana benthamiana
MAASSDTVTPSSLRQAFGNVFSLFILILIGVLAFSIRLFSVIKYESVIHEFDPYFNYRVTQFLTKNGIYDFWNWFDDRTWYPLGRVIGGTVYPGLTLTAGTLWWILNSLNIPLSVETVCVFTAPTFSAFAAWATYLLTKEVKGPGAGLTAAALLAMVPSYISRSVAGSYDNEAVAIFALIFTFYLYIKTLNTGSLFYATLNALAYFYMVCSWGGYTFIINLIPMHALLCIVTGRYSSRLYIAYAPLVILGTLLAALVPVVGFNAVMTSEHFASFLVFIILNVVGLVYYIKGILTPKMFKVAVTLVISAGLVVCCAVVTVLIALVASSPTKGWSGRSLSLLDPTYASKYIPIIASVSEHQPPTWPSYFMDINVLAFLVPAGIIACFLPLTDASSFVILYLVTSVYFSGVMVRLMLVLAPAACIVSGIALSSAFGVFTRSIKFASIGKQVYAGDTSNGVTQNDVVKPDKTEEPPKEKASRKKKKEKENVEKTPIVAKSERRLLMLPMEASVVAILLLMLLGAFYVVHCVWAAAEAYSAPSIVLTSHSHDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPQIKEPDYLRDGQYRIDSMATPTMLNCLMYKLSYYRFVETDGKGFDRVRRTEIGKKHFKLTHFDEVFTTHHWMVRIYKLKPPKNRIRGKTKKSKSKSNSASSKRSPTRKKNPWH

SEQ ID NO: 19701 - protein, 774 aa, Sesamum indicum
MAAPETPQPDTLRHAFGNVLSFFVLLLIGVLAFSIRLFSVIKYESVIHEFDPYFNYRVTQYLTKSGVYDFWNWFDDRTWYPLGRVIGGTVYPGLTLTAGTLWRILNFLNIPLSVETVCVFTAPIFSAFASWATYLLTKEVKGAGAGLTAAALLAMVPSYISRSVAGSYDNEAVAIFALIFTFYLYIKTLNTGSLFYATLNAIAYFYMVCSWGGYTFIINLIPMHVLLCIVTGRYSSRLYIAYAPLVVLGTLLASLVPVVGFNAVMTSEHFASFLVFIIIHVVALVYYIKGILTPQMFKVAVTLVVSVGLIVCGAVLAVLIALVASSPTKGWSGRSLSLLDPTYASKYIPIIASVSEHQPPTWPSYFMDINVLAFLVPAGIIACFLPLSDASSFAVLYIVTSVYFSGVMVRLMLVLAPAACIMSGIALSEAFDVFTRSIKFQLFGATKDPQVNAGDTNVTQNEVVKPEKSEDSLKERSSRKSKKKEKENVETVPLVSRIEKKLLVLPLEASLIAIFLLVLLGAFYVVHCVWAAAEAYSAPSIVLTSRSHDGLHVFDDFREAYAWLRHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNCLMYKLSYYRFVETDGRGFDRVRHTEIGKKYFKLTHFEEVFTTHHWMVRIYKLKSPRNRVRGKTKKSKSKSTSTSISRRSGARKKNPWH

SEQ ID NO: 19702 - protein, 783 aa, Panax ginseng
MAALENAKDSALRYAFGNVLSFFILLLIGVLAFSIRLFSVIKYESVIHEFDPYFNYRVTQFLTKNGIYDFWNWFDDRTWYPLGRVIGGTVYPGLTLTAGTLWWILNSLNIPLSVETVCVFTAPIFSANAAWATFLLTKEVKGTGAGLTAAALLAMVPSYISRSVAGSYDNEAVAIFALIFTFYLYIKTLNTGSLFYATLNAIAYFYMVCSWGGYTFIINLIPMHALLCIVTGRYSSRLYIAYAPLVVLGTLLAALVPVVGFNAVLTSEHFASFLVFIIIHVVALAYYIKGILSPKMFKVAVTLVVSVGLVVCCAVIAVLVALVASSPTKGWSGRSLSLLDPTYASKYIPIIASVSEHQPPTWPSYFMDINVLAFLVPAGIIACFLPLSDASSFVVLYIVTSVYFSGVMVRLMLVLAPAACIMSGIALSEAFSVFTRSIKFQLPGVSQTHQIDTGDLGSGDDAIQKDVVKTDKSDEPAKERSSKRNKKKEKENVEKASKPSIKSKIEKRLLVLPLESSIIALLLLVLLGAFYVVHCVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNCLMYKLSYFRFVDTDGGKGYDRVRQTEIGKKYFKLTHFEEVFTTHHWMVRIYKLKPPRNRIRSKTKKTKSKTSGSTTSSKRSGAIKKNPWQ

SEQ ID NO: 19703 - protein, 778 aa, Vitis vinifera
MAASEDSNQSKIRAVFGSVLSFFILILIGVLAFSIRLFSVIKYESVIHEFDPYFNYRVTQFLTKNGIYDFWNWFDDRTWYPLGRVIGGTVYPGLTLTAGSIWWLLNSLNIPLSVETVCVFTAPIFSANAAWATYLLTKEVKGTGAGLTAAALLAMVPSYISRSVAGSYDNEAVAIFALIFTFYLYIKTLNTGSLFYATLNAITYFYMVCSWGGYTFIINLIPMHVLLCIVTGRYSSRLYIAYAPLVVLGTLLAALVPVVGFNAVMTSEHFASFLVFIIIHVVALVYYIKGILSPKMFKVAVTLVVSVGLVVCCAVVAVLIALVASSPTKGWSGRSLSLLDPTYASKYIPIIASVSEHQPPTWPSYFMDINVLAFLVPAGIVACFLPLSDASSFVVLYIVTSVYFSGVMVRLMLVLAPAACILSGIALSEAFDVLTRSIKFQLPGLSENSQIDAGDTTSSSVVTQNDAAKTNKNEDTLKERPSRKNRKKEKEHVEKTSIKSQIKKRLLVLPLEASVAAIFLLVLLGAFYVVHCVWAAAEAYSAPSIVLTSHSHDGLHVFDDFREAYAWLRHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIREPDYLRDGQYRIDSQATPTMLNCLMYKLSYFRFVETDGKGFDRVRRTEIGKKYFKLTHFEEVFTTHHWMVRIYKLKPPKNRIRVKTKKSKSKASSTTSSKRSGKRKKNPWQ

SEQ ID NO: 19704 - protein, 783 aa, Panax ginseng
MAALENAKDSALRYAFGNVLSFFILLLIGVLAFSIRLFSVIKYESVIHEFDPYFNYRVTQFLTKNGIYDFWNWFDDRTWYPLGRVIGGTVYPGLTLTAGTLWWILNSLNIPLSVETVCVFTAPIFSANAAWATFLLTKEVKGTGAGLTAAALLAMVPSYISRSVAGSYDNEAVAIFALIFTFYLYIKTLNTGSLFYATLNAIAYFYMVCSWGGYTFIINLIPMHALLCIVTGRYSSRLYIAYAPLVVLGTLLAALVPVVGFNAVLTSEHFASFLVFIIIHVVALAYYIKGILSPKMFKVAVTLVVSVGLVVCCAVIAVLVALVASSPTKGWSGRSLSLLDPTYASKYIPIIASVSEHQPPTWPSYFMDINVLAFLVPAGIIACFLPLSDASSFVVLYIVTSVYFSGVMVRLMLVLAPAACIMSGIALSEAFSVFTRSIKFQLPGVSQTHQIDTGDLGSGDDAIQKDVVKTDKSDEPAKERSSKRNKKKEKENVEKASKPSIKSKIEKRLLVLPLESSIIALLLLVLLGAFYVVHCVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNCLMYKLSYFRFVDTDGGKGYDRVRQTEIGKKYFKLTHFEEVFTTHHWMVRIYKLKPPRNRIRSRTKKTKSKTSGSTTSSKRSGAIKKNPWQ

SEQ ID NO: 19705 - protein, 778 aa, Prunus persica
MAASETSNGTSLRHAFGNVLSFFILILIGVLAFSIRLFSVIKYESVIHEFDPYFNYRVTQFLTKNGIYDFWNWFDDRTWYPLGRVIGGTVYPGLTLTAGTLWWLLNSLNIPLSVETICVFTAPIFSAFTSWATYLLTREVKGAGAGLTAAALIAMVPSYISRSVAGSYDNEAVAIFALIFTFYLYIKTLNTGSLFYATLNAIAYFYMVCSWGGYTFIINLIPMHVLLCIVTGRYSSRLYIAYAPLVVLGTLLAALVPVVGFNAVMTSEHFASFLVFIIIHVVAFVYYIKGILSPKMFKVAVTLVLSIGLIICIAVIAVLVALVASSPTKGWSGRSLSLLDPTYASKYIPIIASVSEHQPPTWPSYFMDINVLAFLVPAGIIACFSPLSDASSFVILYIVTSVYFSGVMVRLMLVLAPAACIMSGIALSEAFDVFTRSIKFQLPGLPGFSEVDAGDTSSESTVPQTEVPKTDKSGETLKERPSRKNRKKEKEPVEKPSIKSQIEKRLLVLPFEGSVLAIFLLVLLGAFYVVHCVWAAAEAYSAPSIVLTSYSNDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNSLMYKLSYYRFVDTDGKGFDRVRRTEIGKKYFKLTHFEEVFTTHHWMVRIYKLKPPRNRIRGKTKKSKSKSSSSSSSTKRSSTRKNPWH

SEQ ID NO: 19706 - protein, 778 aa, Quercus alba
MAASETSNGTALRYAFGNVLSFFILLLIGVLAFSIRLFSVIKYESVIHEFDPYFNYRVTQYLTKNGIYDFWNWFDDRTWYPLGRVIGGTVYPGLTLTAGTLYWILNSLNIPLSVETVCVFTAPIFSAFASWATYLLTKEVKGAGAGLTAAVLLAMVPSYISRSVAGSYDNEAVAIFALIFTFFLYIKTLNTGSLFYATLNAIAYFYMVCSWGGYTFIINLIPMHVLLCIVTGRYSSRLYIAYAPLVVLGTLLASLVPVVGFNAVLTSEHFGSFLVFIIIHVVALVYYIKGILSPKMFKVAVTLVVSIGLVVCCAVIAVLVALVASSPTKGWSGRSLSLLDPTYASKYIPIIASVSEHQPPTWPSYFMDINVLAFLVPAGIIACFSPLSDASSFVILYIVTSVYFSGVMVRLMLVLAPAACIMSGIALSASFDVFTRSIKFQLPGVKGNSQVDAGDTSSEGVVAQNEVAKTDKNEEALKERPSKKNRKKEKEHVEKPSVKAQIKKRLLVLPFEASIIAILLLILLGAFYVVHSVWAAAEAYSAPSIVLTSYSHDGLHVFDDFREAYSWLSHNTEVDDKVASWWDYGYQTTAMANRTVIVDNNTWNNTHIATVGTAMSSPEKAAWEIFDSLDVKYVLVVFGGLVGYPSDDINKFLWMVRIGGGVFPHIKEPDYLRDGQYRIDSQATPTMLNCLMYKLSYYRFVETDGKAFDRVRRTEIGKKHFKLTHFEEVFTTHHWMVRIYKLKPQKNRIRGKAKKSRSKASSTTSTKRSETQRKNPWH

SEQ ID NO: 19707 - protein, 778 aa, Prunus mume
MAASETSNGTSLRHAFGNVLSFFILILIGVLAFSIRLFSVIKYESVIHEFDPYFNYRVTQFLTKNGIYDFWNWFDDRTWYPLGRVIGGTVYPGLTLTAGTLWWLLNSLNIPLSVETICVFTAPIFSAFTSWATYLLTREVKGAGAGLTAAALIAMVPSYISRSVAGSYDNEAVAIFALIFTFYLYIKTLNTGSLFYATLNAIAYFYMVCSWGGYTFIINLIPMHVLLCIVTGRYSSRLYIAYAPLVVLGTLLAALVPVVGFNAVMTSEHFASFLVFIIIHVVAFVYYIKGILSPKMFKVAVTLVLSIGLIVCIAVIAVLVALVASSPTKGWSGRSLSLLDPTYASKYIPIIASVSEHQPPTWPSYFMDINVLAFLVPAGIIACFSPLSDASSFVILYIVTSVYFSGVMVRLMLVLAPAACIMSGIALSEAFDVFTRSIKFQLPVLPGFSEVDARDTSSESTVPQTEVPKTDKSGDTLKERPSRKNRKKEKEPVEKPSIKSQIEKRLLVLPFEGSVLAIFLLVLLGAFYVVHCVWAAAEAYSAPSIVLTSYSNDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNSLMYKLSYYRFVDTDGKGFDRVRRTEIGKKYFKLTHFEEVFTTHHWMVRIYKLKPPRNRIRGKTKKSKSKSSSSSSSTKRSSTRKNPWH

SEQ ID NO: 19708 - protein, 784 aa, Eschscholzia californica
MATIENPKGEGTLRYAFGNVLSFFILLLIGVLAFSIRIFSVIKYESVIHEFDPYFNYRVTQFLTKNGIYDFWNWFDDRTWYPLGRVIGGTVYPGLTLTAGTLWTLLQSLNIPLSVETVCVFTAPIFSAFAAWATYLLTKEVKGTGAGLTAAALLAIVPSYISRSVAGSYDNEAVAIFALIFTFYLYIKTLNTGSLFYATLNALAYFYMVCSWGGYTFIINLIPMHALLCIVTGRYSSRLYVAYAPLVVLGTLLAALVPVVGFNAVMTSEHFASFLVFIIIHVVALVYYIKGILSPKMFKVAVTLVVSVGTVICFAVVAVLVALVASSPTKGWSGRSLSLLDPTYASKYIPIIASVSEHQPPTWPSYFMDINVLAFLVPAGIIACFLPLSDASSFVVLYIVTSVYFSGVMVRLMLVLAPAACILSGIALSEAFDVFTRSIKFQLPALLGDSSSDSGDATSGSVVQNDVVKAEANPASDKNEDSLKERPAKKNKKKEKDTTVKASIKSRIEKRLLVLPLEASVIAILLLILLGAFYVVHCVWAAAEAYSAPSIVLTSHSHDGLHVFDDFREAYAWLSHNTEVDDKVASWWDYGYQTTAMANRTVIVDNNTWNNTHIATVGTAMSSPEKPAWEIFNSLDVKYVLVVFGGLVGYPSDDINKFLWMVRIGGGVFPHIKEPDYLRDGQYRIDSQATPTMLNSLMYKLSYFRFVETDGKGFDRVRRTEIGKKHFKLTHFEEVFTTHHWMVRIYKLKSPKNRIRGKTKKSKSGSKSSSNTKRVETGKKNPWH

SEQ ID NO: 19709 - protein, 778 aa, Castanea mollissima
MAASETSNGTALRYAFGNVLSFFILLLIGVLAFSIRLFSVIKYESVIHEFDPYFNYRVTQYLTKNGIYDFWNWFDDRTWYPLGRVIGGTVYPGLTLTAGTLYWILNSLNIPLSVETVCVFTAPIFSAFASWATYLLTKEVKGAGAGLTAAVLLAMVPSYISRSVAGSYDNEAVAIFALIFTFFLYIKTLNTGSLFYATLNAIAYFYMVCSWGGYTFIINLIPMHVLLCIVTGRYSSRLYIAYAPLVVLGTLLASLVPVVGFNAVLTSEHFGSFLVFIIIHVVALVYYIKGILSPKMFKVAVTLVLSIGLVVCCAVIAVLVALVASSPTKGWSGRSLSLLDPTYASKYIPIIASVSEHQPPTWPSYFMDINVLAFLVPAGIIACFSPLSDASSFVVLYIVTSVYFSGVMVRLMLVLAPAACIMSGIALSASFDVFTRSIKFQLPGVKGNSQVDAGYTSSEGVVVQNEVAKTDKNEEALKERPSKKNRKKEKEHVEKPSVKAQIKKRLLVLPFEASIIAILLLILLGAFYVVHSVWAAAEAYSAPSIVLTSYSHDGLHVFDDFREAYSWLSHNTEVDDKVASWWDYGYQTTAMANRTVIVDNNTWNNTHIATVGTAMSSPEKAAWEIFDSLDVKYVLVVFGGLVGYPSDDINKFLWMVRIGGGVFPHIKEPDYLRDGQYRIDSQATPTMLNCLMYKLSYYRFVETDGKAFDRVRRTEIGKKHFKLTHFEEVFTTHHWMVRIYKLKPQKNRIRGKAKKSRSKASSTTSTKRSETQRKNPWH

SEQ ID NO: 19710 - protein, 782 aa, Citrus clementina
  Sequence also found in Organisms: Citrus sinensis
MAAAAKAGEATLRHAFGNVLSFFILLLIGVLAFSIRLFSVIKYESVIHEFDPYFNYRVTQFLTKNGIYDFWNWFDDRTWYPLGRVIGGTVYPGLTLTAGTIWWLLNSLNIPLSVETVCVFTAPIFSAFASWATYLLTKEVKGAGAGLTAAALLAMVPSYISRSVAGSYDNEAVAIFALIITFYLYIKTLNTGSLFYATLNAIAYFYMVCSWGGYTFIINLIPMHVLLCIVTGRYSSRLYIAYAPLVVLGTLLAALVPVVGFNAVMTSEHFASFLVFIILHVVALVYYIKGILSPKMFKVAVTLVVSVGLVVCCAVIAILVALVASSPTKGWSGRSLSLLDPTYASKYIPIIASVSEHQPPTWPSYFMDINVLAFLVPAGIIACFLPLSDASSFVVLYIVTSVYFSGVMVRLMLVFAPAACIMSGIALSQAFDVFTRSIKFQLLRILGFSEADAGDGSSANVVPENDAVKVDKSEETIKERPSRKNKKKEKEQMEKAQAEKTSAKSKTEKRLLVLPMELSVIGLLLLVFMGAFYVVHCVWAAAEAYSAPSIVLTSYTHEGLHVFDDFREAYAWLRHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNCLMYKLSYYRFVETDGKGFDRVRRTEIGKKYFKLTHFEEVFTTHHWMVRIYKLKPSKNRIRGKMKKSKSRTSTPSSKRSGSRKKNPWQ

SEQ ID NO: 19711 - protein, 784 aa, Flaveria ramosissima
MAVPVDNLTKPPPASSTLRFAFGNVLAFFILLLIGVLAFSIRLFSVIKYESVIHEFDPYFNYRVTQFLTKNGIYDFWNWFDDRTWYPLGRVIGGTVYPGLTLTAGTIWKVLHSLNIPLSVETVCVFTAPVFSAFAAWATYLLTKEVKGTGAGLTAAVLLAMVPSYISRSVAGSYDNEAVAIFALIFTFYLYVKTLNTGSLFYATLNSIAYFYMVCSWGGYTFIINLIPMHVLLCIVTGRYSSRLYIAYAPLVVLGTLLAALVPVVGFNAVMTSEHFASFLVFIVIHVVALAYYIKGILSPKMFKVAATLVVSVGLVVCCAVVAVLVAVVASSPTKGWSGRSLSLLDPTYASKYIPIIASVSEHQPPTWPSYFMDLNVLAFLVPAGIIACFTPLSDASSFVILYLVMSVYFSGVMVRLMLVLAPAACIMSGIALSEAFDVFTRSIKFYISNLSEFLQVDAGDSVPVNNVSPQNDVLKNEKREDMLKERPSRKNKKKEKENIEKPSVKPKTEKRPLVLPVEASFFALFLTVLLGGFYVVHSVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNSLMYKLSYFRFVETDGGKGYDRVRRTEIGKKHFKLTHFEEVFTTHHWMVRIYKLKPQRNRIRGKTKKSKSKTSSSTPRSGTMKKNPWH

SEQ ID NO: 19712 - protein, 784 aa, Aquilegia formosa
MAELEIGKGSKLRYAFGNVLSLFILLLIGVLAFSIRLFSVIKYESVIHEFDPYFNYRVTQFLTKNGIYDFWNWFDDRTWYPLGRVIGGTVYPGLTLTAGTLWWILNSLNIPLSVETVCVFTAPIFSAFAAWATYLLTKEVKGTGAGLTAAVLLAMVPSYISRSVAGSYDNEAVAIFALIFTFYLYLKTLNTGSLFYATLNALSYFYMVCSWGGYTFIINLIPMHALLCIVTGRYSSRLYIAYAPLIVLGTLLASLVPVVGFNAVMTSEHFASFLVFIIIHVVALVYYIKGILTPKMFKVAVTLVVSVGMIVCFAMVAVLVALVASSPTKGWSGRSLSLLDPTYASKYIPIIASVSEHQPPTWPSYFMDINVLAFLVPAGIIACFLPLSDASSFVVLYIVTSVYFSGVMVRLMLVLAPAACILSGIALSEAFDVFTRSIKCQLSDLLSDPLPAAGDMASENSAVQNDIVKVDKHSTAQKSDEGLKERTSKKNRKKEKEHVEKVSIKARKEKRLLVLPLETSVIAILLLVMLGAFYVVHCVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFDSLDVKYVLVVFGGLVGYPSDDINKFLWMVRIGGGVFPHIKEPDYLRDGQYRIDSQATPTMLNCLMYKLSYYRFVETDGKGFDRVRRTEIGKKHFKLTHFEEVFTTHHWMVRIYKLKSPKNRVRGKTKKSKSKASSAAKLKKVDRGKKNPWH

SEQ ID NO: 19713 - protein, 784 aa, Arnica chamissonis
MAVPVDSLTKQTPASSTLRFAFGNVLAFFILLLIGVLAFSIRLFSVIKYESVIHEFDPYFNYRVTQFLTKNGIYDFWNWFDDRTWYPLGRVIGGTVYPGLTLTAGTIWKVLQSLNIPLSVETVCVFTAPVFSAFAAWATYLLTKEVKGTGAGLTAAVLLAMVPSYISRSVAGSYDNEAVAIFALIFTFYLYIKTLNTGSLFYATLNSISYFYMVCSWGGYTFIINLIPMHVLLCIVTGRYSSRLYVAYAPLVVLGTLLAALVPVVGFNAVMTSEHFASFLVFIVIHVVAFAYYIKGMLSPKMFKVAATLVVSVGLVVCCAVVAVLVAVVASSPTKGWSGRSLSLLDPTYASKYIPIIASVSEHQPPTWPSYFMDLNVLAFLVPAGIIACFTPLSDASSFVILYLVMSVYFSGVMVRLMLVLAPAACIMSGIALSEAFDVFTRSIKFYITNLSEFLQIDAGDSLPGNNVSPQNDVLKNEKKEDALKERPSRKNKKKEKESIEKPSVKSKTEKRPLVLPVEASFFALFLTVLLGGFYVVHSVWAAAEAYSAPSIVLTSHSHDGLHVFDDFREAYAWLSHNTEVDDKVASWWDYGYQTTAMANRTVIVDNNTWNNTHIATVGTAMSSPEKAAWDIFNSLDVKYVLVVFGGLVGYPSDDINKFLWMVRIGGGVFPHIKEPDYLRDGQYRIDSQATPTMLNSLMYKLSYFRFVETDGGKGYDRVRRTEIGKKHFKLTHFEEVFTTHHWMVRIYKLKPQRNRIRGKTKKSKSKTSSTTPRSGTMKKNPWH

SEQ ID NO: 19714 - protein, 786 aa, Eucalyptus grandis
MAASEASSAATATATATTLRQAFGGVLSFFILLLIGVLAFSIRLFSVIKYESVIHEFDPYFNYRVTQFLTKNGIYDFWNWFDDRTWYPLGRVIGGTVYPGLTLTAGTLWWILNSLNIPLSVETVCVFTAPIFSAFASWATYLLTKEVKGAGAGLTAAALLAMVPSYISRSVAGSYDNEAVAIFALIFTFFLYIKTLNTGSLFYATLNAISYFYMVCSWGGYTFIINLIPMHALLCIVTGRYSSRLYIAYAPLVVLGTLLAALVPVVGFNAVMTSEHFASFLVFIVIHVVALVYYIKGILSPKMFKVAVTLVLSAGLVVCFAVVAILIALVASSPTMGWSGRSLSLLDPTYASKYIPIIASVSEHQPPTWPSYFMDINVLAFLVPAGIIACFLPLSDASSFVVLYIVTSVYFSGVMVRLMLVLAPAACILSGIALSEAFDTLTRSIKFQLPGISGGNSEANAGDASSASASAQNDVIKADKTEETAKERPSRKSKKKEKEPVEKPPRNPRNEKKLLVLPFEASIVGIFLLVLLGAFYVVHCVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNCLMYKLSYYRFVDTDGKAFDRVRRTEIGKKHFKLTHFEEVFTTHHWMVRLYKLKPPKNRLRGKTKKLKSKTSSASNSKRSGKRTKNPWQ

SEQ ID NO: 19715 - protein, 784 aa, Flaveria ramosissima
MAVPVDNLTKPPPASSTLRFAFGNVLAFFILLLIGVLAFSIRLFSVIKYESVIHEFDPYFNYRVTQFLTKNGIYDFWNWFDDRTWYPLGRVIGGTVYPGLTLTAGTIWKVLHSLNIPLSVETVCVFTAPVFSAFAAWATYLLTKEVKGTGAGLTAAVLLAMVPSYISRSVAGSYDNEAVAIFALIFTFYLYVKTLNTGSLFYATLNSIAYFYMVCSWGGYTFIINLIPMHVLLCIVTGRYSSRLYIAYAPLVVLGTLLAALVPVVGFNAVMTSEHFASFLVFIVIHVVALAYYIKGILSPKMFKVAATLVVSVGLVVCCAVVAVLVAVVASSPTKGWSGRSLSLLDPTYASKYIPIIASVSEHQPPTWPSYFMDLNVLAFLVPAGIIACFTPLSDASSFVILYLVMSVYFSGVMVRLMLVLAPAACIMSGIALSEAFDVFTRSIKFYISNLSEFLQVDAGDSVPVNNVSPQNDVLKNEKREDMLKERPSRKNKKKEKENIEKPSVKPKTEKRPLVLPVEASFFALFLTVLLGGFYVVHSVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNSLMYKLSYFRFVETDGGKGYDRVRRTEIGKKHFKLTHFEEVFTTHHWMVRIYKLKPQRNRIRGKTKKSKSKTSSTTPRSGTMKKNPWH

SEQ ID NO: 19716 - protein, 780 aa, Populus trichocarpa
MADGESSKEATARTLRNAFGNVLSFFILLLIGVLAFSIRLFSVIKYESVIHEFDPYFNYRVTQFLTKNGIYDFWNWFDDRTWYPLGRVIGGTVYPGLTLTAGTLWWLLNSLNIPLSVETVCVFTAPIFSAFASWATYLLTKEVKGTGAGLTAAVLLAMVPSYISRSVAGSYDNEAVAIFALIFTFYLYIKTLNTGSLFYATLNALAYFYMVCSWGGYTFIINLIPMHVLLCIVTGRYSSRLYIAYAPLVVLGTLLAALVPVVGFNAVMTSEHFASFLVFIIIHVVALVYHVKGNLSPRMFKVAVTLVVSVGLVVCCAMIAVLIALVASSPTKGWSGRSLSLLDPTYASKYIPIIASVSEHQPPTWPSYFMDINVLAFLVPAGIIACFLPLSDASSFVVLYIVTSVYFSGVMVRLMLVLAPAACIMSGIALSEAFNVLTRSIKFQLPGSSGTSQSRDTSLNTDGEQNDIAKTEKMDETVKERPSKKNRKKEKEPVEKASIRSRIERRLLVLPLEASVIAIILLVLLGAFYVVHCVWAAAEAYSAPSIVLTTYSRDGGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNCLMYKLSYYRFVETDGKAFDRVRQTEIGKKYFKLTHFEEVFTTHHWMVRIYKLKPPKNRIRGKTKKSKLKASSTSSSKRSATGKRNPWH

SEQ ID NO: 19717 - protein, 786 aa, Cirsium arvense
MAVPVDTITKPPPASSTSTLRFAFGNVLAFFILLLIGVLAFSIRLFSVIKYESVIHEFDPYFNYRVTQFLTKNGIYDFWNWFDDRTWYPLGRVIGGTVYPGLTLTAGTIWKVLQSLNIPLSVETVCVFTAPVFSAFAAWATYLLTKEVKGTGAGLTAAVLLAMVPSYISRSVAGSYDNEAVAIFALIFTFYLYIKTLNTGSLFYATLNSMSYFYMVCSWGGYTFIINLIPMHVLLCIVTGRYSSRLYIAYAPLVVLGTLLAALVPVVGFNAVMTSEHFASFLVFIVIHVVALAYYIKGILSPKMFKVAATLVVSVGLVVCCAVVAVLVAVVASSPTKGWSGRSLSLLDPTYASKYIPIIASVSEHQPPTWPSYFMDINVLAFLVPAGIIACFSPLSDASAFVILYLVMSVYFSGVMVRLMLVLAPAACIMSGIALSEAFDVFTRSIKFYISNLSETLQTDAGDIVSGNNASPQNDAIKTDKREDSLKERPSRKNKKKDKEIVEKPSVKSKIEKRPLVLPVEASFFALFLTVLLGAFYVVHSVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNSLMYKLSYFRFVETDGGKGYDRVRRTEIGKKYFKLTHFEEVFTTHHWMVRIYKLKPQKNRIRGKTKKSRSKSSSATPTSGTTKKNPWH

SEQ ID NO: 19718 - protein, 774 aa, Vigna unguiculata
MAASDAQNGVSSVRHAFGNVLAFFILLLIGVLAFSIRLFSVIKYESVIHEFDPYFNYRVTQFLTKNGIYDFWNWFDDRTWYPLGRVIGGTVYPGLTLTAGTLWWILNSLNIPLSVETVCVFTAPIFSAFASWATYLLTKEVKGTGAGLTAAILLAMVPSYISRSVAGSYDNEAVAIFALIFTFYLYIKTLNTGSLFYATLNSIAYFYMVCSWGGYTFIINLIPMHALLCIVTGRYSSRLYIAYAPLVVLGTLLASLVPVVGFNAVMTSEHFASFLVFIIIHVVALVYYIKGILSPKMFKVAVALVVSVGLAVCFAMVAVLIALVASSPTKGWSGRSLSLLDPTYASKYIPIIASVSEHQPPTWPSYFMDINVLAFLVPAGIIACFSPLSDASSFVVLYIVTSVYFSGVMVRLMLVLAPAACILSGIALSQAFDVFTRSIKFQLPHLSDHSQAGEGSSENVVPNDSVKADKTEDTSKERTSKKSKKKEKEPVEKPLSKSQIKKRLSVLPLETSVVAIILLVLLGAFYVVHSVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFHSLDVKYVLVVFGGLVGYPSDDINKFLWMVRIGGGVFPHIKEPDYLRDGQYRIDSMATPTMLNCLMYKLSYYRFVETDGKAFDRVRRTEIGKKHFKLTHFEEVFTTHHWMVRIYKLKPPKNRIRGKTKKSKSKTSSKTASKRKGLKRNPF

SEQ ID NO: 19719 - protein, 785 aa, Ambrosia trifida
MAVPIDNNLTKPTPPSSTLRFAFGNVLAFFILLLIGVLAFSIRLFSVIKYESVIHEFDPYFNYRVTQFLTKNGIYDFWNWFDDRTWYPLGRVIGGTVYPGLTLTAGTIWKVLQSLNIPLSVETVCVFTAPVFSAFASWAAYLLTKEVKGTGAGLTAAVLLAMVPSYISRSVAGSYDNEAVAIFALIFTFYLYVKTLNTGSLFYATLNSIAYFYMVCSWGGYTFIINLIPMHVLLCIVTGRYSSRLYIAYAPLVVLGTLLAALVPVVGFNAVMTSEHFASFLVFIVIHVVALAYYIKGILSPKMFKVAATLVVSVGLVVCCAVVAVLVAVVASSPTKGWSGRSLSLLDPTYASKYIPIIASVSEHQPPTWPSYFMDLNVLAFLVPAGIIACFSPLSDASSFVILYLVMSVYFSGVMVRLMLVLAPAACIMSGIALSEAFDVFTRSIKFYISNLSESLQIDAGDTVPGNNVSPPSDVLKNDKKEDTLKERPSRKNKKKEKENTEKPAIKSKTEKRPLVLPVEASFFALFLTVLLGGFYVVHSVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNSLMYKLSYFRFVETDGGKGYDRVRRTEIGRKHFKLTHFEEVFTTHHWMVRIYKLKPQKNRIRGKTKKSKSKTSSATPRSGTVKKNPWH

SEQ ID NO: 19720 - protein, 785 aa, Helianthus annuus
MAVPVDSLAKPPPASSTLRFAFGNVLAFFILLLIGVLAFSIRLFSVIKYESVIHEFDPYFNYRVTQFLTKNGIYDFWNWFDDRTWYPLGRVIGGTVYPGLTLTAGTIWKVLQSLNIPLSVETVCVFTAPVFSAFAAWAAYLLTKEVKGTGAGLTAAVLLAMVPSYISRSVAGSYDNEAVAIFALIFTFYLYVKTLNTGSLFYATLNSIAYFYMVCSWGGYTFIINLIPMHVLLCIVTGRYSSRLYIAYAPLVVLGTLLAALVPVVGFNAVMTSEHFASFLVFIVIHVVALAYYIKGILSPKMFKVAATLVVSVGLVVGCAVVAVLVAVVASSPTKGWSGRSLSLLDPTYASKYIPIIASVSEHQPPTWPSYFMDLNVLAFLVPAGIIACFSPLSDASSFVILYLVMSVYFSGVMVRLMLVLAPAACIMSGIALSEAFDVFTRSIKFYITNLSESLQIDAGDAVPGNGVSPQNDVLKNDKKEDTLKERPSRKNKKKEKETIEKPSVKSKAEKKPLVLPVEASFFALFLTVLLGGFYVVHSVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNSLMYKLSYFRFVETDGGKGYDRVRRTEIGKKHFKLTHFEEVFTTHHWMVRIYKLKPQKNRIRGKTKKSKSKTSSTTTPRSGTTKKNPWH

SEQ ID NO: 19721 - protein, 784 aa, Daucus carota
MVAAETAKDKALRYAFGNVLCFFILLLIGVLAFSIRIFSVIKYESVIHEFDPYFNYRVTQFLTKNGIYDFWNWFDDRTWYPLGRVIGGTVYPGLTLTAGTLWWTLNALNIPLSVETVCVFTAPIFSAFAAWATYFLTKEVKGTGAGLAAAALLAMVPSYISRSVAGSYDNEAVAIFALIFTFYLYIKTLNTGSLFYATLNAIAYFYMVCSWGGYTFIINLIPMHALLCIVTGRYSPRLYIAYCPLVVLGTLLAALVPVVGFNAVLTSEHFASFLVFIIIHVVALAYYIKGILSPKMFKVAVTLVVSVGLVVCCGVIAILVALVASSPTKGWSGRSLSLLDPTYASKYIPIIASVSEHQPPTWPSYFMDINVLAFLVPAGIVACFVPLSDASSFVVLYIVTSVYFSGVMVRLMLVLAPAACIMSGIALSEAFSVFTRSIKFQLPGLSQSHQMDAGDSVSEPSGDVIQNDIVKTDRHDEPVKERPTRRNKKKEKENVDKASKPSIKSKIENRLLVLPLETSIIALFLLVLLGAFYVVHCVWAAAEAYSAPSIVLTSHSRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSEATPTMLNCLMYKLSYYRFVETDGGKAFDRVRRTEIGKKYIKLTHFEEVFTTHHWMVRIYKLKPPRNRIRSKTKKSKSKSSSSANRDRSVKRKKNPWH

SEQ ID NO: 19722 - protein, 773 aa, Medicago truncatula
MAATDAQTSLRHAFGNVLAFFILILIGVLAFSIRLFSVIKYESVIHEFDPYFNYRVTQFLTKNGIYDFWNWFDDRTWYPLGRVIGGTVYPGLTLTAGTLWWVLNSLNIPLSVETVCVFTAPIFSAFASWATYLLTKEVKGAGAGLTAAVLLAMVPSYISRSVAGSYDNEAVAIFALIFTFYLYIKTLNTGSLFYATLNSIAYFYMVCSWGGYTFIINLIPMHVLLCIVTGRYSSRLYIAYAPLVVLGTLLAALVPVVGFNAVMTSEHFASFLVFILIHVVALVYYIKGILSPKMFKVAVTLVVSGGLAVGFAMIAVLVAMVAASPTMGWSGRSLSLLDPTYASKYIPIIASVSEHQPPTWPSYFMDINVLAFLVPAGIIACFSPLSDASSFVILYIVTSVYFSGVMVRLMLVLAPAACILSGIALSQAFDVFTRSIKLQLPSLSVDSHVNAGDASSESVVPDDTVKTDKTEDTHKERTSKKSKKKEKEPVEKPPSKSQIKKRLLVLPLETSIIAIVLLVLLGAFYVVHSVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDNMATPTMLNCLMYKLSYYRFVETDGKAYDRVRRTEIGKKYFKLTHFEEVFTTHHWMVRIYKLKPPKNRIRGKTKKTKSKASSKTVSKKQGIKKNPF

SEQ ID NO: 19723 - protein, 778 aa, Mimulus guttatus
MAAPENPQQQAATIRHAFGNVLSFLILLLIGVLAFSIRLFSVIKYESVIHEFDPYFNYRVTQFLIKSGVYDFWNWFDDRTWYPLGRVIGGTVYPGLTLTAGTLWRIFNALNIPLTVETVCVFTAPIFSAFAAWATYLLTKEVKGVGAGLTAAALLAMVPSYISRSVAGSYDNEAVAIFALIITFYLYIKTLNTGSLFYATLNAIAYFYMVCSWGGYTFIINLIPMHVLLCIVTGRYSSRLYIAYAPLVVLGTLLAALVPVVGFNAVMTSEHFASFLVFIIIHVVALVYYIKGILTPKMFRVAVTLVVSVGLIVGFAVLAVLIALVASSPTKGWSGRSLSLLDPTYASKYIPIIASVSEHQPPTWPSYFMDLNVLAFLVPAGIIACFMPLSDASSFAVLYIVTSVYFSGVMVRLMLVLAPAACIMSGIALSEAFDVLTRSIKLQLLAATENPQINAGDATKVTPNDAVKTEKSEDSVKERSSRKSKKKEKENVEKASSVSRKEKRLLVLPLEASMIAVFLLVLLGAFYVVHCVWAAAEAYSAPSIVLTTRSNDGGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDAQATPTMLNSLMYKLSYYRFVETDGRGFDRVRHTEIGKKHFKLTHFEEVFTTHHWMVRLYKLKSPKNRIRGKTKKSKSKATTTTSSKRIGARKKNPWH

SEQ ID NO: 19724 - protein, 774 aa, Phaseolus vulgaris
MAASDAQNGVFSVRHAFGNVLAFFILLLIGVLAFSIRLFSVIKYESVIHEFDPYFNYRVTQFLTKNGIYDFWNWFDDRTWYPLGRVIGGTVYPGLTLTAGTLWWILNSLNIPLSVETVCVFTAPIFSAFASWATYLLTKEVKGAGAGLTAAILLAMVPSYISRSVAGSYDNEAVAIFALIFTFYLYIKTLNTGSLFYATLNSIAYFYMVCSWGGYTFIINLIPMHVLLCIVTGRYSSRLYIAYAPLVVLGTLLASLVPVVGFNAVMTSEHFASFLVFIIIHVVALVYYIKGSLSPKMFKVAVALVVSVGVAVCFAMVAVLIALVASSPTKGWSGRSLSLLDPTYASKYIPIIASVSEHQPPTWPSYFMDINVLAFLVPAGIIACFSPLSDASSFVVLYIVTSVYFSGVMVRLMLVLAPAACILSGIALSQAFDVFTRSIKFQLPSLSDNSQAGEGSSENVVPNDSVKADKTEDTSKERTSKKSKKKEKEPVEKPLSKSQIKKRLLVLPLETSVIAIILLVLLGAFYVVHSVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFQSLDVKYVLVVFGGLVGYPSDDINKFLWMVRIGGGVFPHIKEPDYLRDGQYRIDSMATPTMLNCLMYKLSYYRFVETDGKAFDRVRRTEIGKKHFKLTHFEEVFTTHHWMVRIYKLKSPKNRIRGKTKKSKSKTSSKTASKRNELKRNPF

SEQ ID NO: 19725 - protein, 777 aa, Fragaria vesca
MEASETSSGKTLRNAFGNVLAFLILILIGVLAFSIRLFSVIKYESVIHEFDPYFNYRVTQFLTKNGIYDFWNWFDDRTWYPLGRVIGGTVYPGLTLTAGTLWWLLNSLNIPLSVETICVFTAPIFSAFTSWSTYLLTREVKGTGAGLTAAALIAMVPSYISRSVAGSYDNEAVAIFALIFTFYLYIKTLNTGSLFYATLNSLAYFYMVCSWGGYTFIINLIPMHVLMCIVTGRYSSRLYIAYAPLVVLGTLLAALVPVVGFNAVMTSEHFASFLVFIIIHVVAFVYYIKGVLSPKMFKVAVTLVLSIGLVVCCAVIAVLVALVASSPTKGWSGRSLSLLDPTYASKYIPIIASVSEHQPPTWPSYFMDINVLAFLVPAGIIACFSPLSDASSFVILYIVTSVYFSGVMVRLMLVLAPAACITSGIALSEAFEVFTRSIKFQLPGLPGLSPVEAEETSTDSTVPLNEVPKTDKGGETLKERPSRKNRKKEKEPVEKPSIKARIEKKLLVLPFEGSILAIFLLVLLGAFYVVHCVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDNQATPTMLNCLMYKLSYYRFVDTDGKGFDRVRRTEIGKKYFKLTHFEEVFTTHHWMVRIYKLKPPKNRIRGKTKKSKSKSTSTSSGKSSGTRKNPWN

SEQ ID NO: 19726 - protein, 773 aa, Trigonella foenum-graecum
MAATDAQTSLRHAFGNVLAFFILILIGVLAFSIRLFSVIKYESVIHEFDPYFNYRVTQFLTKNGIYDFWNWFDDRTWYPLGRVIGGTVYPGLTLTAGTLWWVLNSLNIPLSVETVCVFTAPIFSAFASWATYLLTKEVKGAGAGLTAAVLLAMVPSYISRSVAGSYDNEAVAIFALIFTFYLYIKTLNTGSLFYATLNSIAYFYMVCSWGGYTFIINLIPMHVLLCIVTGRYSSRLYIAYAPLVVLGTLLAALVPVVGFNAVMTSEHFASFLVFILIHVVALVYYIKGILSPKMFKVAVTLVVSGGLAVCFAMIAVLVAMVASSPTMGWSGRSLSLLDPTYASKYIPIIASVSEHQPPTWPSYFMDINVLAFLVPAGIIACFSPLSDASSFVILYIVTSVYFSGVMVRLMLVLAPAACILSGIALSQAFDVFTRSIKLQLPSLLVDSPVNVGDASSESVVPDDTVKTDKTEDTHKERTSKKSKKKDKEPVEKPPSKSQIKKRLLVLPLETSVIAIFLLVLLGAFYVVHSVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDNMATPTMLNCLMYKLSYYRFVETDGKAFDRVRRTEIGKKYFKLTHFEEVFTTHHWMVRIYKLKPPKNRIRGKTKKTKSKASSKTVSKRQGIKRNPF

SEQ ID NO: 19727 - protein, 777 aa, Citrullus lanatus
MAASVPSKGSTLRDAFGNVLSFFILILIGVLAFSIRLFSVIKYESVIHEFDPYFNYRVTQYLSKMGIYEFWNWFDDRTWYPLGRVIGGTVYPGLTLTAGTLWRVLNALNIPLSVETVCVFTAPVFSAFASWATYLLTKEVKGPGAGLTAAALLAMVPSYISRSVAGSYDNEAVAIFALIFTFYLYLKTLNTGSLFYATLNALAYFYMVCSWGGYTFIINLIPMHALLCIVTGRYSSRLYIAYAPFVVLGTLLAALVPVVGFNAVMTSEHFASFLVFIIIHVVALVYYIKGTLSQKMFKVAVTLVVSIGLAVCCSVIAVLIALVASSPTKGWSGRSLSLLDPTYASKYIPIIASVSEHQPPTWPSYFMDINVLAFLVPAGIIACFSPLSDASSFVVLYIATAVYFSGVMVRLMLVLAPAACIMSGIALSQAFEVFTRSIKFQMPGEAPDAQEVGETISDGVVIQHDVVKPEKSEDTVKERPSKKNRKKEKEPVEKPSVKSQIRKRLLVLPFATSIIALFLLVLLGAFYVVHCVWAAAEAYSAPSIVLTSHSRDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNCLMYKLSYYRFVETDGKGFDRVRQTEIGKKYFKLSHFEEVFTTHHWMVRIYKLKPPKNRIRGKTKKSKTKSSSTTSSKRKGTKKRNPWH

SEQ ID NO: 19728 - protein, 779 aa, Cannabis sativa
MAASETSSGIVLRNAFGNVFSVFILILIGVLAFSIRLFSVIKYESVIHEFDPYFNYRVTQFLTKSGIYEFWNWFDDRTWYPLGRVIGGTVYPGLTLTAGSIWWFVNSLNIPLTVETVCVFTAPIFSAFASWATFLLTKEVKGTGAGLTAAALLAMVPSYISRSVAGSYDNEAVAIFALIITFYLYIKTLNTGSLFYATLNSIAYFYMVCSWGGYTFIINLIPMHVLLCIVTGRYSSRLYIAYAPLVVLGTLLAALVPVVGFNAVMTSEHFASFLVFIIIHVVALVYYIKGLLSAKMFKVAVTLILSLGLVLCFAVVAILVALVASSPTKGWSGRSLSLLDPTYASKYIPIIASVSEHQPPTWPSYFMDINVLAFLVPAGIVACFSPLSDASSFVILYIVTSVYFSGVMVRLMLVFAPAACILSGIALSEAFEVFTRSIKFQLPGSSMKPQIDAAETSSVSVIPENDVAKTDKTEDTLKERPSRKNRKKDKESVAAVEKPSIKSKIEKRLLVLPFEASIIAIFLLVLLGAFYVVHCVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNSLMYKLSYYRFVETDGKGFDRVRRTEIGKKYFKLTHFEEVFTTHHWMVRLYKLKPPKNRIRGKTKKSKKLTGTTPKRSGAGKKNPWL

SEQ ID NO: 19729 - protein, 778 aa, Glycine max
MAASNAHNGTTTNSIRHAFGNVLAFFILLLIGVLAFSIRLFSVIKYESVIHEFDPYFNYRVTQFLTKNGIYDFWNWFDDRTWYPLGRVIGGTVYPGLTLTAGTLWWVLNSLNIPLSVETVCVFTAPIFSAFASWATYLLTKEVKGAGAGLTAAVLLAMVPSYISRSVAGSYDNEAVAIFALIFTFYLYIKTLNTGSLFYATLNSIAYFYMVCSWGGYTFIINLIPMHVLLCIVTGRYSSRLYIAYAPLVVLGTLLAALVPVVGFNAVMTSEHFASFLVFIIIHVVALVHYIKGILSPKMFKVAVALVVSVGLAVCCAMVAVLVALVASSPTKGWSGRSLSLLDPTYASKYIPIIASVSEHQPPTWPSYFMDINVLAFLVPAGIIACFSPLSDASSFVVLYIVTSVYFSGVMVRLMLVLAPAACILSGIALSQAFDVFTRSIKLQLPSLLGHSHVDAGEASSESVVTNDSMKSDKSEDTSKERTSKKSKKKEKEPVEKPPSKSQIKKRLLVLPLETSIIAIVLLVLLGAFYVVHSVWAAAEAYSAPSIVLTSHSHDGLHVFDDFREAYAWLSHNTEIDDKVASWWDYGYQTTAMANRTVIVDNNTWNNTHIATVGTAMSSPEKAAWEIFHSLDVKYVLVVFGGLVGYPSDDINKFLWMVRIGGGVFPHIKEPDYLRDGQYRIDSMATPTMLNCLMYKLSYYRFVETDGKAFDRVRRTEIGKKYFKLTHFEEVFTTHHWMVRIYKLKPPKNRIRGKIKKSKSKASSKTTSKRKGLKRNPF

SEQ ID NO: 19730 - protein, 769 aa, Manihot esculenta
MADPENAIGATTLRYAFGNVLSFFILLLIGVLAFSIRLFSVIKYESVIHEFDPYFNYRVTQFLTKNGIYDFWNWFDDRTWYPLGRVIGGTVYPGLTLTAGTLWWALNSLNIPLSVETVCVFTAPIFSAFASWATYLLTKEVKGAGAGLTAAALLAMVPSYISRSVAGSYDNEAVAIFALIFTFYLYIKTLNTGSLFYATLNALAYFYMVCSWGGYTFIINLIPMHVLLCIVTGRYSSRLYIAYAPLVVLGTLLAALVPVVGFNAVMTSEHFASFLVFIIIHVVAFVYYIKGILSPKMFKVAVTLVVSIGLAVCCAVLAILIALVASSPTKGWSGRSLSLLDPTYASKYIPIIASVSEHQPPTWPSYFMDINVLAFLVPAGIIACFLPLSDASSFVVLYIVTSVYFSGVMVRLMLVLAPAACVMSGIALSEAFSVFTRSIKFQLPGLLGSSQSQVDFFYQLRNHNDLMLLIFKSGDAKKEKEIVDKPSLKTKIEKRLLVLPLEASIFGILLLVLLGAFYVVHCVWAAAEAYSAPSIVLTSYSRDGGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGHYRIDSQATPTMLNCLMYKLSYYRFVETDGRGFDRVRQTEIGKKNFKLTHFEEAFTTHHWMVRIYKLKPPKNRIRGKTKKSKSVCMKKTSTKRSGASKRNPWH

SEQ ID NO: 19731 - protein, 773 aa, Cicer arietinum
MAATEAQSSLRHAFGNVLAFFILILIGVLAFSIRLFSVIKYESVIHEFDPYFNYRVTQFLTKNGIYDFWNWFDDRTWYPLGRVIGGTVYPGLTLTAGTLWWILNSLNIPLSVETVCVFTAPIFSAFASWATYLLTKEVKGAGAGLTAAVLLAMVPSYISRSVAGSYDNEAVAIFALIFTFYLYIKTLNTGSLFYATLNSIAYFYMVCSWGGYTFIINLIPIHVLLCIVTGRYSSRLYIAYAPLVVLGTLLAALVPVVGFNAVMTSEHFASFLVFILIHVVAFVYYIKGILSPKMFKVAVALVVSSGLAVGLAMIAVLVAMVASSPTMGWSGRSLSLLDPTYASKYIPIIASVSEHQPPTWPSYFMDINVLAFLVPAGIIACFSPLSDASSFVILYIVTSVYFSGVMVRLMLVLAPAACILSGIALSQAFDVFTRSIKLQLPSLSVDSHVDAGNASSESVVPNDTVKTDKIEDTPKERTSKKSKKKEKEPVEKPPSKSQIKKKLLVLPLETSIIAIILLVLLGAFYVVHSVWAAAEAYSAPSIVLTSHSNDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSMATPTMLNCLMYKLSYYRFVETDGKAFDRVRRTEIGKKYFKLTHFEEVFTTHHWMVRIYKLKPPKNRIRGKIKKSKAKASSKPASKRKELKRNPF

SEQ ID NO: 19732 - protein, 783 aa, Petroselinum crispum
MAAIETANDKALRYAFGNVLCFFILLLIGVLAFSIRLFSVIKYESVIHEFDPYFNYRVTQFLIKNGIYDFWNWFDDRTWYPLGRVIGGTVYPGLTLTAGTLWWILNSLNIPLSVETVCVFTAPIFSAFASWATYFLTKEVKGTGAGLAAAAVLAMVPSYISRSVAGSYDNEAVAIFALIFTFYLYVKTLNTGSLFYATFNAIAYFYMVCSWGGYTFIINLIPMHALLCIVTGRYSSRLYIAYCPLVVLGTLLAALVPVVGFNAVLTSEHFASFLVFIIIHVVALAYYIKGILSPKMFKVAVTLVLSVGLVVCCAVVAVLFALVASSPTKGWSGRSLSLLDPTYASKYIPIIASVSEHQPPTWPSYFMDINVLAFLVPAGIVACFLPLSDASSFVILYIVTSVYFSGVMVRLMLVLAPAACIMSGIALSEAFTVFTRSIKFQLPGISQSHQIDAGDTSSEPSGDVIQNVVKTDKVDEPVKERPLRRNKKKEKENMEKASKPSIKSKIEKRLMVLPLETSIIALLLLVLLGAFYVVHCVWAAAEAYSAPSIVLTSHSHDGLHVFDDFREAYAWLSHNTDVDDKVASWWDYGYQTTAMANRTVIVDNNTWNNTHIATVGTAMSSPEKAAWEIFNSLDVKYVLVVFGGLVGYSSDDINKFLWMVRIGGGVFPHIKEPDYLRDGQYRIDSQATPTMLNCLMYKLSYYRFADTDGGKAFDRVRRTEIGKKNIRLTHFEEVFTTHHWMVRLYKLKPPRNRIRSKTKKSKSKSSSTTNLKRRGTGKKNPWH

SEQ ID NO: 19733 - protein, 787 aa, Theobroma cacao
MAAPEASSAAVPTLMTNNTLRNAFGGVLSFFILLLIGVLAFSIRLFSVIKYESVIHEFDPYFNYRVTQFLTKNGIYEFWNWFDDRTWYPLGRVIGGTVYPGLTLTAGTIWWLLNSLNIPLSVETVCVFTAPIFSAFASWATYLLTKEVKGAGAGLTAAVLLAMVPSYISRSVAGSYDNEAVAIFALIFTFYLYIKTLNTGSLFYATLNSIAYFYMVCSWGGYTFIINLIPMHVLLCIVTGRYSSRLYIAYAPLVVLGTLLAALVPVVGFNAVMTSEHFASFLVFIIIHVVALVYYIKGILSPKMFKVAVTLVISAGLAVCCAVIAVLIALVASSPTKGWSGRSLSLLDPTYASKYIPIIASVSEHQPPTWPSYFMDINVLAFLVPAGIIACFLPLSDASSFVVLYIATSVYFSGVMVRLMLVLAPAACITSGIALSQAFDVFTRSIKFQLPGLSSNTEVDAGETSSATKEAQNDAVKTEKAEETSKDRPSRKSKKKEREHVEKPSTKTKAEKKRLLALPLEASVISLLLLVFLGAFYVVHCVWAAAEAYSAPSIVLTSHSHDGLHVFDDFREAYAWLRHNTDVDDKVASWWDYGYQTTAMANRTVIVDNNTWNNTHIATVGTAMSSPEKAAWEIFHSLDVKYILVVFGGLVGYPSDDINKFLWMVRIGGGVFPHIKEPDYLRDGQYRIDSQATPTMLNCLMYKLSYYRFVETDGKGFDRVRRTEIGKKYFKLTHFEEVFTTHHWMVRIYKLKPQKNRIRGKTKKSKSKTSSTSSSKRSGTRKKNPWH

SEQ ID NO: 19734 - protein, 779 aa, Ricinus communis
MAGSESAKGETTLRYAFGNVLSFFILILIGVLAFSIRLFSVIKYESVIHEFDPYFNYRVTQFLTKKGIYDFWNWFDDRTWYPLGRVIGGTVYPGLTLTAGTLWWLLNSLNIPLSVETVCVFTAPIFSAFASWATYLLTKEVKGAGAGLTAAAILAMVPSYISRSVAGSYDNEAVAIFALIFTFYLYLKTLNTGSLFYATLNALAYFYMVCSWGGYTFIINLIPMHVLLCIVTGRYSSRLYIAYAPLVVLGTLLAALVPVVGFNAVMTSEHFASFLVFIIIHVVAFVYYIKGILSPNMFKVAVTLVVSVGLAVCCAVMAVLIAMVASSPTKGWSGRSLSLLDPTYASKYIPIIASVSEHQPPTWPSYFMDINVLAFLVPAGIIACFLPLSDASSFVVLYIVTSVYFSGVMVRLMLVLAPAACIMSGIALSEAFDVFTRSIKFQLPGVSGNSRVGLEDASSSTVAVQNDAGKTEKPEDIAKERPSKKNKRKEKEVLERPSIRTRIQNRLLVLPLEASIFGILLLVLLGAYYVVHCVWAAAEAYSAPSIVLTSHTHDGGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNSLMYKLSYYRFVETDGKGFDRVRRTEIGKKYFKLTHFEEVFTTHHWMVRIYKLKPQKNRIRGKAKKKSKTSSTPSSKRSRASKRNPWH

SEQ ID NO: 19735 - protein, 778 aa, Glycine max
MAASEALNGTTTTSIRHAFGNVLAFFILLMIGVLAFSIRLFSVIKYESVIHEFDPYFNYRVTQFLTKNGIYDFWNWFDDRTWYPLGRVIGGTVYPGLTLTAGTLWRILNSINIPLSVETVCVFTAPIFSAFASWATYLLTKEVKGVGAGLTAAVLLAMVPSYISRSVAGSYDNEAVAIFALIFTFYLYIKTLNTGSLFYATLNSIAYFYMVCSWGGYTFIINLIPMHVLLCIVTGRYSSRLYIAYAPLVVLGTLLAALVPVVGFNAVMTSEHFASFLVFIIIHVVALVHYIKGILSPKMFKVAVALVVSVGLAVCCAMVAVLIALVASSPTKGWSGRSLSLLDPTYASKYIPIIASVSEHQPPTWPSYFMDINVLAFLVPAGIIACFSPLSDASSFVILYIVTSVYFSGVMVRLMLVLAPAACILSGIALSQAFDVFTRSIKLQLPSLSGHSHVDAGETSSESVVPNDLAKTDKSEDTSKDRTSKKSKKKEKEHVEKPPSKSLIKKRLLVLPLETSIIAIILLVLLGAFYVVHSVWAAAEAYSAPSIVLTSHSHDGIHVFDDFREAYAWLSHNTEIDDKVASWWDYGYQTTAMANRTVIVDNNTWNNTHIATVGTAMSSPEKAAWEIFHSLDVKYVLVVFGGLVGYPSDDINKFLWMVRIGGGVFPHIKEPDYLRDGQYRIDSMATPTMLNSLMYKLSYYRFVETDGKAFDRVRQTEIGKKHFKLTHFEEVFTTHHWMVRIYKLKPPKNRIRGKIKKSKFKASSKSASKRKGLKRNPF

SEQ ID NO: 19736 - protein, 794 aa, Chelidonium majus
MASVENANGVAVAAAAVAGGGGGTSLRYAFGNVLSLFILLLIGVLAFSIRLFSVIKYESVIHEFDPYFNYRVTQFLIKNGIYDFWNWFDDRTWYPLGRVIGGTVYPGLTLTAGTLWKILHSLNIPLSVETVCVFTAPIFSANAAWATYLLTKEVKGTGAGLIAAALLAMVPSYISRSVAGSYDNEAVAIFALIFTFYLYIKTLNTGSLFYATLNALSYFYMVCSWGGYTFIINLIPMHALLCIVTGRYSSRLYVAYAPLVVLGTLLAALVPVVGFNAVLTSEHFASFLVFIIIHVVALVYYIKGILSPKMFKVAVTLVVSVGTVVCLAVVAVLVALVASSPTKGWSGRSLSLLDPTYASKYIPIIASVSEHQPPTWPSYFMDINVLAFLVPAGIIACFLPLSDASSFAILYIVTSVYFSGVMVRLMLVLAPAACIMSGIALSEAFDVFTRSIKFQLPGILGNSTSDAGDVTSGATVQNDVVKADPAAEKSEDTLKERPSKKNRKKEKEPVMKASIKSRIEKRLLVLPLEASVLAILLLILLGAFYVVHCVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDAQATPTMLNCLMYKLSYFRFVETDGKGFDRVRRTEIGKKYFKLTHFEEVFTTHHWMVRIYKLKPQKNRIRGKTKKTKSGSKVSSTSSKRVEGGKKNP

SEQ ID NO: 19737 - protein, 774 aa, Ocimum basilicum
MAEQEASNSATFRHAFGNVLSFSVLLLIGVIAFSIRLFSVIKYESVIHEFDPYFNYRVTQYLVKSGVYDFWNWFDDRTWYPLGRVIGGTVYPGLTLTAGTLWRIFNSLNIPLSVETVCVFTAPIFSAFASWATYLLTKEIKGTGAGLTAAALLAMVPSYISRSVAGSYDNEAVAIFALIFTFYLYVKTLNTGSLFYAILNAIAYFYMVCSWGGYTFIINLIPMHVLLCIVTGRYSSRLYIAYAPLVVLGTLLAALVPVVGFNAVMTSEHFASFLVFIILHVVALVYYIKGILTPKMFKVAVTLVIAVGLIFCFAVLAVLIALVASSPTKGWSGRSLSLLDPTYASKYIPIIASVSEHQPPTWPSYFMDINVLAFLVPAGIIACFLPLSDASSFAILYIVTSVYFSGVMVRLMLVLAPAACIMSGIALSEAFDVFTRSIKFHLVGATENPQGNAGDSSNVTQHDVKTEKSEETLKERPSRKSKKKDKENTEKPSPVSRVQQKLLVLPLETSLLAVLLLVLLGAFYVVHCVWAAAEAYSAPSIVLTSRSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSQATPTMLNCLMYKLSYYRFVDTDGRGFDRVRQTEIGKKHFKLSHFEEVFTTHHWMVRIYKLKSPRNRMRGKTKKSESKSSASTSSKRNGTRKKNPWQ

SEQ ID NO: 19738 - protein, 785 aa, Euphorbia peplus
VAEVAAAAQGGTNLRNAFGNVLSLFILILIGVLAFSIRLFSVIKYESVIHEFDPYFNYRVTQFLTKNGIYDFWNWFDDRTWYPLGRVIGGTVYPGLTLTAGSLWWLLNSLNIPLSVETVCVFTAPIFSAFASWATYLLTKEVKGAGAGLTAAALLAMVPSYISRSVAGSYDNEAVAIFALIFTFYLYIKTLNTGSLFYATLNALAYFYMVCSWGGYTFIINLIPIHVLLCIVTGRYSSRLYIAYAPLVVLGTLLAALVPVVGFNAVMTSEHFASFLVFIIIHVVAFVHYIKGILSPKMFKVAVTLVISVGLVVCCAVIAILVAVVASSPTKGWSGRSLSLLDPTYASKYIPIIASVSEHQPPTWPSYFMDINVLAFLVPAGIVACFLPLSDASSFVILYIVTSVYFSGVMVRLMLVFAPAACIMSGISLSEAFNVLTQSIKFQLPGSSGSYRVDSGNASSSTTVAQDDAAKVENTEETVKERPSKKNKKKDKEREKEVVDKPSVRSRIEKRLLVLPFEASIIGVLLLVLLGAFYVVHCVWAAAEAYSAPSIVLTSHSPDGGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDNQATPTMLNCLMYKLSYFRFVETDGKGFDRVRRTEIGKKHFKLTHFEEVFTTHHWMVRIYKLKPQKNRIRGKVKKSKSKTSSTSSSKRSGATKRNPWQ

SEQ ID NO: 19739 - protein, 773 aa, Ambrosia trifida
MAASTDTTTPSSSSTLRHASGNILAFFILLLIGVLAFSIRLFSVIKYESVIHEFDPYFNYRVTQFLTKNGVYDFWNWFDDRTWYPLGRVIGGTVYPGLTLTAGTMWKVLQFLNIPLSVETVCVFTAPVFSAFAAWATYLLTKEVKGVGAGLTAAVLLAMVPSYISRSVAGSYDNEAVAIFALIFTFYLYIKTLNTGSLFYATLNSMAYFYMVCSWGGYTFIINLIPMHVLLCIVTGRYSPRLYIAYAPLVVLGTLMAALVPVVGFNAVMTSEHFASFLVFIIIHVVALAYYIKGILSPKMFKVAATLVVSVGLVVCCAVVAVLIAVVASSPTKGWSGRSLSLLDPTYASKYIPIIASVSEHQPPTWPSYFMDINILAFLVPAGIIACFSPLSDASSFVILYIVMSAYFSGVMVRLMLVFAPAACIMSGIALSEAFDVFTTSIKFYAFQAVDKVTASTVSTQNNVVETDKKEDSLKERPSKKNKRKEKENVEKPLKKSQTEKRPLILPVEASAFALFLTVLLGAFYVVHSVWAAAEAYSAPSIVLTSHTRDGLHVFDDFREAYAWLSHNTHVDDKVASWWDYGYQTTAMANRTVIVDNNTWNNTHIATVGTAMSSPEKAAWEIFNSLDVKYVLVVFGGLVGYSSDDINKFLWMVRIGGGVFPHIKEPDYLRDGQYRIDSQATPTMLNSLMYKLSYFRFVETDGGKGYDRVRGTEIGKKHFKLTHFEEVFTTHHWMVRIYKLKPQKNRIRGKTKKSRSKTNSTKTRTISKKNPWH

SEQ ID NO: 19740 - protein, 775 aa, Trifolium pratense
MAATDAQTSLRHAFGNVLAFFILILIGVLAFSIRLFSVIKYESVIHEFDPYFNYRVTQFLTKNGIYDFWNWFDDRTWYPLGRVIGGTVYPGLTLTAGTLWWILNSLNIPLSVETVCVFTAPIFSAFASWATYLLTKEVKGPGAGLTAAVLLAMVPSYISRSVAGSYDNEAVAIFALIFTFYLYIKTLNTGSLFYATLNSIAYFYMVCSWGGYTFIINLIPMHALLCIVTGRYSSRLYIAYAPLIVLGTLLAALVPVVGFNAVMTSEHFASFLVFILIHVVALVYYIKGILSPKMFKVAVALVVSGGLAVCFAMIAVLVAMVASSPTMGWSGRSLSLLDPTYASKYIPIIASVSEHQPPTWPSYFMDINVLAFLVPAGIIACFSPLSDASSFVILYIVTSVYFSGVMVRLMLVLAPAACILSGIALSQAFDVLTRSIKLQLPSLLVDSPVDAGDASSESVVPDDTVKTDKTEDTQKERTSKKGRSRKSSSENVEKPPSKSQIKKRLSVLPLETSIIAIVLLVLLGAFYVVHSVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFHSLDVKYVLVVFGGLVGYPSDDINKFLWMVRIGGGVFPHIKEPDYLRDGQYRIDNMATPTMLNSLMYKLSYYRFVETDGKAFDRVRRTEIGKKYFKLTHFEEVFTTHHWMVRIYKLKPPKNRIRGKTKKSKSKTSPKTPSKRKELKRNPF

SEQ ID NO: 19741 - protein, 779 aa, Arabidopsis thaliana
MAALESPLPGTPTAMRNAFGNVLSVLILVLIGVLAFSIRLFSVIKYESVIHEFDPYFNYRVTQFLSKNGIYEFWNWFDDRTWYPLGRVIGGTVYPGLTLTAGTIWWGLNSLNIPLSVETVCVFTAPVFSAFASWATYLLTKEVKGSGAGLAAAALLAMVPSYISRSVAGSYDNEAVAIFALIFTFYLYIKTLNTGSLFYATLNALAYFYMVCSWGGYTFIINLIPMHVLLCIVTGRYSPRLYIAYAPLVVLGTLLAALVPVVGFNAVLTSEHFASFLVFIIIHVVALVYYIKGILSPKMFKVAVTLVVSIGMVVCFIVVAILVALVASSPTGGWSGRSLSLLDPTYASKYIPIIASVSEHQPPTWPSYFMDINVLAFLVPAGIIACFSPLSDASSFVVLYIVMSVYFSGVMVRLMLVLAPAACIMSGIALSQAFDVFTGSIKYQLGASSNSTDDAEDNTSTNNAPKDDVSAGKTDKGEEIVKERSSKKGKKKEREPADKPSVKAKIKKKALVLPLEASIVALLLLIMLGAFYVIHCVWAAAEAYSAPSIVLTSQSRDGLHVFDDFRESYAWLSHNTDVDDKVASWWDYGYQTTAMANRTVIVDNNTWNNTHIATVGTAMSSPEKAAWEIFNSLDVKYVLVVFGGLIGYPSDDINKFLWMVRIGGGVFPHIKEADYLRDGQYRIDSEATPTMLNSLMYKLSYYRFVETDGKGYDRVRRTEIGKKHFKLTHFEEVFTSHHWMVRLYKLKPPRNRIRGKAKKLKSKTSSGLSSKSAKKNPWV

SEQ ID NO: 19742 - protein, 788 aa, Gossypium hirsutum
  Sequence also found in Organisms: Gossypium raimondii
MAAPETSTAAVPTLYTNNTLRNAFGGVLSFFILLLIGVMAFSIRLFSVIKYESVIHEFDPYFNYRVTQFLAKNGIYEFWNWFDDRTWYPLGRVIGGTVYPGLTLTAGTIWWLLNSLNIPLSVETVCVFTAPIFSAFASWATYLLTKEVKGTGAGLTAAALLAMVPSYISRSVAGSYDNEAVAIFALIFTFYLYIKTLNTGSLFYATLNSISYFYMVCSWGGYTFIINLIPMHVLLCIVTGRFSSRLYIAYAPLVVLGTLLAALVPVVGFNAVMTSEHFASFLVFIIIHVVAFVYYIKGILSPKMFKVAVTLVVSVGLAVCCAVIAVLIALVASSPTKGWSGRSLSLLDPTYASKYIPIIASVSEHQPPTWPSYFMDINVLAFLVPAGIIACFLPLSDASSFVVLYIATSVYFSGVMVRLMLVLAPAACITSGIALSQAFDVFTGSIKFQLTGASSNTEVDAAETSSSTAESQTDAVKTEKPEETAKNRPSRKSKKKEREHGEKPSTKAKAEKKRLLALPLESSVISLLLLVLLGAFYVVHCVWAAAEAYSAPSIVLTSRSHDGLHVFDDFREAYAWLRHNTDVDDKVASWWDYGYQTTAMANRTVIVDNNTWNNTHIATVGTAMSSPERAAWEIFHSLDVKYVLVVFGGLVGYPSDDINKFLWMVRIGGGVFPHIKEPDYLRDGQYRIDSQATPTMLNCLMYKLSYYRFVETDGKGFDRVRQTEIGKKYFKLTHFEEAFTTHHWMVRIYKLKPPKNRIRGKTKKSKSKTSSTTSSPKRSGTKKKNPWQ

SEQ ID NO: 19743 - protein, 782 aa, Musa acuminata
MAASSETKGEGTLRKAFGGVLGFFILLLIGALAFSIRLFSVIKYESVIHEFDPYFNYRVTQFLTKNGIYDFWNWFDDRTWYPLGRVIGGTVYPGLTLTAGSIWWLLNNLNIPLSVETVCVFTAPIFSANASWATYLLTKEVKGTGAGLTAAALLAMVPSYISRSVAGSYDNEAVAIFALIFTFYLYTKTLNTGSLFYATLNALSYFYMVCSWGGYTFIINLIPMHVLLCIVTGRYSPRLYIAYAPLVVLGTLLASLVPVVGFNAVMTSEHFASFLVFIIIHVVALVYYIKGILSPKMFKVAVTLVVTIGIAVCCAVLAILIALVASSPTKGWSGRSLSLLDPTYASKYIPIIASVSEHQPPTWPSYFMDINVLAFLVPAGIVACFLPLSDASSFMVLYITTSVYFSGVMVRLMLVLAPAACIMSGIALSEAFDVFTRSIKLQLPKLFESPPPGSGDIDSAQDEVVKVDNKAATDKSETAPKERPSKKNRKKEKEIVETTIKRPLKAKRLLVLPLEASAVAILLLIILGAFYVVHCVWAAAEAYSAPSIVLTSHSHDGLHVFDDFREAYAWLRHNTDVDDKVASWWDYGYQTTAMANRTVIVDNNTWNNTHIATVGTAMSSPEKPAWEIFNSLDVKYVLVVFGGLVGYPSDDINKFLWMVRIGGGVFPHIREPDYLRDGQYRIDAQATPTMLNCLMYKLSYYRFVETDGKGFDRVRRTEIGKKHFKLTHFEEVFTTHHWMVRIYKLKPPKNRIRGKSKKSKSNSKTSPSNSKRHGNLRKNPWQ

SEQ ID NO: 19744 - protein, 771 aa, Chrysanthemum coronarium
MAASTDTTTTSLRHASGHILAFFILLLIGVLAFSIRLFSVIKYESVIHEFDPYFNYRVTQFLTKNGIYDFWNWFDDRTWYPLGRVIGGTVYPGLTLTAGTMWKVLQSLNIPLSVETVCVFTAPVFSAFAAWATYLLTKEVKGAGAGLTAAVLLAMVPSYISRSVAGSYDNEAVAIFALIFTFYLYIKTLNTGSLFYATLNSISYFYMVCSWGGYTFIINLIPMHVLLCIVTGRYSPRLYIAYAPLVVLGTLLAALVPVVGFNAVMTSEHFASFLVFIIIHVVALAYYIKGMLSPKMFKVAATLVVSVGLVVCCAVVAVLIAVVASSPTKGWSGRSLSLLDPTYASKYIPIIASVSEHQPPTWPSYFMDINILAFLVPAGIIACFSPLSDASSFVILYIVMSAYFSGVMVRLMLVFAPAACIMSGIALSEAFDVFTRSIKFYASESSENVQNEAGDNVMKTDTKEEILKERPSKKNKKKEKENNVEKPTKKSHTEKRALVLPVGLSVFSLFLIVLLAAFYVVHSVWAAAEAYSAPSIVLTSYSPDGGLHVFDDFREAYAWLSHNTEVDDKVASWWDYGYQTTAMANRTVIVDNNTWNNTHIATVGTAMSSPEKAAWEIFNSLDVKYVLVVFGGVVGYSSDDINKFLWMVRIGGGVFPHIKEPDYLRDGQYRIDSQATPTMLNSLMYKLSYFRFWETDGGKGYDRVRRTEIGRKHFKLTHFEEVFTTHHWMVRIYQLKPQKNRIRGKTKKSRSKTSSSTPTKTRTITKKNPWH

SEQ ID NO: 19745 - protein, 777 aa, Triphysaria pusilla
MAVPETSNQTALRHAFGNVISFLVLLLIGALAFSIRLFSVIKYESVIHEFDPYFNYRVTQFLTKSGVYDFWNWFDDRTWYPLGRVIGGTLYPGLMLTAGTLWRVFNALNIPLSVETVCVFTAPIFSAFASWATYLLTKEVKGAGAGLTAAALLAMVPSYISRSVAGSYDNEAVAIFALILTFYLYIKTLNTGSLFYATLNAIAYFYMVCSWGGYTFIINLIPMHVMLCIVTGRYSSRLYIAYAPLVVLGTLLAALVPVVGFNAVLTSEHFASFLVFIIIHVVALVYHIKGILSPQMFKVAVTLVVSAGLIVCGAVLAVLVALVASSPTKGWSGRSLSLLDPTYASKYIPIIASVSEHQPPTWPSYFMDINVLAFLVPAGIIACFLPLSDASSFAVLYIVTAVYFSGVMVRLMLVLAPAACIMSGIALSEAFHVFTRSIKFHLLSATESPNVNAGDTTTVAQNNVVKTEKNEDAPKEKSSKKNKKKEKENVERVSLVSRIEQKLLVLPLETSLVAVFLLVLLGAFYVVHCVWAAAEAYSAPSIVLTSHTNDGLHVFDDFREAYSWLSHNTEVDDKVASWWDYGYQTTAMANRTVIVDNNTWNNTHIATVGTAMSSPEKAAWDIFNSLDVKYVLVVFGGLVGYPSDDINKFLWMVRIGGGVFPHIKEPDYLRDGQYRIDSQATPTMLNSLMYKLSYYRFVETDGGRGFDRVRNTEIGKKYFKLTHFEEVFTTHHWMVRIYKLKTPRNRIRGKTKKSKSRGGSTTSSKRSGTKKKINPWN

SEQ ID NO: 19746 - protein, 755 aa, Papaver somniferum
ILLLIGILGFSIRLFSVIKYESVIHEFDPYFNYRVTQFLIKNGIYDFWNWFDDRTWYPLGRVIGGTVYPGLTLTAGTLYKILHALNIPLSVETVCVFTAPIFSAFAAWATFLLTKEVKGTGAGLTAAALLAMVPSYISRSVAGSYDNEAVAIFALIFTFYLYIKTLNTGSLFYATLNALAYFYMVCSWGGYTFIINLIPMHVLLCIGTGRYSSRLYVAYAPLVVLGTLLAALVPVVGFNAVMTSEHFASFLVFIIIHVVALVYYIKGVLSPKMFKVAVTLVVSVGMVVCIAVVAILVAVVASSPTKGWSGRSLSLLDPTYASKYIPIIASVSEHQPPTWPSYFMDINVLAFLVPAGIISCFLPLSDASSFAVLYIVTSVYFSGVMVRLMLVFAPAACIMAGIALSGAFDVFTSSVKFQLPGLLGDSDAGDITSGDVVQNGVTKADSNAAAEKSEETLKERPSKKNKKKEKEPVVKASIKSKIQKRLLVLPLEASIIALLLLILLGAFYVIHCVWAAAEAYSAPSIVLTSQSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDNQATPTMLNSLMYKLSYYRFVETDGKGYDRVRRTEIGKKHFKLTHFEEVFTTHHWMVRLYKLKPPRNRIKGKTKKSKASSKSSSTSTKGKKNPWH

SEQ ID NO: 19747 - protein, 778 aa, Brassica oleracea
MAAVESPPPGTPSAMRNAFGTVLSALILVLIGVLAFSIRLFSVIKYESVIHEFDPYFNYRVTQFLSKNGIYEFWNWFDDRTWYPLGRVIGGTVYPGLTLTAGTIWWVLNSINIPLSVETVCVFTAPVFSAFASWATYLLTKEVKGSGAGLAAAALLAMVPSYISRSVAGSYDNEAVAIFALIFTFYLYIKTLNTGSLFYATLNAIAYFYMVCSWGGYTFIINLIPMHVLLCIVTGRYSPRLYIAYAPLVVLGTLLAALVPVVGFNAVLTSEHFASFLVFIIIHVVALVYYIKGILTPKMFKVAVTLVVSIGLVVCLIVVAVLVALVASSPTGGWSGRSLSLLDPTYASKYIPIIASVSEHQPPTWPSYFMDINVLAFLVPAGIIACFSPLSDASSFVVLYIVMSVYFSGVMVRLMLVLAPAACIMSGIALSQAFDVFTGSIKYQLSSKSKDDAEDNTSTKNAPKDDASSGKTDKGEEVSKERSSKKGKKKEREPAEKPSVKSKIVKKKALVLPLEASIVALLLLIMLGAFYVIHCVWAAAEAYSAPSIVLTSQSHDGLHVFDDFRESYAWLSHNTDVDDKVASWWDYGYQTTAMANRTVIVDNNTWNNTHIATVGTAMSSPEKAAWEIFNSLDVKYVLVVFGGVIGYPSDDINKFLWMVRIGGGEFPHIKEADYLRDGQYRIDSEATPTMLNCLMYKLCYYRFVETDGKGYDRVRRTEIGKKHFKLTHFEEVFTSHHWMVRIYKLKPQKNRIRGRVKKLKQKTSSGVSSKSVKKNPWM

SEQ ID NO: 19748 - protein, 778 aa, Brassica napus
MAAVESLPPGTPSAMRNAFGTVLSALILVLIGVLAFSIRLFSVIKYESVIHEFDPYFNYRVTQFLSKNGIYEFWNWFDDRTWYPLGRVIGGTVYPGLTLTAGTIWWVLNAINIPLSVETVCVFTAPVFSAFASWATYLLTKEVKGSGAGLAAAALLAMVPSYISRSVAGSYDNEAVAIFALIFTFYLYIKTLNTGSLFYATLNAIAYFYMVCSWGGYTFIINLIPMHVLLCIVTGRYSPRLYIAYAPLVVLGTLLAALVPVVGFNAVLTSEHFASFLVFIIIHVVALVYYIKGILTPKMFKVAVTLVVSIGLVVCLIVVAVLVALVASSPTGGWSGRSLSLLDPTYASKYIPIIASVSEHQPPTWPSYFMDINVLAFLVPAGIIACFSPLSDASSFVVLYIVMSVYFSGVMVRLMLVLAPAACIMSGIALSQAFDVFTGSIKYQLSSKSKDDAEDNTSTKNAPKDDASSGKTDKGEEVAKERSSKKGKKKEREPAEKPSVKSKIVKKKALVLPLEASIVALLLLIMLGAFYVIHCVWAAAEAYSAPSIVLTSQSHDGLHVFDDFRESYAWLSHNTDVDDKVASWWDYGYQTTAMANRTVIVDNNTWNNTHIATVGTAMSSPEKAAWEIFNSLDVKYVLVVFGGVIGYPSDDINKFLWMVRIGGGEFPHIKEADYLRDGQYRIDSEATPTMLNCLMYKLCYYRFVETDGKGYDRVRRTEIGKKHFKLTHFEEVFTSHHWMVRIYKLKPQKNRIRGRVKKLKQKTTSGVSSKSVKKNPWM

SEQ ID NO: 19749 - protein, 773 aa, Chrysanthemum coronarium
MAASTDTPATTTTFRHASGHILAFFILLLIGVLAFSIRLFSVIKYESVIHEFDPYFNYRVTQFLTKNGIYDFWNWFDDRTWYPLGRVIGGTVYPGLTLTAGTMWKVLQSLNIPLSVETVCVFTAPVFSAFAAWATYLLTKEVKGPGAGLTAAVLLAMVPSYISRSVAGSYDNEAVAIFALIFTFYLYIKTLNTGSLFYATLNSIAYFYMVCSWGGYTFIINLIPMHVLLCIVTGRYSPRLYIAYAPLVVLGTLLAALVPVVGFNAVMTSEHFASFLVFIIIHVVALAYYIRGMLSPKMFKVAATLVVSVGLVVCCAVVAVLIAVVASSPTKGWSGRSLSLLDPTYASKYIPIIASVSEHQPPTWPSYFMDINILAFLVPAGIIACFSPLSDASSFVILYIVMSAYFSGVMVRLMLVFAPAACIMSGIALSEAFDVFTRSIKFYASESSENVQNEAGDNVMKTDTKEEILKERPSKKNKKKEKENNVEKPTKKSHTEKRALVLPVGLSVFSLFLIVLLAAFYVVHSVWAAAEAYSAPSIVLTSHSPDGGLHVFDDFREAYAWLSHNTEVDDKVASWWDYGYQTTAMANRTVIVDNNTWNNTHIATVGTAMSSPEKAAWEIFNSLDVKYVLVVFGGVVGYSSDDINKFLWMVRIGGGVFPHIKEPDYLRDGQYRIDSQATPTMLNSLMYKLSYFRFWETDGGKGYDRVRRTEIGRKHFKLTHFEEVFTTHHWMVRIYKLKPQKNRIRGKTKKSRSKTSSSTPTKTRTITKKNPWH

SEQ ID NO: 19750 - protein, 779 aa, Arabidopsis lyrata
MAALESPQPGTPTAMRNAFGNVLSVLILVLIGVLAFSIRLFSVIKYESVIHEFDPYFNYRVTQFLSKNGIYEFWNWFDDRTWYPLGRVIGGTVYPGLTLTAGTIWWVLNSLNIPLSVETVCVFTAPVFSAFASWATYLLTKEVKGSGAGLAAAALLAMVPSYISRSVAGSYDNEAVAIFALIFTFYLYIKTLNTGSLFYATLNALAYFYMVCSWGGYTFIINLIPMHVLLCIVTGRYSPRLYIAYAPLVVLGTLLAALVPVVGFNAVLTSEHFASFLVFIIIHVVALVYYIKGILSPKMFKVAVTLVVSIGMVVCFIVVAILVALVASSPTGGWSGRSLSLLDPTYASKYIPIIASVSEHQPPTWPSYFMDINVLAFLVPAGIIACFSPLSDASSFVVLYIVMSVYFSGVMVRLMLVLAPAACIMSGIALSQAFDVFTGSIKYQLGASSNSTDDAEDNTSTNNAPKDDASAGKTDKGEEIVKERSSKKGKKKEREPADKPSVKSKIKKKALVLPLEASIVALLLLIMLGAFYVIHCVWAAAEAYSAPSIVLTSQSRDGLHVFDDFRESYAWLSHNTDVDDKVASWWDYGYQTTAMANRTVIVDNNTWNNTHIATVGTAMSSSEKAAWEIFNSLDVKYVLVVFGGLIGYPSDDINKFLWMVRIGGGVFPHIKEADYLRDGQYRIDSEATPTMLNCLMYKLSYYRFVKTDGKGYDRVRRTEIGKKNFKLTHFEEVFTSHHWMVRIYKLKPPRNRIRGRTKKLKSKTSSGLSSKSVKKNPWI

SEQ ID NO: 19751 - protein, 778 aa, Brassica rapa
MAAVESLPPGTPSAMRNAFGTVLSALILVLIGVLAFSIRLFSVIKYESVIHEFDPYFNYRVTQFLSKNGIYEFWNWFDDRTWYPLGRVIGGTVYPGLTLTAGTIWWVLNAINIPLSVETVCVFTAPVFSAFASWATYLLTKEVKGSGAGLAAAALLAMVPSYISRSVAGSYDNEAVAIFALIFTFYLYIKTLNTGSLFYATLNAIAYFYMVCSWGGYTFIINLIPMHVLLCIVTGRYSPRLYIAYAPLVVLGTLLAALVPVVGFNAVLTSEHFASFLVFIIIHVVALVYYIKGILTPKMFKVAVTLVVSIGLVVCLIVVAVLVALVASSPTGGWSGRSLSLLDPTYASKYIPIIASVSEHQPPTWPSYFMDINVLAFLVPAGIIACFSPLSDASSFVVLYIVMSVYFSGVMVRLMLVLAPAACIMSGIALSQAFDVFTGSIKYQLSSKSKDDAEDNTSTKNAPKDDASSGKADKGEEVAKERLSKKGKKKEREPAEKPSVKSKIVKKKALVLPLEASIVALLLLIMLGAFYVIHCVWAAAEAYSAPSIVLTSQSHDGLHVFDDFRESYAWLSHNTDVDDKVASWWDYGYQTTAMANRTVIVDNNTWNNTHIATVGTAMSSPEKAAWEIFNSLDVKYVLVVFGGVIGYPSDDINKFLWMVRIGGGEFPHIKEADYLRDGQYRIDSEATPTMLNCLMYKLCYYRFVETDGKGYDRVRRTEIGKKHFKLTHFEEVFTSHHWMVRIYKLKPQKNRIRGRVKKLKQKTSSGVSSKSVKKNPWM

SEQ ID NO: 19752 - protein, 780 aa, Cyclamen graecum
MAAPDAATGSSLRSAFGNVLSIFILILIGVLAFSIRLFSVIKYESVIHEFDPYFNYRVTQFLTKNGIYDFWNWFDDRTWYPLGRVIGGTVYPGLTLTAGTMWKILHSLNIPLSVETVCVFTAPVFSANAAWATYLLTKEVKGTGAGLTAAALLGMVPSYISRSVAGSYDNEAVAIFALIFTFYLYIKTLNTGSLFYATLNAIAYFYMVCSWGGYTFIINLIPMHVLLCIVTGRYSSRLYIAYAPLVVLGTLLAALVPVVGFNAVLTSEHFASFLVFIIIHVVALAYYIKGILSPKMFKVAATLVVSVGLIVCVAVIAILIALVASSPTKGWSGRSLSLLDPTYASKYIPIIASVSEHQPPTWPSYFMDINVLAFLVPAGIVACFLPLTDASSFVVLYIVTSVYFSGVMVRLMLVLAPAACILSGIALSESFDVFTRSIKFQLLGRPQNSETDAAGDTSPSSITANNETMKSQKSDESLKERPSRKNEDSSKERLSKKSKKKENVEKATVKPVKPKTGKRLLILPLEASIIAIFLLVLLVAFYVVHCVWAAAEAYSAPSIVLTSQTNDGLHVFDDFREAYGWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEADYLRDGQYRIDSEATPTMLNCLMYKLSYYRFVETDGKGFDRVRRTPIGKKYFKLTHFEEVFTTHHWMVRIYKLKPPKNRIRGKTKKSKTKTSSTRSK

SEQ ID NO: 19753 - protein, 777 aa, Eutrema halophilum
MAALESPPPGTPSAMRHAFGSVLSALILLLIGVLAFSIRLFSVIKYESVIHEFDPYFNYRVTQFLSKNGIYEFWNWFDDRTWYPLGRVIGGTVYPGLTLTAGTIWWVLNSLNIPLSVETVCVFTAPVFSAFASWATYLLTKEVKGSGAGLAAAALLAMVPSYISRSVAGSYDNEAVAIFALIFTFYLYIKTLNTGSLFYATLNAIAYFYMVCSWGGYTFIINLIPMHVLLCIVTGRYSPRLYIAYAPLVVLGTLLAALVPVVGFNAVLTSEHFASFLVFIIIHVIALVYYIKGILSPKMFKVAVTLVVSIGLVVCFIVVAVLVALVASSPTKGWSGRSLSLLDPTYASKYIPIIASVSEHQPPTWPSYFMDINVLAFLVPAGIVACFSPLSDASSFVVLYIVMSVYFSGVMVRLMLVLAPAACIMSGIALSQAFDVFTASIKYHLSGSSNSKDDAEDKTSTNNASKDDGSAGKTDKGEESAKERSSRKGKKKEREPADKPSVKSKIVKKKALVLPFEASIVALLLLIMLGAFYVIHCVWAAAEAYSAPSIVLTSQSRDGLHVFDDFRESYAWLSHNTDVDDKVASWWDYGYQTTAMANRTVIVDNNTWNNTHIATVGTAMSSPEKAAWEIFNSLDVKYVLVVFGGLIGYPSDDINKFLWMVRIGGGVFPHIKEADYLRDGQYRIDSEATPTMLNCLMYKLSYYRFVETDGKGFDRVRRTEIGKKNFKLTHFDEVFTSHHWMVRIYKLKPQKNRIRGRAKKLKLKTSSSKSAKKNPWI

SEQ ID NO: 19754 - protein, 778 aa, Chrysanthemum coronarium
MAVPVDTVTKQPPPPSSSLRFAFGNVLAFFILLLIGVLAFSIRLFSVIKYESVIHEFDPYFNYRVTQFLTKNGIYDFWNWFDDRTWYPLGRVIGGTVYPGLTLTAGTIWKVLQSLNIPLSVETVCVFTAPVFSAFAAWATYLLTKEVKGTGAGLTAAVLLAMVPSYISRSVAGSYDNEAVAIFALIFTFYLYIKTLNTGSLFYATLNSISYFYMVCSWGGYTFIINLIPMHVLLCIVTGRYSSRLYIAYAPLVVLGTLLAALVPVVGFNAVMTSEHFASFLVFIVIHVVALAYYIKGILSPKMFKVAATLVVSVGLVVCLAVVGVLVAVVASSPTKGWSGRSLSLLDPTYASKYIPIIASVSEHQPPTWPSYFMDLNVLAFLVPAGIIACFSPLSDASSFVILYIVMSAYFSGVMVRLMLVFAPAACIMSGIALSEAFDVFTRSIKFYASESSENVQNEAGDNVMKTDTKEEILKERPSKKNKKKEKENIVEKPTKKPHTGKRALVLPVGLSVFSLFLIVLLAAFYVVHSVWAAAEAYSAPSIVLTSHSPDGGLHVFDDFREAYAWLSHNTEVDDKVASWWDYGYQTTAMANRTVIVDNNTWNNTHIATVGTAMSSPEKAAWEIFNSLDVKYVLVVFGGVVGYSSDDINKFLWMVRIGGGVFPHIKEPDYLRDGQYRIDAQATPTMLNSLMYKLSYFRFWETDGGKGYDRVRRTEIGKKHYKLTHFEEVFTTHHWMVRIYKLKPQKNRIRGKTKRSRSKTSSSTSTKTRTITKKNPWH

SEQ ID NO: 19755 - protein, 777 aa, Eutrema parvulum
MAALESPPPGTSSAMRNAFGTVLSALILVLIGVLAFSIRLFSVIKYESVIHEFDPYFNYRVTQFLSKNGIYEFWNWFDDRTWYPLGRVIGGTVYPGLTLTAGTIWWVLNAINIPLSVETVCVFTAPVFSAFASWATYLLTKEVKGSGAGLAAAALLAMVPSYISRSVAGSYDNEAVAIFALIFTFYLYIKTLNTGSLFYATLNAIAYFYMVCSWGGYTFIINLIPMHVLLCIVTGRYSPRLYIAYAPLVVLGTLLAALVPVVGFNAVLTSEHFASFLVFIIIHVVALVYYIKGILSPKMFKVAVTLVVSIGLVVCLIAVAVLVALVASSPTGGWSGRSLSLLDPTYASKYIPIIASVSEHQPPTWPSYFMDINVLAFLVPAGIIACFSPLSDASSFVVLYIVMSVYFSGVMVRLMLVLAPAACIMSGIALSQAFDVFTASIKYQLGGSSNSKDDAEDNTSTNNSPKDDVSSGKTDKGEEVAKERSSKKGKKKEREPAEKPSVKSKIVKKKALVLPLEASIVALLLLIMLGAFYVIHCVWAAAEAYSAPSIVLTSQSRDGLHVFDDFRESYAWLSHNTDVDDKVASWWDYGYQTTAMANRTVIVDNNTWNNTHIATVGTAMSSPEKAAWEIFNSLDVKYVLVVFGGLIGYPSDDINKFLWMVRIGGGVFPHIKEADYLRDGQYRIDSEATPTMLNCLMYKLSYYRFVETDGKGFDRVRRTEIGKKNFKLTHFDEVFTSHHWMVRIYKLKPQKNRIRGRAKKLKLKTSSSKSAKKNPWI

SEQ ID NO: 19756 - protein, 783 aa, Chenopodium quinoa
MADTETANGSSLRNAFGNVLAVFILILIGVLAFSIRLFSVIKYESVIHEFDPYFNYRVTQFLTKNGIYDFWNWFDDRTWYPLGRVIGGTVYPGLTLTAGTMWWLLHSVNIPLSVETVCVFTAPVFSAFASWATYFLTKEVKGPGAGLTAALLLGMVPSYISRSVAGSYDNEAVAIFALIFTFYLYVKTLNTGSLFYATLNAIAYFYMVCSWGGYTFIINLIPMHVLLCIVTGRYSNRLYIAYAPLVVLGTLLAALVPVVGFNAVLTSEHFASFLVFIIIHVVALVYYIKGILSPQMFKVAVTLVVTGGLAVCFAVAAILIALVASSPTMGWSGRSLSLLDPTYASKYIPIIASVSEHQPPTWPSYFMDINVLAFLVPAGIIACFSPLSDASSFVVLYIVMSVYFSGVMVRLMLVLAPAACIMSGIALSEAFDVFARSIKFQLPSLLETPPDEAGEVSSGNAEIQKIVAKTDKNEDAIKERPSKKGKKKEKEKEKEKEVPERAPVRSRVGRRLLVLPFEASLIALFLTVLLGGFYVVHCVWAAAEAYSAPSIVLTSHTHDGLHVFDDFREAYAWLSHNTEVDDKVASWWDYGYQTTAMANRTVIVDNNTWNNTHIATVGTAMSSPEKAAWEIYNSLDVKYVLVVFGGLVGYPSDDINKFLWMVRIGGGVFPHIKEPDYLRDGQYRIDSQATPTMLNSLMYKLSYYRFVETDGKGYDRVRRTEIGKKHFKLTHFEEAFTSHHWMVRIYKLKPPKNRLRGKIKKSKSKTSSASSKRSSTVKRNPWQ

SEQ ID NO: 19757 - protein, 755 aa, Helianthus annuus
MAASTDTTAAAPSSTLRHASGNILAFFILLLIGVLAFSIRLFSVIKYESVIHEFDPYFNYRVTQFLTKSGVYDFWNWFDDRTWYPLGRVIGGTVYPGLTLTAGTMWKVLQMLNIPLSVETVCVFTAPVFSAFAAWATYLLTKEVKGVGAGLTAAVLLAMVPSYISRSVAGSYDNEAVAIFALIFTFYLYIKTLNTGSLFYATLNSMAYFYMVCSWGGYTFIINLIPMHVLLCIVTGRYSPRLYIAYAPLVVLGTLMAALVPVVGFNAVMTSEHFASFLVFIIIHVVALAYYIKGILSPKMFKVAVTLVVSVGLVVCCAVVAVLIAVVASSPTKGWSGRSLSLLDPTYASKYIPIIASVSEHQPPTWPSYFMDINILAFLVPAGIIACFSPLSDASSFVILYIVMSAYFSGVMVRLMLVFAPAACIMSGIALSEAFDVFTRSIKFYAFQAVDTVSASTVSPQNNVVETDKKEDVLKERPSRKNKKKEKETVEKPLKKSETEKRPLILPVEASAIALFLTVLLGAFYVVHSVWAAAEAYSAPSIVLTSHTRDGLHVFDDFREAYAWLSHNTHVDDKVASWWDYGYQTTAMANRTVIVDNNTWNNTHIATVGTAMSSPEKAAWEIFNSLDVKYVLVVFGGLVGYSSDDINKFLWMVRIGGGVFPHIKEPDYLRDGQYRIDSQATPTMLNSLMYKLSYFRFVETDGGKGYDRVRGTEIGKKHFKLTHFEEVFTTHHWMVRIYKLKPQRNRIRGKTKKSR

SEQ ID NO: 19758 - protein, 782 aa, Silene vulgaris
AATESAINTGSSLRHASGNVLAVFILILIGVLAFAIRLFSVIKYESVIHEFDPYFNYRVTQFLTKNGIYDFWNWFDDRTWYPLGRVIGGTVYPGLTLTAGTLWWLLNSLNIPLTVETVCVFTAPIFSAFASWATYLLTKEVKGTGAGLTAALLLGMVPSYISRSVAGSYDNEAVAIFALIFTFYLYVKTLNTGSLFYATLNAIAYFYMVCSWGGYTFIINLIPMHVLLCIVTGRYSHRLYIAYAPLIVLGTLLAALVPVVGFNAVLTSEHFASFLVFIILHVVAFVYYIKGTLSPQMFKVAVTLVVSIGMAVCFAVAAVLVALVASSPTMGWSGRSLSLLDPTYASKYIPIIASVSEHQPPTWPSYFMDINVLAFLVPAGIVSCFLPLSDASSFVILYIVTSVYFSGVMVRLMLVFAPAACILSGIALSEAFDVFARSIKFQLPTILDTSENEAGVLSSGSAGLQNDVVKANKGDDVTKDRPLKKGKKKEKEKEKESAGTASLKSRLEKRLLVLPLEASIIALLLTIFLGGFYVIHCVWAAAEAYSAPSIVLTSHTHDGLHVFDDFREAYAWLSHNTEVDDKVASWWDYGYQTTAMANRTVIVDNNTWNNTHIATVGTAMSSPEKAAWEIFDSLDVKYVLVVFGGLVGYPSDDINKFLWMVRIGGGEFPHIKEPDYLRDGQYRIDSEATPTMLNSLMYKLCYYRFVETDGKGYDRVRRTEIGKKYFKLTHFEEAFTSHHWMVRIYKLKPQKNRIRGKGKKLKSKTSSTASKRSTNTRRNPWH

SEQ ID NO: 19759 - protein, 809 aa, Malus domestica
MAASETSNGTTLRHAFGNVLSFFILILIGVLAFSIRLFSVIKYESVIHEFDPYFNYRVTQFLTKNGIYDFWNWFDDRTWYPLGRVIGGTVYPGLTLTAGSLWWFLNSLNIPLSVETICVFTAPIFSAFTSWATYLLTREVKGAGAGLTAAALIAMVPSYISRSVAGSYDNEAVAIFALIFTFYLYIKTLNTGSLFYATLNAIAYFYMVCSWGGYTFIINLIPMHVLLCIVTGRYSSRLYIAYAPLVVLGTLLAALVPVVGFNAVMTSEHFASFLVFIILHVVALVYYIKGILSPKMFKVAVTLVVSIGLLVCLAVVAVLVALVASSPTKGWSGRSLSLLDPTYASKYIPIIASVSEHQPPTWPSYFMDINVLAFLVPAGIIACFSPLSDASSFVILYIVTSVYFSGVMVRLMLVLAPAACIMSGIALSEAFDVFTRSIKFQLPGLLVPSQVDAGETSSENTVSQNEVPKTDKRADTLKERPSRKNRKKEKEPVEKPSIKSQIEKRLLVLPFEGSILAIFLLVLLGAFYVVHCVWAAAEAYSAPSIVLTSHSHDGLHVFDDFREAYAWLSHNTEVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDNQATPTMLNSLMYKLCYYRFVDTDGKGFDRVRQTEIGKKHFKLTHFEEVFTTHHWMVRLYKLKPPKNRIRGKTKKSKSKSSSTSSTKRRNEKESLALICGHVSVISYNIYTETLRGPLEKVIESRHSFS

SEQ ID NO: 19760 - protein, 780 aa, Brassica oleracea
MATLESPPPGTPSAMRNAFGTVLSALILLLIGVLAFSIRLFSVIKYESVIHEFDPYFNYRVTQFLSKNGIYEFWNWFDDRTWYPLGRVIGGTVYPGLTLTAGTIWWALNAINIPLSVETVCVFTAPVFSAFASWATYLLTKEVKGSGAGLAAAALLAMVPSYISRSVAGSYDNEAVAIFALIFTFYLYIKTLNTGSLFYATLNAIAYFYMVCSWGGYTFIINLIPMHVLLCIVTGRYSPRLYIAYAPLVVLGTLLAALVPVVGFNAVLTSEHFASFLVFIIIHVVALVYYIKGILSPKMFKVAVTLVVSIGLVVCLIVVAVLVALVASSPTGGWSGRSLSLLDPTYASKYIPIIASVSEHQPPTWPSYFMDINVLAFLVPAGIIACFSPLSDASSFVVLYIVMSVYFSGVMVRLMLVLAPAACIMSGIALSQAFDVFTASIKYQLGRSANSKDDAEDNTSTNNAPKDDSSSGKTDKGEEVAKERSSKKGKKKEREPADKPSVKSKILKKRALVLPLEASIVALLLLIMLGAFYVIHCVWAAAEAYSAPSIVLTSQSRDGLHVFDDFRESYAWLSHNTDVDDKVASWWDYGYQTTAMANRTVIVDNNTWNNTHIATVGTAMSSPEKAAWEIFNSLDVKYVLVVFGGLIGYPSDDINKFLWMVRIGGGVFPHIKEADYLRDGNYRIDSEATPTMLNCLMYKLSYYRFVETDGKGYDRVRRTEIGKKNFKLTHFEEVFTSHHWMVRIYKLKPQKNRIRGRAKKLKLKTSSGLDSKAAKKNPWI

SEQ ID NO: 19761 - protein, 793 aa, Gossypium hirsutum
MAAPEASTAAVPTLYTNNTLRNAFGGVLSFFILLLIGVLAFSIRLFSVIKYESVIHEFDPYFNYRVTQFLTKKGIYEFWNWFDDRTWYPLGRVIGGTVYPGLTLTAGTIWWLLNSLNIPLSVETVCVFTAPIFSAFASWATYLLTKEVKGAGAGLTAAVLLAMVPSYISRSVAGSYDNEAVAIFALIFTFYLYLKTLNTGSLFYATLNSLAYFYMVCSWGGYTFIINLIPMHVLLCIVTGRYSSRLYIAYAPLVVLGTLLAALVPVVGFNAVMTSEHFASFLVFIIIHVVAFVYYIKGILSPKMFKVAVTLVVTVGLAVCCAVIAVLIALVASSPTKGWSGRSLSLLDPTYASKYIPIIASVSEHQPPTWPSYFMDINVLAFLVPAGIIACFLPLSDASSFIVLYIATSVYFSGVMVRLMLVLAPAACITSGIALSEAFDVLTGSIKFQLPGVTSNAEVDAGETSSDTSEAQTDEVKAEKPDDTSKNRPSKKSKKKERELAENPPAKATAKAKAKAEKKRLLALPLEASVISLLLLVVLGAFYVVHSVWAAAEAYSAPSIVLTTRSRDGLHVFDDFREAYAWLSHNTDVNDKVASWWDYGYQTTAMANRTVIVDNNTWNNTHIATVGTAMSSPERAAWEIFHSLDVKYVLVVFGGLIGYPSDDINKFLWMVRIGGGVFPHIKEPDYLRDGQYRIDSQATPTMLNCLMYKLSYYRFVETDGKAYDRVRRTEIGKKYFKLTHFEEVFTTHHWMVRIYKLKPLKNRIRGKAKKSKSKTSSTSSSKRSGTKKKNPWQ

SEQ ID NO: 19762 - protein, 784 aa, Setaria italica
MAEPVSSAAASGGGRLRNAFGGVLCAFTLLLIGVVAFSIRLFSVIKYESVIHEFDPYFNFRVTQFLSKNGIYEFWNWFDDRTWYPLGRVIGGTVYPGLTLTAGTMWWLVNALNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGGYTFIINLIPMHVLLCIVTGRYSSRLYIAYAPLVILGTLLAALVPVVGFNAVMTSEHFASFLVFIILHVVALVYYIKGLLTPRLFKVAMTLVISVGLAVCFAVVAVLVALVASSPTKGWSGRSLSLLDPTYASKYIPIIASVSEHQPPTWPSYFMDINVLAFLIPAGIISCFLPLSDASSFMVLYLVTAVYFSGVMVRLMLVLAPAACILSGIALSEVFGVLTRSIKFQLSKLFDDSSAAVSASGDSGPESSTNSTKSENRNEKSETAPKEKPSKKNRKKEKEVAESVPVKPKKEKRLLVLPFELSIMGILLLIVLGGFYVVHCVWAAAEAYSAPSIVLTSRSRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRVDAQATPTMLNCLMYKLCYYRFVETDGKGFDRVRGYEIGKKHFKLTHFEEVFTTHHWMVRIYKLKPQKNRVRGKLKKLKSNAKTSSTLVAGRKKNPWQ

SEQ ID NO: 19763 - protein, 761 aa, Lactuca sativa
MAASTDTTAAPSTTLRHASGNILAFFILLLIGVLAFSIRLFSVIKYESVIHEFDPYFNYRVTQFLTKNGIYDFWNWFDDRTWYPLGRVIGGTVYPGLTLTAGTIWKVLQSLNIPLSVETVCVFTAPVFSAFAAWATYLLTKEVKGAGAGLTAAVLLAMVPSYISRSVAGSYDNEAVAIFALIFTFYLYIKTLNTGSLFYATLNSIAYFYMVCSWGGYTFIINLIPMHVLLCIVTGRYSSRLYIAYAPLVVLGTLLAALVPVVGFNAVMTSEHFASFLVFIIIHLVALAYYIKGILSPKMFKVAATLVISVGMVVCCGVVAVLVAVVASSPTKGWSGRSLSLLDPTYASKYIPIIASVSEHQPPTWPSYFMDLNVLAFLVPAGIIACFSPLSDASSFVILYIVMSVYFSSVMVRLMLVLAPAACILSGIALSEAFDVFTRSIKFYVSDLSENLQTEAGDGASASNVSMENNDKKEELLKERGSKKNKKKEKVVVEESSKKKKTEKRPLVLPVDTSIFALFLIVLLGAFYVVHSVWAAAEAYSAPSIVLTSHSPEGLHVFDDFREAYAWLSHNTEVDDKVASWWDYGYQTTAMANRTVIVDNNTWNNTHIATVGTAMSSPEKAAWEIFNSLDVKYVLVVFGGVVGYSSDDINKFLWMVRIGGGVFPHIKEPDYLRDGQYRIDSQATPTMLNCLMYKLSYFRFVETDGGRGYDRVRRTEIGKKHFKLTHFEEVFTTHHWMVRIYKLKPQKNRIRGKTAKKSRSV

SEQ ID NO: 19764 - protein, 782 aa, Panicum virgatum
MAEPEVSSAAAGGGGRLRNAFGGVLCAFTLLLIGVVAFSIRLFSVIKYESVIHEFDPYFNFRVTQFLSKNGIYEFWNWFDDRTWYPLGRVIGGTVYPGLTLTAGTIWWLVNSLNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGGYTFIINLIPMHVLLCIVTGRYSSRLYIAYAPLVILGTLLAALVPVVGFNAVMTSEHFASFLVFIILHVVALVYYIKGLLSPRLFKVAMTLVISVGLAVCFAVVAVLVALVASSPTKGWSGRSLSLLDPTYASKYIPIIASVSEHQPPTWPSYFMDINVLAFLIPAGIISCFLPLSDASSFMVLYLVTAVYFSGVMVRLMLVLAPAACILSGIALSEVFGVLTRSIKFQLSKLFDDSSAASGDSSSESSTNSAKSETRNEKSETAPKEKPSKKNRKKEKEVAESVPVKTKKEKRLLVLPFELSVMGILLLIVLGGFYVVHCVWAAAEAYSAPSIVLTSRSRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRVDAQATPTMLNCLMYKLCYYRFVETDGKGFDRVRGYEIGKKHFKLTHFEEVFTTHHWMVRIYKLKPQKNRVRGKLKKLKSNAKTSSTLAAGRKKNPWQ

SEQ ID NO: 19765 - protein, 768 aa, Brassica napus
SAMRNAFGTVLSALILLLIGVLAFSIRLFSVIKYESVIHEFDPYFNYRVTQFLSKNGIYEFWNWFDDRTWYPLGRVIGGTVYPGLTLTAGTIWWALNAINIPLSVETVCVFTAPVFSAFASWATYLLTKEVKGSGAGLAAAALLAMVPSYISRSVAGSYDNEAVAIFALIFTFYLYIKTLNTGSLFYATLNAIAYFYMVCSWGGYTFIINLIPMHVLLCIVTGRYSPRLYIAYAPLVVLGTLLAALVPVVGFNAVLTSEHFASFLVFIIIHVVALVYYIKGILSPKMFKVAVTLVVSIGLAVCLIVVAVLVALVASSPTGGWSGRSLSLLDPTYASKYIPIIASVSEHQPPTWPSYFMDINVLAFLVPAGIIACFSPLSDASSFVVLYIVMSVYFSGVMVRLMLVLAPAACIMSGIALSQAFDVFTASIKYQLGRSANSKDDAEDNTSTNNAPKDDSSSGKTDKGEEVAKERSSKKGKKKEREPADKPSVKSKIAKKRVLVLPLEASIVALLLLIMLGAFYVIHCVWAAAEAYSAPSIVLTSQSRDGLHVFDDFRESYAWLSHNTDVDDKVASWWDYGYQTTAMANRTVIVDNNTWNNTHIATVGTAMSSPEKAAWEIFNSLDVKYVLVVFGGLIGYPSDDINKFLWMVRIGGGVFPHIKEADYLRDGNYRIDSEATPTMLNCLMYKLSYYRFVETDGKGYDRVRRTEIGKKNFKLTHFEEVFTSHHWMVRIYKLKPQKNRIRGRAKKLKLKTSSGLDSKAAKKNPWI

SEQ ID NO: 19766 - protein, 793 aa, Gossypium raimondii
MAAPEASTAAVPTLYTNNTLRNAFGGVLSFFILLLIGVLAFSIRLFSVIKYESVIHEFDPYFNYRVTQFLTKKGIYEFWNWFDDRTWYPLGRVIGGTVYPGLTLTAGTIWWLLNSLNIPLSVETVCVFTAPIFSAFASWATYLLTKEVKGAGAGLTSAVLLAMVPSYISRSVAGSYDNEAVAIFALIFTFYLYLKTLNTGSLFYATLNSLAYFYMVCSWGGYTFIINLIPMHVLLCIVTGRYSSRLYIAYAPLVVLGTLLAALVPVVGFNAVMTSEHFASFLVFIIIHVVAFVYYIKGILSPKMFKVAVTLVVTVGLAVCCAVIAVLIALVASSPTKGWSGRSLSLLDPTYASKYIPIIASVSEHQPPTWPSYFMDINVLAFLVPAGIIACFLPLSDASSFIVLYIATSVYFSGVMVRLMLVLAPAACITSGIALSEAFDVLTGSIKFQLPGVTSNAEVDAGETSSDTSEAQTDEVKAEKPDDTSKNRPLKKSKKKERELAENPPAKATAKAKAKAEKKRLLALPLEASVISLLLLVVLGAFYVVHSVWAAAEAYSAPSIVLTTRSRDGLHVFDDFREAYAWLSHNTDVNDKVASWWDYGYQTTAMANRTVIVDNNTWNNTHIATVGTAMSSPERAAWEIFHSLDVKYVLVVFGGLIGYPSDDINKFLWMVRIGGGVFPHIKEPDYLRDGQYRIDSQATPTMLNCLMYKLSYYRFVETDGKAYDRVRRTEIGKKYFKLTHFEEVFTTHHWMVRIYKLKPLKNRIRGKAKKSKSKTSSTSSSKRSGTKKKNPWQ

SEQ ID NO: 19767 - protein, 755 aa, Cichorium intybus
GNVLAFFILLLIGILAFSIRLFSVIKYESVIHEFDPYFNYRVTQFLTKNGIYDFWNWFDDRTWYPLGRVIGGTVYPGLTLTAGTIWKVLQSLNIPLSVETVCVFTAPVFSAFAAWATYLLTKEVKGAGAGLTAAVLLAMVPSYISRSVAGSYDNEAVAIFALIFTFYLYIKTLNTGSLFYATLNSMAYFYMVCSWGGYTFIINLIPMHVLLCIVTGRYSSRLYIAYAPLVVLGTLLAALVPVVGFNAVMTSEHFASFLVFIIIHLVALAYYIKGILSPKMFKVAATLVVSVGMVVCCAVVAVLVAVVASSPTKGWSGRSLSLLDPTYASKYIPIIASVSEHQPPTWPSYFMDLNVLAFLVPAGIIACFSPLSDASSFVILYIVTSVYFSSVMVRLMLVLAPAACILSGIALSEAFDVFTRSIKFYISGLTETIETQAGDAVSNVLEIDKKQDLLKEKEKPSKKNKKKEKVIVEVEITEKKRPLVLPVDTSIFALFLIVLLATFYVVHSVWAAAEAYSAPSIVLTSHSPEGLHVFDDFREAYAWLSHNTHVDDKVASWWDYGYQTTAMANRTVIVDNNTWNNTHIATVGTAMSSPEKAAWEIFNSLDVKYVLVVFGGVVGYSSDDINKFLWMVRIGGGVFPHIKEPDYLRDGQYRIDSQATPTMLNCLMYKLSYFRFVETDGGRGYDRVRRTEIGKKHFKLSHFEEVFTTHHWMVRIYKLKPQRNRIRGKTKKSRSKTSSATTTRTRTLTKKNPWH

SEQ ID NO: 19768 - protein, 732 aa, Euonymus alatus
MAAPETATATTLRYAFGNVLSFFILLLIGVLAFSIRLFSVIKYESVIHEFDPYFNYRVTQFLTKNGIYDFWNWFDDRTWYPLGRVIGGTVYPGLTLTAGTIWWLLNSLNIPLSVETVCVFTAPIFSAFASWATYLLTKEMMGDGAGLTAAALLAMVPSYISRSVAGSYDNEAVAIFALIFTFYLYIKTLNTGSLFYATLNAIAYFYMVCSWGGYTFIINLIPMHVLLCIVTGRYSSRLYIAYAPLVVLGTLLAALVPVVGFNAVLTSEHFASFLVFIIIHVVALAYYIKGILSPKMFKVAVTLVVSVGLVVCCAVVAVLIALVASSPTKGWSGRSLSLLDPTYASKYIPIIASVSEHQPPTWPSYFMDINVLAFLVPAGIIACFLPLSDASSFAVLYIVTSVYFSGVMVRLMLVLAPAACIMSGIALSQAFDVLTRSIKFQLPTLLGNSQVDAGDNSSGSIVAQNDVVRIDKSEDKLRERPSKKNKKKEKENVEMASSKPKKEKRLLVLPLVASAIAIFLLVMLGAFYVVHCVWAAAEAYSAPSIVLTSPSPDGGLHVFDDFREAYAWLSHNTGVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRIDSEATPTMLNSLMYKLSYFRFVETDGKGLDRVRRTEIGKKYFKLTHFEEVFT

SEQ ID NO: 19769 - protein, 785 aa, Phalaenopsis aphrodite
MVAPVDPKPGGALRNAFAGVLGFFILFLIGVLAFSIRLFSVIKYESVIHEFDPYFNYRVTQFLTKNGIYEFWNWFDDRTWYPLGRVIGGTVHPGLTLTAGTMWWILNSLNIPLSVETVCVFTAPVFSAFAAWATYLLTKEVKGIGSGLTAAILLALVPSYISRSVAGSYDNEAVAIFALIFTFYLYVKTLNTGSLFYSTLSALSYFYMVCSWGGYTFIINLIPMHVLLCIVTGRYSSRLYIAYAPLVVLGTLLAALVPVVGFNAVMKSEHFASFLVFIIIHVVAFVYFIKGILSPKMFKVAITLVLTVGIAIFVAVIAVLVALVSSSPTKGWSGRSLSLLDPTYASKYIPIIASVSEHQPPTWPSYFMDINILAFLVPAGIVACFLPLSDASSFVVLYLVTSVYFSGVMVRLMLVLAPAACILSGIALSEAFVVLTRSVKLQLVKLLEGPPLSNAGDTKGERSAAQNDVPNANKQDSSNKTEDIKDRSSKKNRKKEKETIEKAPVKSRNEKRLLVLPLEASAVAILLLVVLSGLYVIHCVWAAAEAYSAPSIVLTSRSHDGLHVFDDFREAYAWLSHNTEVDDKVASWWDYGYQTTAMANRTVIVDNNTWNNTHIATVGTAMSSPEKAAWEIFQSLDVKYVLVVFGGLVGYPSDDINKFLWMVRIGGGVFPHIKEPDYLRDGQYRIDAQATPTMLNCLMYKLSYYRFVETDGKGFDRVRRTEIGKKHFKLSHFEEVFTTHHWMVRIYKLKPEKNRIKRKTKKPKLSSKTSSGARRDGSTKKNPWQ

SEQ ID NO: 19770 - protein, 795 aa, Ananas comosus
MAEPAGGGALRNAFGGVLSIFILILIGVLAFSIRLFSVIKYESVIHEFDPYFNYRVTQFLTKNGIYDFWNWFDDRTWYPLGRVIGGTVYPGLTLTAGTMWWILNSLNIPLSVETVCVFTAPIFSANASWATYLLTKEVKGAGAGLTAAALLAMVPSYISRSVAGSYDNEAVAIFALIFTFYLYIKTLNTGSLFYATLNAIAYFYMVCSWGGYTFIINLIPMHVLLCIVTGRYSSRLYIAYAPLVVLGTLLAALVPVVGFNAVVTSEHFASFLVFIILHVVALVYYIKRILSPAMFKVAVTLVVTIGMAVCCAVIAILIALVASSPTKGWSGRSLSLLDPTYASKYIPIIASVSEHQPPTWPSYFMDINVLAFLVPAGIIACFLPLSDASSFVVLYLVTSVYFSGVMVRLMLVLAPAACITSGIALSEAFDVFTRSIKFQLPNLFSNSPSAGDNSSESSVSQDVVKNDNHRQVEKSETVPKVKGDNSRPTEKSEAVMKGKQSKKNRKKEKDLEEEDILKPKKERRLLVLPLEASAVAILLLIVLGGFYVVHCVWAAAEAYSAPSIVLTSHSHDGLHVFDDFREAYAWLRHNTDEDDKVASWWDYGYQTSAMANRTVIVDNNTWNNTHIATVGTAMSSPEKAAWEIFNSLDVKYVLVVFGGLVGYPSDDINKFLWMVRIGGGVFPHIKEPDYLRDGQYRIDAQATPTMLNCLMYKLSYYRFIEADGSGFDKVRRTEIGKKHFKLTHFEEAFTTHHWMVRIYKLKPPKNRIKGKWKKSKSSSKSSSKRNGATRKNPWQ

SEQ ID NO: 19771 - protein, 782 aa, Saccharum officinarum
MAEPEASSAAAGGGRRLRNAFGGVLCAFTLLLIGVVAFSIRLFSVIKYESVIHEFDPYFNFRVTQFLSKNGIYEFWNWFDDRTWYPLGRVIGGTVYPGLTLTAGTIWWLLNSLNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGGYTFIINLIPMHVLLCIVTGRYSSRLYIAYAPLVILGTLLAALVPVVGFNAVMTSEHFASFLVFIILHVVALVYYIKGLLTPRLFKVAMTLVISVGLAVCFAVVAILVALVASSPTKGWSGRSLSLLDPTYASKYIPIIASVSEHQPPTWPSYFMDINVLAFLIPAGIISCFLPLSDASSFMVLYLVTAVYFSGVMVRLMLVLAPAACILSGIALSEVFSVLTRSIKFQLSKFFDDSPTSSGDSSPESSTNSTKNENRNEKSETAPKERPSKKNRKKEKEAAESVPVKPKKEKKLLVLPFELSVMGILLLIVLGGFYVVHCVWAAAEAYSAPSIVLTSRSRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRVDAQATPTMLNCLMYKLCYYRFVETDGKGFDRVRGYEIGKKHFKLTHFEEVFTTHHWMVRIYKLKPQKNRVRGKLKKLKASAKTSSTLAAGQKKNPWQ

SEQ ID NO: 19772 - protein, 781 aa, Brassica rapa
MATLESPPPGTSSSAMRNAFGTVLSALILLLIGVLAFSIRLFSVIKYESVIHEFDPYFNYRVTQFLSKNGIYEFWNWFDDRTWYPLGRVIGGTVYPGLTLTAGTIWWALNAINIPLSVETVCVFTAPVFSAFASWATYLLTKEVKGSGAGLAAAALLAMVPSYISRSVAGSYDNEAVAIFALIFTFYLYIKTLNTGSLFYATLNAIAYFYMVCSWGGYTFIINLIPMHVLLCIVTGRYSPRLYIAYAPLVVLGTLLAALVPVVGFNAVLTSEHFASFLVFIIIHVVALVYYIKGILSPKMFKVAVTLVVSIGLVVCLIVVAVLVALVASSPTGGWSGRSLSLLDPTYASKYIPIIASVSEHQPPTWPSYFMDINVLAFLVPAGIIACFSPLSDASSFVVLYIVMSVYFSGVMVRLMLVLAPAACIMSGIALSQAFDVFTASIKYQLGRSANSKDDAEDNTSTNNAPKDDSSSGKTDKGEEVAKERSSKKGKKKEREPADKPSVKSKIAKKRALVLPLEASIVALLLLIMLGAFYVIHCVWAAAEAYSAPSIVLTSQSRDGLHVFDDFRESYAWLSHNTDVDDKVASWWDYGYQTTAMANRTVIVDNNTWNNTHIATVGTAMSSPEKAAWEIFNSLDVKYVLVVFGGLIGYPSDDINKFLWMVRIGGGVFPHIKEADYLRDGNYRIDSEATPTMLNCLMYKLSYYRFVETDGKGYDRVRRTEIGKKNFKLTHFEEVFTSHHWMVRIYKLKPQKNRIRGRAKKLKLKTSSGLDSKAAKKNPWI

SEQ ID NO: 19773 - protein, 760 aa, Pennisetum glaucum
VLCAFTLLVIGVLAFSIRLFSVIKYESVIHEFDPYFNFRVTQFLSKNGIYEFWNWFDDRTWYPLGRVIGGTVYPGLTLTAGTMWWLVNSLNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGGYTFIINLIPMHVLLCIVTGRYSSRLYIAYAPLVILGTLLAALVPVVGFNAVMTSEHFASFLVFIILHVVALVYYIKGLLTPRLFKVAMTLVISVGLAVCFAVVAVLVALVASSPTKGWSGRSLSLLDPTYASKYIPIIASVSEHQPPTWPSYFMDINVLAFLIPAGIISCFLPLSDASSFMVLYLVTAVYFSGVMVRLMLVLAPAACILSGIALSEVFGVLTRSIKFQLSKLFVDSSAASGDSSPESSTNSTKTENRNENSETAPKEKPSKKNRKKEKEVAESVPVKPNKKEKRLLVLPFELSVMGILLLIVLGGFYVVHCVWAAAEAYSAPSIVLTSRSRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRVDAQATPTMLNCLMYKLCYYRFVETDGKGFDRVRGYEIGKKHFKLTHFEEVFTTHHWMVRIYKLKPQKNRVRGKLKKLKSNAKTSSTLAAGRKKNPWQ

SEQ ID NO: 19774 - protein, 784 aa, Echinochloa colona
MAEPEVSSAAAGGGGRLRNAFGGVLCAFTLLLIGVLAFSIRLFSVIKYESVIHEFDPYFNFRVTQFLSKNGIYEFWNWFDDRTWYPLGRVIGGTVYPGLTLTAGTIWWLVNSLNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGGYTFIINLIPMHVLLCIVTGRYSSRLYIAYAPLVILGTLLAALVPVVGFNAVMTSEHFASFLVFIILHVVALVYYIKGLLTPRLFKVAMTLIISIGLAVCFAVVAVLVAVVASSPTKGWSGRSLSLLDPTYASKYIPIIASVSEHQPPTWPSYFMDINVLAFLIPAGIISCFLPLSDASSFMVLYLVTAVYFSGVMVRLMLVLAPAACILSGIALSEAFGVLTRSVKFQLSKLFDDSSAAVSASGDSSPESSTNSTKGENRNEKSETAPKEKPSKKNWKKEKEPPESVPVKPKKEKKLLVLPFEVSVMGILLLIVLGGFYVVHCVWAAAEAYSAPSIVLTSRTRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRVDAQATPTMLNCLMYKLCYYRFVETDGKGFDRVRGYEIGKKHFKLTHFEEVFTTHHWMVRIYKLKPQKNRVRGKLKKSKSNAKTSSTLAAGRKNPWQ

SEQ ID NO: 19775 - protein, 745 aa, Flaveria ramosissima
IGVLAFSIRLFSVIKYESVIHEFDPYFNYRVTQFLTKNGVYDFWNWFDDRTWYPLGRVIGGTVYPGLTLTAGTMWKVLQFLNIPLSVETVCVFTAPVFSAFAAWATYLLTKEVKGVGAGLTAAVLLAMVPSYISRSVAGSYDNEAVAIFALIFTFYLYIKTLNTGSLFYATLNSIAYFYMVCSWGGYTFIINLIPMHVLLCIVTGRYSPRLYIAYAPLVVLGTLMAALVPVVGFNAVMTSEHFASFLVFIIIHVVALAYYIKGILSPKMFKVAATLVVSVGLVICCTVVAVLIAVVAASPTKGWSGRSLSLLDPTYASKYIPIIASVSEHQPPTWPSYFMDINVLAFLVPAGIIACFSPLSDASSFVILYIVMSVYFSGVMVRLMLVFAPAACIMSGIALSEAFDVLTRSIKFYVFQAGDTISASIVAMQNNAMDTDEKEVSLKERPSKKNKRKEKENVEKPLKKSQTEKKPLILPVEASVFALFLTVLLGAFYVVHSVWAAAEAYSAPSIVLTSHSRDGLHVFDDFREAYAWLSHNTHVDDKVASWWDYGYQTTAMANRTVIVDNNTWNNTHIATVGTAMSSPEKAAWEIFNSLDVKYVLVVFGGLVGYSSDDINKFLWMVRIGGGVFPHIKEPDYLRDGQYRIDSQATPTMLNSLMYKLSYFRFVETDGGRGYDRVRGTEIGKKHFKLTHFEEVFTTHHWMVRIYKLKPQRNRIRGKIKKSRSKTSSTSPTKTRTITKKNPWH

SEQ ID NO: 19776 - protein, 781 aa, Zea mays
MAEPEVSPAAAGGGGRLRNAFGGVLCAFTLLLIGVVAFSIRLFSVIKYESVIHEFDPYFNFRVTQFLSKNGIYEFWNWFDDRTWYPLGRVIGGTVYPGLTLTAGTMWWLLNSLNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGGYTFIINLIPMHVLLCIVTGRYSSRLYIAYAPLVVLGTLLAALVPVVGFNAVMTSEHFASFLVFIILHVVALVYYIKGLLTPRLFKVAMTLVISVGLAVCFAVVAILVALVASSPTKGWSGRSLSLLDPTYASKYIPIIASVSEHQPPTWPSYFMDINVLAFLIPAGIISCFLPLSDASSFMVLYLVTAVYFSGVMVRLMLVLAPAACILSGIALSEVFSVLTRSIKLQLSKLFDDSPTSSGDSSPESSTNSTKNENRNEKHEIAPKEKTSKKNRKKEKEVAESVPVKPKKENRLLVLPFELSVMGILLLIVLGGFYVVHCVWAAAEAYSAPSIVLTSRSRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRVDAQATPTMLNCLMYKLCYYRFVETDGKGFDRVRGYEIGKKHFKLTHFEEVFTTHHWMVRIYKLKPQKNRVRGKLKKLKASAKTSPTLAAGRKNPWQ

SEQ ID NO: 19777 - protein, 787 aa, Oryza sativa
MAEPESSTAAAGGSRLRNACGGVLCAFTLLLIGVLAFSIRLFSVIKYESVIHEFDPYFNFRVTQFLSKNGIYEFWNWFDDRTWYPLGRVIGGTVYPGLTLTAGTIWWLLNSLNIPLSVETVCVFTAPIFSANASWATYLLTKEAKGTGAGLMAAAILAMVPSYISRSVAGSYDNEAVAIFALIFTFYLYVKTLNTGSLFYATLNALSYFYMVCSWGGYTFIINLIPIHVLLCIVTGRYSSRLYIAYAPLVILGTLLAALVPVVGFNAVMTSEHFASFLVFIILHVVALVYYIKGLLTPRLFKVAMTLVITVGLAVCFAVIAILIALVASSPTKGWSGRSLSLLDPTYASKYIPIIASVSEHQPPTWPSYFMDINVLAFLIPAGIISCFLPLSDASSFVVLYLVTAVYFSGVMVRLMLVLAPAACILSGIALSEAFDVLTRSVKYQLSKLFDDSPAASGDSSAESSSASTVSTNSAKNETRPEKTETAPKEKPSKKNRKKEKEVAESVPVKPKKEKKLLVLPMEASVLGILLLIVLGGFYVVHCVWAAAEAYSAPSIVLTSRSRDGLHVFDDFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGNYRVDAQGTPTMLNCLMYKLCYYRFVETDGKGFDRVRGYEIGKKHFKLTHFEEVFTTHHWMVRIYKLKPQKNRVRGKLKKLKSGSKASSTNAAGRKKNPWQ

SEQ ID NO: 19778 - protein, 783 aa, Cycas rumphii
MAVSGDYYRNAFGIVLSTSILILIGILAFSIRLFSVIKFESVIHEFDPYFNYRVTQYLTKNGIYDFWNWFDDRTWYPLGRVIGGTVYPGLTLTAGTIWWVLNSLNIPLSVETVCVFTAPIFSANAAWATYLLTKEVKGTGAGLTAAALIAMVPSYISRSVAGSYDNEAVAIFALVFTFYLYIKTLNTGSLFYATLNALAYFYMVCSWGGYTFIINLIPMHVLLCIVTGRYSSRLYIAYAPLVVLGTLLAALVPVVGFNAVMTSEHFASFLVFIILQIVALVHHIKRILSPKMFKVALTLVISVGMMVCIALVAILVALVAASPTKGWSGRSLSLLDPTYASKYIPIIASVSEHQPPTWPSYFMDINALAFLVPAGIIACFLPLSDASSFLVLYLVTSVYFSGVMVRLMLVLAPAACILSGIALSEAFSTLTQSVKHQLPALLGHSLPEQMDASTVNSAAGKDVSKAELRDSHSEKGEEPSKEKPSKRNRKKEKDNVEKVLDKKDSKKKLLILPLEASAIGILLLVILGSFYVIHCVWAAAEAYSAPSIVLTSQSHDGFHVFDDFREAYAWLRHNTDEDDKVASWWDYGYQTTAMANRTVIVDNNTWNNTHIATVGTAMSSPEKQAWEIFQSLDVKYVLVVFGGLVGYPSDDINKFLWMVRIGGGVFPHIKEPDYLRDGQYRIDSQATPTMLNCLMYKLSYYRFTEASMDGRGFDRVRRTEIGKKNFKLTHFEEVFTTHHWMVRIYKLKPLKNRIRAKSKKRTKSSSKNKSASLKKQMQKNPWY

SEQ ID NO: 19779 - protein, 788 aa, Hordeum vulgare
MAEPVANAAAPAPAPGRLRNAFGGVLCAFTLLLIGVLAFSIRLFSVIKYESVIHEFDPYFNFRVTQFLSKNGIYEFWNWFDDRTWYPLGRVIGGTVYPGLTLTAGSIWWLVNALNIPLSVETVCVFTAPIFSANASWATYLLTKEAKGTGAGLMAAAILAMVPSYISRSVAGSYDNEAVAIFALVFTFYLYVKTLNTGSLFYATLNALSYFYMVCSWGGYTFIINLIPMHVLLCIVTGRYSSRLYIAYAPLVILGTLLAALVPVVGFNAVLTSEHFASFLVFIILHVVAFVYYIKGLLTPRLFKMAMTLVITVGLAVCFAVVAILVALVASSPTKGWSGRSLSLLDPTYASKYIPIIASVSEHQPPTWPSYFMDINVLAFLVPAGIISCFLPLSDASSFMVLYLVTAVYFSGVMVRLMLVLAPAACILSGIALSSAFDVLTRSMKFQLSKLFDDGPAISGNGSPNGSSASTVNTSSSKNEKTEKSEAAPKEKPSKKNRKKDKEVTESVSVKPKKEKRLSVLPLEASIMGTLLLVALGGFYVVHCVWAAAEAYSAPSIVLTSRSREGLHVFDDFREAYAWLSHNTDVDDKVASWWDYGYQTTAMANRTVIVDNNTWNNTHIATVGTAMSSPEKAAWEIFDSLDVKYVLVVFGGLVGYPSDDINKFLWMVRIGGGEFPHIKEPDYLRDGQYRVDAQATPTMLNCLMYKLCYYRFVETDGKGFDRVRGYEIGKKHFKLTHFEEVFTTHHWMVRIYKLKPQKNRIRGKLKKLKSSAKTSSTLAAGRKKNPWQ

SEQ ID NO: 19780 - protein, 788 aa, Secale cereale
MAEPVANAAAPAPAPGRLRNAFGGVLCAFTLILIGVLAFSIRLFSVIKYESVIHEFDPYFNFRVTQFLSKNGIYEFWNWFDDRTWYPLGRVIGGTVYPGLTLTAGSIWWFVNALNIPLSVETVCVFTAPIFSAFASWATYLLTKEAKGTGAGLMAAAILAMVPSYISRSVAGSYDNEAVAIFALVFTFYLYVKTLNTGSLFYATLNALSYFYMVCSWGGYTFIINLIPMHVLLCIVTGRYSSRLYIAYAPLVILGTLLAALVPVVGFNAVLTSEHFASFLVFIILHVVAFVYYIKGLLTPRLFKMAMTLVITVGLAVCFAVVAILVALVASSPTKGWSGRSLSLLDPTYASKYIPIIASVSEHQPPTWPSYFMDINVLAFLVPAGIISCFLPLSDASSFMVLYLVTAVYFSGVMVRLMLVLAPAACILSGIALSSAFDVLTRSMKFQLSKLFDDGPAISGNGSPNGSSASTVNTSSSKSEKAEKSEAAPKEKPSKKNRKKDREVTESVSVKPKKEKRLSVLPLEASVVSTLLLIALGGFYVVHCVWAAAEAYSAPSIVLTSRSREGLHVFDDFREAYAWLSHNTDVDDKVASWWDYGYQTTAMANRTVIVDNNTWNNTHIATVGTAMSSPEKAAWEIFDSLDVKYVLVVFGGLVGYPSDDINKFLWMVRIGGGEFPHIKEPDYLRDGQYRVDAQATPTMLNCLMYKLCYYRFVETDGKGFDRVRGYEIGKKHFKLTHFEEVFTTHHWMVRIYKLKPQKNRIRGKLKKLKSSSKTSSTLAAGRKKNPWQ

SEQ ID NO: 19781 - protein, 787 aa, Secale cereale
WRSPWPTRRRPPRPGRLRNAFGGVLCAFTLILIGVLAFSIRLFSVIKYESVIHEFDPYFNFRVTQFLSKNGIYEFWNWFDDRTWYPLGRVIGGTVYPGLTLTAGSIWWLVNALNIPLSVETVCVFTAPIFSAFASWATYLLTKEAKGTGAGLMAAAILAMVPSYISRSVAGSYDNEAVAIFALVFTFYLYVKTLNTGSLFYATLNALSYFYMVCSWGGYTFIINLIPMHVLLCIVTGRYSSRLYIAYAPLVILGTLLAALVPVVGFNAVLTSEHFASFLVFIILHVVAFVYYIKGLLTPRLFKMAMTLVITVGLAVCFAVVAILVALVASSPTKGWSGRSLSLLDPTYASKYIPIIASVSEHQPPTWPSYFMDINVLAFLVPAGIISCFLPLSDASSFMVLYLVTAVYFSGVMVRLMLVLAPAACILSGIALSSAFDVLTRSMKFQLSKLFDDGPAISGNGSPNGSSASTVNTSSSKSEKAEKSEAAPKEKPSKKNRKKDREVTESVSVKPKKEKRLSVLPLEASVVSTLLLIALGGFYVVHCVWAAAEAYSAPSIVLTSRSREGLHVFDDFREAYAWLSHNTDVDDKVASWWDYGYQTTAMANRTVIVDNNTWNNTHIATVGTAMSSPEKAAWEIFDSLDVKYVLVVFGGLVGYPSDDINKFLWMVRIGGGEFPHIKEPDYLRDGQYRVDAQATPTMLNCLMYKLCYYRFVETDGKGFDRVRGYEIGKKHFKLTHFEEVFTTHHWMVRIYKLKPQKNRIRGKLKKLKSSSKTSSTLAAGRKKNPWQ

SEQ ID NO: 19782 - protein, 788 aa, Hordeum vulgare
MAEPAANAAAPAPAPGRLRNAFGGVLCAFTLLLIGVLAFSIRLFSVIKYESVIHEFDPYFNFRVTQFLSKNGIYEFWNWFDDRTWYPLGRVIGGTVYPGLTLTAGSIWWLVNALNIPLSVETVCVFTAPIFSANASWATYLLTKEAKGTGAGLMAAAILAMVPSYISRSVAGSYDNEAVAIFALVFTFYLYVKTLNTGSLFYATLNALSYFYMVCSWGGYTFIINLIPMHVLLCIVTGRYSSRLYIAYAPLVILGTLLAALVPVVGFNAVLTSEHFASFLVFIILHVVAFVYYIKGLLTPRLFKMAMTLVITVGLAVCFAVVAILVALVASSPTKGWSGRSLSLLDPTYASKYIPIIASVSEHQPPTWPSYFMDINVLAFLVPAGIISCFSPLSDASSFMVLYLVTAVYFSGVMVRLMLVLAPAACILSGIALSSAFDVLTRSMKFQLSKLFDDGPAISGNGSPNGSSASTVNTSSSKNEKTEKSEAAPKEKPSKKNRKKDKEVTESVSVKPKKEKRLSVLPLEASIMGTLLLVALGGFYVVHCVWAAAEAYSAPSIVLTSRSREGLHVFDDFREAYAWLSHNTDVDDKVASWWDYGYQTTAMANRTVIVDNNTWNNTHIATVGTAMSSPEKAAWEIFDSLDVKYVLVVFGGLVGYPSDDINKFLWMVRIGGGEFPHIKEPDYLRDGQYRVDAQATPTMLNCLMYKLCYYRFVETDGKGFDRVRGYEIGKKHFKLTHFEEVFTTHHWMVRIYKLKPQKNRIRGKLKKLKSSAKTSSTLAAGRKKNPWQ

SEQ ID NO: 19783 - protein, 793 aa, Brachypodium distachyon
MAEPEPTTAAAAPAPGRLRNAFGGVLCAFTLLLIGVLAFSIRLFSVIKYESVIHEFDPYFNFRVTQFLSKNGIYEFWNWFDDRTWYPLGRVIGGTVYPGLTLTAGSIWWLVNALNIPLSVETVCVFTAPIFSANASWATYLLTKEAKGTGAGLMAAAILAMVPSYISRSVAGSYDNEAVAIFALVFTFYLYLKTLNTGSLFYATLNALSYFYMVCSWGGYTFIINLIPMHVLLCIVTGRYSSRLYIAYAPLVILGTLLAALVPVVGFNAVLTSEHFASFLVFIILHVVAFVYYIKGLLTPRLFKVAMTLVITVGLAVCFAVVAVLVALVASSPTKGWSGRSLSLLDPTYASKYIPIIASVSEHQPPTWPSYFMDINVLAFLVPAGIISCFLPLSDASSFMVLYLVTAVYFSGVMVRLMLVLAPAACILSGIALSSAFDVLTRSMKFQLSKVFNDGSAVSGDSIAEGSTASNDTKGSSTSTVNTNSAKIENRTEKSEKPSKKNRKKDREVTGSVPVKPKKEKRLSVLPLEASVVGTLLLIVLGGFYVVHCVWAAAEAYSAPSIVLTSRSREGLHVFDDFREAYAWLSHNTDVDDKVASWWDYGYQTTAMANRTVIVDNNTWNNTHIATVGTAMSSPEKAAWEIFDSLDVKYVLVVFGGLVGYPSDDINKFLWMVRIGGGEFPHIKEPDYLRDGQYRVDSQATPTMLNCLMYKLCYYRFVETDGKGFDRVRGYEIGKKHFKLTHFEEVFTTHHWMVRIYKLKPQKNRIRGKLKKLKSSSKTSSTLAAGRKKNPWQ

SEQ ID NO: 19784 - protein, 788 aa, Avena sativa
MAETEAKAAAPAPDPGRLRNAFGGVLCAFTLILIGVLAFSIRLFSVIKYESVIHEFDPYFNFRVTQFLSKNGIYEFWNWFDDRTWYPLGRVIGGTVYPGLTLTAGSIWWFVNALNIPLSVETVCVFTAPIFSAFASWVTYLLTKEAKGTGAGLMAAAILAMVPSYISRSVAGSYDNEAVAIFALVFTFYLYVKTLNTGSLFYATLNALSYFYMVCSWGGYTFIINLIPMHVLLCIVTGRYSSRLYIAYAPLVILGTLLAALVPVVGFNAVLTSEHFASFLVFIILHVVAFVYYIKGLLTPRLFKMAMTLVITVGMAVCFAVVAILVALVASSPTKGWSGRSLSLLDPTYASKYIPIIASVSEHQPPTWPSYFMDINVLAFLVPAGIISCFLPLSDASSFMVLYLVTAVYFSGVMVRLMLVLAPAACILSGVALSSAFDVLTRSMKFQISKLFEDGSAISGNGSAEGSSASTVNTNSSRNESRTEKSEVVPKEKPSRKNRKKEKEVTESVPAKSKKEKRLSVLPLEASVVGTLLLIVLGGFYVVHCVWAAAEAYSAPSIVLTSRSREGTHVFDDFREAYAWLSHNTDVDDKVASWWDYGYQTTAMANRTVIVDNNTWNNTHIATVGTAMSSPEKAAWEIFHSLDVKYVLVVFGGLVGYPSDDINKFLWMVRIGGGEFPHIKEPDYLRDGQYRVDAQATPTMLNCLMYKLCYYRFVETDGKGFDRVRGYEIGKKHFKLTHFEEVFTTHHWMVRIYKLKPQKNRVRGKLRKLKSGSKPSSTPSAARKNPWQ

SEQ ID NO: 19785 - protein, 739 aa, Podocarpus macrophillus
AAAGSVLSFTILILVAILAFSIRLFSVIKYESVIHEFDPYFNYRVTQYLTKKGVYDFWNWFDDRTWYPLGRVIGGTVYPGLTLTAGTMWWILNSLNIPLSVETVCVFTAPVFSANAAWATYLLTKEVKGTGAGLTAAALIAMVPSYISRSVAGSYDNEAVAIFALVFTFYLYIKTLNTGSLFYATLNALAYFYMVCSWGGYTFIINLIPMHVLLCIVTGRYSSRLYIAYAPLVILGTLLAALVPVVGFNAVMTSEHFGSFLVFIILNVVALGHYIKRTVSAKMFKVAITLVISIGMVVSVALAAVLVASVAASPTKGWSGRSLSLLDPTYASKYIPIIASVSEHQPPTWPSYFMDINVLAFLVPAGIIACFLPLSDASSFLVLYIVTSVYFSGVMVRLMLVLAPAACILSGIALSEAFTVLTRSIKFQKDAGTVKSEVVTDQSNDGSKSEVEKGKELPREKPSKKSRKKEKENMEKVLDKKEIKQRSLLLPVEASVVGILLLIILGSFYVIHCVWAAAEAYSAPSIVLTSHTPDGFHVFDDFREGYAWLSHNTDINDKVASWWDYGYQTTAMANRTVIVDNNTWNNTHIATVGTAMSSPERQAWEIFQSLDVKYVFVVFGGLVGYPSDDINKFLWMVRIGGGVFPHIKEPDYLRDGQYRIDSQATPTMLNSLMYKLSYYRFTDIDGRGYDRVRRTEIGKKYFKLTHFEEVFTTHHWMVRIYKLKPQKNRLRGKSKKKRN

SEQ ID NO: 19786 - protein, 769 aa, Panicum virgatum
MPEPLSSTAASGGGGRLRNAFGGVLCAFTLLLIGVIAFSIRLFSVIKYESVIHEFDPYFNYRVTQFLSKNGIYEFWNWFDDRTWYPLGRVIGGTVYPGLTLTAGTMWWLLNSLNIPLSVETVCVFTAPIFSANASWATYLLTKEAKGSGAGLMAAAILAMVPSYISRSVAGSYDNEAVAIFALIFTFYLYVKTLNTGSLFYATLNALSYFYMVCSWGGYTFIINLIPMHVLLCIVTGRYSSRLYIAYAPLVVLGTLLAALVPVVGFNAVMTSEHFASFLVFIILHVVALVYYIKGLLTPRLFKVAMTFVVTVGLAVCFAVAAILIALVASSPTKGWSGRSLSLLDPTYASKYIPIIASVSEHQPPTWPSYFMDINVLAFLIPAGIISCFLPLSDASSFLVLYLVTSVYFSGVMVRLMLVLAPAACILSGIALSEAFGVLTRSMKFQRPISDDGSSTAHDGSFDTPANSEPVSKEKPSKKNRKKNKGSEGSPPVNPRTEEKLLVLPCGPSAVGIMLLIILSGFYVVHCVWAAAEAYSAPSIVLTSRSHDGLHVFDDFREAYGWLRHNTDVDDKVASWWDYGYQTTAMANRTVIVDNNTWNNTHIATVGTAMASPEKAAWEILNSLDVKYVFVVFGGLIGYSSDDINKFLWMVRIGGGVFPHIKEADYLRDGNYRVDAHGTPTMLNSLMYKLCYYRFVETDGKGFDRVRRYEIGKKHFKLTHFEEVFTTHHWMVRIYKLKPQKNRVRGKLKLKSSSKTSSRHKTSGKKRPW

SEQ ID NO: 19787 - protein, 770 aa, Setaria italica
MPEPQSSTAASGGGGRLRDAFGEVLCTFTLLLIGVLAFSIRLFSVIKYESVIHEFDPYFNYRVTQFLSKNGIYEFWNWFDDRTWYPLGRVIGGTVYPGLTLTAGTIWWLLNSLNIPLSVETACVFTAPIFSANASWATYLLTKEAKGSGAGLMAAAILAVVPSYISRSVAGSYDNEAVAIFALIFTFYLYVKTLNTGSLFYATLNALSYFYMVCSWGGYTFIINLIPIHVLLCIVTGRYSSRLYIAFAPLVVLGTLLAALVPVVGFNAVMTSEHFASFLVFIILHVVALVYYIKGLLTPRLFKVAMTFVITVGLAVCFAVAAILIALVASSPTKGWSGRSLSLLDPTYASKYIPIIASVSEHQPPTWPSYFMDINVLAFLVPAGIISCFLPLSDASSFLVLYLVTSVYFSGVMVRLMLVLAPAACILSGIALSEAFGVLTRSMKFQRPTSNDGSSTAGDGSSNTPADSEAVSKEKPAKKNRKKGKDSEGSSPVDPRTEEKLLVLPCGPSAVGIMLLIILSGFYVVHCVWAAAEAYSAPSIVLTSRSHDGLHVFDDFREAYGWLRHNTDVDDKVASWWDYGYQTTAMANRTVIVDNNTWNNTHIATVGTAMASPEKAAWEILNSLDVKYVLVVFGGLIGYPSDDINKFLWMVRIGGGVFPHIKEADYLRDGNYRVDAHGTPTMLNSLMYKLCYYRFADTDGKGFDRVRRYEIGKKHFKLTHFEEVFTTHHWMVRIYKLKPQKNRVRGKLKLKSSSKTSSMRKTGGKKSPWQ

SEQ ID NO: 19788 - protein, 630 aa, Solanum phureja
MRKHGWQLPYHPLQVVALAVFLALGFAFYVFFAPFVGKKLLQYIVMGLYTPLIISAFGLYIWCAAADPADPGVFKSKKYLKKLDHKKQVQLKESKLGCETNSSIQDANAASIGENASGKSNKGAEPAADHNETEQKITDTRHRSCSSGLLALLPCAIISNCAGRHEESSQQQLSEDGMFYCSLCEVEVFKYSKHCRVCDKCVDQFDHHCRWINNCIGKRNYRKFFTLMVSALLLLILQWSTGILVLICCFVEKKKFSAEITSKLGSSFSIVPFVIVVAVCTILAMIATLPLAQLFFFHILLIKKGISTYDYIIALRDQEQQGVAGQQSPQMSTVSSLTGLSSASSFNTFHRAAWCTPPRLFVEDQYDVVPPDTVSVSSLGKRSTAEEPIKKKNPAAVKISPWTLARLNAEDVSKAAAEARKKSKILQPVVRNKEPYILETNSSLGSSGRRMVPRVDNNRRRASKRVRLPAELPFETMSKIPNDIAQNSRRPMITESSSSLAPLQLEARSDFRTTRGLSTSGVVVASSPESSLDSPDIHPLRVSSSGVEDAARLVGHLSSGMTLQKDTPLSRSTSDGYEASGGEDSDRVPTRIVQRSTRWSSILFGSDQQDDRVRRLMVPSSSSQANIRKH

SEQ ID NO: 19789 - protein, 625 aa, Nicotiana benthamiana
MRKHGWQLPYHPLQVVAVAVFLALGFAFYVFFAPFVGKKLFQYVVMGLYTPLIISAFGLYIWCAGADPADPGVFKSKKYIKKLDNKKRVQLKESKLGCETNSSIQDANAASIGENASVKSNKGAESAADHNATQKKIAATHRRGLLALLPCALICNCTGTHEESSQQQLSEDGMFYCSLCEVEVFKYSKHCRVCDKCVDQFDHHCRWLNNCIGKKNYRKFFTLMVSALLLLILQWSTGIFVLIYCFIEKKKFSVEITSKLGSSFSLVPFVIVVAVCTILAMIATLPLAQLFFFHILLIKKGISTYDYIIALRDQEQQGVAGQQSPQMSTVSSLTGLSSASSFNTFHRAAWCTPPRLFVEDQYDVVAPDTVSVSSLGKRSTVEEPIKKRNPAAVKISPWTLARLNAEDVSKAAAEARKKSKILQPVVRNKEPYTLETNSSLGSSGRRMVPRPDNNRRRASKRVRLPTELPFENLSKIPSDIAQNSRNAIMSETSSSLAPLQLEARSDFRTSRGLSSSGGVAASSPESSLDSPDIHPLRVSSSGVEEATRFVGLSSGMTLQKDTPLSRSTSDGYEASGGEDSDRVPTRIVQRSTRWSSILFGSDQQDDRLRRLMVPSSSSQANIRKH

SEQ ID NO: 19790 - protein, 647 aa, Capsicum annuum
GGLYSCVHFSSGLSNLGILELFDFRYVSFWQVVAVAVFLALGFAFYVFFAPFVGKTMFQYIVMGLYTPLIISAFGLYIWCAAADPADPGVFKSKKYLKKLDKKKQVQVKESKLGCETNSSIQDVNAASIGENASAKSNKGTEPAADHIEIEQEVTATRQRSRSSGLLALLPCALISNCAGRHTESSQQQLSEDGMFYCSLCEVEVFKYSKHCRVCDKCVDQFDHHCRWINNCIGKRNYRKFFTLMVSALLLLILQWSTGILVLICCFIEKKKFSAEITSKLGSSFSIVPFVIVVAVCTILAMIATLPLAQLFFFHILLIKKGISTYDYIIALRDQEQQGVAGQQSPQMSTVSSLTGLSSASSFNTFQRAAWCTPPRLFVEDQYDVVPPDTVSVSSLGKRSTAEEPIKKKNPAAVKISPWTLARLNAEDVSKAAAEARKKSKILQPVVRNKDPYALETNSSLGSSGRRMVPRPDNNRRRAGKRVRLPAELPFETMSKIPSDIAQNSRRPMMTESSSSLAPLQLEARSDFRTNRGLSTSGVVVASSPESSLDSPDIHPLRVSSSGVEDAARLVGHLSSGTTLQKDTPLSRSTSDGYEASGGEDSDRVPTRIVQRSTRWSSILFGADQQDDRVRRLMVPSSSSQTNIRKH

SEQ ID NO: 19791 - protein, 294 aa, Solanum phureja
MPICSSSSSSSSSSTKSWILHGLAVGAAVAVALGAHAYLGRSGKFRSRVIGIIPARFASTRFQGKPLVQILGKPMIQRTWERAKLAETLDQVVVATDDEKIAECCRGFGAEVIMTSESCRNGTERCNEALQKLDKKYDIVVNIQGDEPLIEPEIIDGIVKALQAAPDAVFSTAVTSLKPEDAFDPNRVKCVVDNRGYAIYFSRGLIPYNKSGKVNPQFPYLLHLGIQSYDTKFLKIYPELTPTPLQLEEDLEQLKVLENGYKMKVIKVDHEAHGVDTPEDVEKIEQFMRERNMA

SEQ ID NO: 19792 - protein, 294 aa, Capsicum annuum
MTICDSSSSSGSSTKAWILHGLAAGAALAIAAGAQAYYGRRSGKYRSRVIGIIPARFSSTRFQGKPLVHILGKPMIQRTWERAKLAETLDQVVVATDDEKIAECCRGFGAEVIMTAESCRNGTERCNEALQKLDKKYDIVVNIQGDEPLIEPEIIDGIVKALQAAPDAVFSTAVTSLKPKDAFDPNRVKCVVDNRGYAIYFSRGLIPYNKSGKVNPQFPYLLHLGIQSYDTNFLKVYPELTPTPLQLEEDLEQLKVLENGYKMKVIKVDHEAHGVDTPEDVEKIEQFMRDRNLA

SEQ ID NO: 19793 - protein, 293 aa, Solanum melongena
MAICDSSSSSYGSTKAWILHGLAVGAALAVALGAHVYHRRSGKFRSRVIGIIPARFASSRFPGKPLVQIIGKPMIQRTWERAKLAETLDQVVVATDDERIAECCRGFGAKVIMTSVSCRNGTERCNDALQRLDKKYDIVVNIQGDEPLIEPEIIDGIVKALQAAPDAVFSTAVTSLKSEDAFDPNRVKCVVDNRGYAIYFSRGLIPYNKSGKVNPQFPYSLHLGIQSYDAKFLKIYPELTPTPLQLEEDLEQLKVLENGYKMKVIKVDHEAHGVDTPEDVEKIEQFMRERNLA

SEQ ID NO: 19794 - protein, 293 aa, Capsicum annuum
MSSSSSSSSSSSSSKSWIINGLAIGAAMAAALGARAYLARSGRFRSRVIGIIPARFASTRFQGKPLVHILGKPMIQRTWERAKLAATLDHVVVATDDEKIAECCQGFGAEVIMTSESCRNGTERCNEALQKLGKKYDIVVNIQGDEPLIEPEIIDGIVKALQAAPDAVVSTAVTSLKPEDAFDPNRVKCVVDNRGYAIYFSRGLIPYNKSGKVNPHFPYLLHLGIQSYDSKFLKIYPELEPTPLQLEEDLEQLKVLENGYKMKVIKVDHETHGVDSPEDADKIEQFMRERNLS

SEQ ID NO: 19795 - protein, 273 aa, Solanum tuberosum
MPICSSSSSSSSSSTKSWILHGLAVGAAVAVALGAHAYLGRSGKFRSRVIGIIPARFASTRFQGKPLVQILGKPMIQRTWERAKLAETLDQVVVATDDEKIAECCRGFGAEVIMTSESCRNGTERCNEALQKLDKKYDIVVNIQGDEPLIEPEIIDGIVKALQAAPDAVFSTAVTSLKPEDAFDPNRVKCVVDNRGYAIYFSRGLIPYNKSGKVNPQFPYLLHLGIQSYDTKFLKIYPELTPTPLELEEDLEQLKVLENGYKMKVIKVEHEAH

SEQ ID NO: 19796 - protein, 292 aa, Nicotiana benthamiana
MPIISSNSSSSSSKSWILHGLAAGAAMAAVLGARAYLGRSSKFRSRVIGIIPARFASTRFQGKPLAHILGKPMIQRTWERAKLAATLDHVVVATDDEKIAACCQGFGAEVIMTSESCRNGTERCTEALQKLAKKYDIVVNIQGDEPLIEPEIIDGIVKALQAAPDAVFSTAATSLKPEDAFDPNRVKCVVDNRGYAIYFSRGLIPYNKSGKVNPQFPYLLHLGIQSYDSRFLKIYPELEPTPLQLEEDLEQLKVLENGYKMKVIKVDHETHGVDTPEDVDKIERFMRERNLS

SEQ ID NO: 19797 - protein, 294 aa, Manihot esculenta
MSMCSSSSSSSSSSAKLWIVHGIVAGAAIAAAFGARAYLGRSGKFRSRVVGIIPARFASSRFEGKPLVQILGKPMIQRTWERAKLATTLDRIVVATDDEKIAECCRGFGAEVIMTSESCRNGTERCNEALGKLEKKYDVVVNIQGDEPLIEPEIIDGIVKALQASPDAVFSTAVTSLKPEDAFDPNRVKCVVDNRGYAIYFSRGLIPYNKSGKVNPQFPYLLHLGIQSYDAKFLKIYPELKPTPLQLEEDLEQLKVLENGYKMKVIKVDHEAHGVDIPEDVEKIETLMREQNLS

SEQ ID NO: 19798 - protein, 298 aa, Vinca minor
MTICSSSSSSSSSSSSNKSWIFHGIAVGAAIAVAIGAHAYLYLRRPNKFRTQVIGIIPARFASSRFPGKPLAQILGKPMIQRTWERAILASSLDHVVVATDDEKIAECCRGFGADVVMTSESCRNGTERCNEALEMMGNKYDIVVNIQGDEPLIEPEIIDGIVKALQAAPDAVFSTAVTSLNPEDAFDPNRVKCVVDNRGYAIYFSRGLIPFNKSGKVNPKFPYLLHLGIQSYDTKFLKIYPELTPTPLQLEEDLEQLKVLENGYKMKVIKVDHEAHGVDAPEDVEKIERFMRERNLA

SEQ ID NO: 19799 - protein, 294 aa, Ricinus communis
MSICSSNSSSSSSGSKSWIVHSIVAGAAIAVGIGARAYLSRSRKFRSRVIGIIPARFASSRFQGKPLVQILGKPMIQRTWERAKLATTLDHIIVATDDEKIAECCRGFGADVIMTSESCRNGTERCNEAIGKLEKKYDVVVNIQGDEPLIEPEIIDGIVKALQEAPDAVFSTAVTSLKPEDAFDPNRVKCVVDNQGYAIYFSRGLIPYNKSGKINPQFPYLLHLGIQSYDAKFLKIYPELQPTPLQLEEDLEQLKVLENGYKMKVIKVDHEAHGVDAPEDVEKIERLMREHNVL

SEQ ID NO: 19800 - protein, 292 aa, Panax ginseng
MSICTSSSSSSSTTAKAWIVHGIAVGAAIAVAVGAYLGRSSKFRSRVVGIIPARFASTRFQGKPLVQILGKPMIQRTWERAKLATTLDHLVVATDDEKIADCCRGFGADVIMTSESCRNGTERCNEALQKLAKKYDVVVNIQGDEPLIEPDIIDGIVKALQAAPDAVFSTAVTSLKPEDAFDPNRVKCVVDNNGYAIYFSRGLIPHNKSGKVNPQFPYLLHLGIQSYDSKFLRIYPVLPPTPLQLEEDLEQLKVLENGYKMKVIKVDHNAHGVDTPEDVGKIESFMREHNLF

SEQ ID NO: 19801 - protein, 299 aa, Mimulus guttatus
MPICNPSSSSSSSSSSSTKSWIIHGLAVGAAAAVAIGAHAYFNYRRSGKFRSRVIGIIPARFASSRFEGKPLVHILGKPMIQRTWERAKMATSLDHVVVATDDDKIAECCRGFGADVVMTSESCRNGTERCNEALQKLGKEYDVVVNIQGDEPLIEPEIIDGIVKSLQASPDAVFSTAVTSLKYEDALDPNRVKCVVDNHGYAIYFSRGLIPFNKSGTVNPRFPYLLHLGIQSYDSKFLKIYPELPPTPLQLEEDLEQLKVLENGYKMKVIKVDHEAHGVDVPEDVAKIEQYMRERNLH

SEQ ID NO: 19802 - protein, 297 aa, Vitis vinifera
MAVCSSSSSSGSSSNTKAWIIHGILTGAAVAVALGAHAYLLLRRSGKFRSRVVGIIPARFASSRFQGKPLVQILGKPMIQRTWERAKLATTLDHVVVATDDDKIADCCRGFGADVIMTSESCRNGTERCNEALQKLEKQYDIVVNIQGDEPLIEPEIIDGVVKALQAAPDAVFSTAVTSLKPEDGFDPNRVKCIVDNRGYAIYFSRGLIPFNKSGEVNQQFPYLLHLGIQSYDTKFLRIYPDLPPTPLQLEEDLEQLKVLENGYKMKVIKVDHEAHGVDTPEDVDKIESFMRERNLS

SEQ ID NO: 19803 - protein, 293 aa, Tabernaemontana elegans
SSSSSSSSSSSSKAWIFHGLAVGAAVAVAIGAHAYLYFRRPSKFRTRVIGIIPARFASSRFPGKPLVRILGKPMIQRTWERAKLASSLDHVVVATDDEKIAECCRGFGADVVMTSESCQNGTERCNEALEMLGKKYDVVVNIQGDEPLIEPEIIDGIVKALQAAPDAVFSTAVTSLKPEDAYDPNRVKCVVDNHGYAIYFSRGLVPFNKSGKVNPKFPYLLHLGIQSYDTKFLKIYPELPPTPLQLEEDLEQLKVLENGYKMKVIKVDHEAHGVDAPEDVEKIEHFMRERNLA

SEQ ID NO: 19804 - protein, 295 aa, Chelidonium majus
MDSTSSSGSGSSSSSKSWILCSLAAGAAIAASAAGAFHFQGGSRKFRSRVIGIIPARFASSRFQGKPLVQILGKPMIQRTWERTKLATTLDHVVVATDDEKIAECCRGFGADVIMTSESCRNGTERCNEALEKLNKKYDIVVNIQGDEPLIEPEIIDGVVKALQGAPDAVFSTAVTSLKPEDSMDPNRVKCVVDNRGYAIYFSRGLIPYNKSGQVNPNFPYLLHLGIQSYDTKFLKIYPELTPTPLQLEEDLEQLKVLENGYKMKVIKVDHDAHGVDTPEDVEKIETLMRERNIS

SEQ ID NO: 19805 - protein, 294 aa, Ocimum basilicum
MPICDPSSSSSASASAKSWIIHTLAAAAVALGAHAYIYYRRSGKFRSRVIGIIPARFASSRFQGKPLVHILGKPMIQRTWERAKMATSLDHVVVATDDEKIAECCRGFGADVVMTSESCRNGTERCNEALTKLGKQYDVVVNIQGDEPLIEPEIIDGIVKALQAAPDAVFSTAVTSLKPEDANDPNRVKCVVDNHGYAIYFSRGLIPFNKSGSVNPQFPYLLHLGIQSYDTKFLTIYPELPPTPLQLEEDLEQLKVLENGYKMKVIKVEHECHGVDVPEDVDKIERFMRERNLN

SEQ ID NO: 19806 - protein, 292 aa, Petroselinum crispum
MSICKSESSSSSSSNKSWIVHSLLVGAAVAVAVGAHLRLTSRFRSRVVGIIPARYASTRFEGKPLVQILGKPMIQRTWERANLATTLDHVVVATDDEKIASCCRGFGADVIMTSESCRNGTERCNEALQKLKKKYDVVVNIQGDEPLIEPEIIDGIVKALQGAPDAVFSTAVTALAPEDAFDPNRVKCVVDNRGYAIYFSRGLIPYNKSGKVNPKFPYLLHLGIQSFDTKFLKIYPELPPTPLQLEEDLEQLKVLENGYKMKVIKVDHNAHGVDTPEDVEKIERYMRERNLS

SEQ ID NO: 19807 - protein, 292 aa, Panax ginseng
MSICTSSSSSSSTTAKAWIVHGIAVGAAIAVAVGAYLGRSSKFRSRVVGIIPARFASTRFQGKPLVQILGKPMIQRTWERAKLATTLDHLVVATDDENIADCCRGFGADVIITAESCRNGTERCNEALQKLAKKYDVVVNIQGDEPLIEPDIIDGIVKALQAAPDAVFSTAVTSLKPEDAFDPNRVKCVVDNNGYAIYFSRGLIPHNKSGKVNPQFPYLLHLGIQSYDSKFLRIYPELPPTPLQLEEDLEQLKVLENGYKMKVIKVDHNAHGVDTPEDVGKIESFMREHNLF

SEQ ID NO: 19808 - protein, 292 aa, Panax ginseng
MSICTSSSSSSSTTAKAWIVHGIAVGAAIAVAVGAYLGRSSKFRSRVVGIIPARFASTRFQGKPLVQILGKPMIQRTWERAKLATTLDHLVVATDDENIADCCRGFGADVIMTAESCRNGTERCNEALQKLAKKYDVVVNIQGDEPLIEPDIIDGIVKALQAAPDAVFSTAVTSLKPEDAFDPNRVKCVVDNNGYAIYFSRGLIPHNKSGKVNPQFPYLLHLGIQSYDSKFLRIYPELPPTPLQLEEDLEQLKVLENGYKMKVIKVDHNTHGVDTPEDVGKIESFMREHNLF

SEQ ID NO: 19809 - protein, 300 aa, Actinidia deliciosa
MDPTSFCAPSSSSGSSSSTKAWIVHGLVVGAAVAVALGAHAYLYLGRSGKFRSRVIGIIPARFASSRFPGKPLVQILGKPMIQRTWERAKMATTLDQVVVATDDEKIAECCRGFGADVIMTSESCLNGTERCNEALQKLEKKYDVVVNIQGDEPLIEPEVIDGIVKALQAAPDAVFSTAVTSLKPEDPFDPNRVKCVMDTHGYAIYFSRGLIPYNKSAKVNPQFPYLLHLGIQSYDTKFLKIYPELPSTLLQLEEDLEQLKVLENGYKMKVIKVNHEAHGVDAPEDVEKIECFMRERNLS

SEQ ID NO: 19810 - protein, 293 aa, Populus trichocarpa
MSMCSSCSSGSSSTRSWIVHGIVAGAAIAAAIGAGAYLVRYRKFRSQVVGIIPARYASSRFEGKPLVNILGKPMIQRTWERAKLATTLDHIVVATDDEKIAECCRGFGADVVMTSESCRNGTERCNEALQKLDKKYDVVVNIQGDEPLIEPEIIDGIVKSLQAAPDAVFSTAVTSLKPEDAFDPNRVKCVVDNQGYAIYFSRGLIPYNKSGKVNPQFPYLLHLGIQSYDAKFLKIYPELQPTPLQLEEDLEQLKVLENGYKMKVIKVDHEAHGVDIPEDVEKIETLMREQNLS

SEQ ID NO: 19811 - protein, 300 aa, Quercus alba
MVAPSVCSSSSSSSDGSSSNTKAWIVHGIVAGVAIAVAVGARAYLGRFGKFRSRVVGIIPARFASSRFHGKPLVHILGKPMIQRTWERAKLAATLDHIVVATDDDKIAECCRGFGAHVIMTSESCRNGTERCNEALQKLEKKYDIVVNIQGDEPLIEPEIIDGVVKALQAAPDAVFSTAVTSLKPEDAFDPNRVKCVVDNRGYAIYFSRGLIPFNKSGDVNPQFPYLLHLGIQSYDSKFLKIYPELQPTPLQLEEDLEQLKVLENGYKMKVIKVDHEAHGVDAPEDVEKIESYMRERNLS

SEQ ID NO: 19812 - protein, 295 aa, Citrus clementina
  Sequence also found in Organisms: Citrus sinensis
MSSKSICSPSESSSSTKSWIVHGIVAGAAIAVAVGARAYLGRSKNFRSRVVGIIPARFASSRFEGKPLVNILGKPMIQRTWERSKLATTLDHLVVATDDEKIAECCQQFGADVIMTSESCRNGTERCNEALQKLEKKYDIVVNIQGDEPLIEPEIIDGVVKALQAAPDAVFSTAVTSLKPEDAFDPNRVKCVVDNHGYAIYFSRGLIPYNKSGKVNPQFPYLLHLGIQSYDSNFLKIYPGLHPTPLQLEEDLEQLKVLENGYKMKVIKVDHEAHGVDAPEDVEKIESFMRERNLS

SEQ ID NO: 19813 - protein, 302 aa, Eucalyptus grandis
MSICTSSSSSSSGSSSSSSYSTAKAWIVHGIVAGVAVAAAIGARAYLGRAAKFRSRVVGIIPARFASSRFQGKPLVPILGKPMIQRTWERAKLAASLDHVVVATDDEKIAECCRGFGADVIMTSESCRNGTERCNEALQKLDKKYDIVVNIQGDEPLIEPEIIDGVVKALQAAPDAVFSTAVTSLKPEDAFDPNRVKCVVDNRGYAIYFSRGLIPHNKSGKVNPKFPYLLHLGIQSYDSKFLKIYPELQPTPLQLEEDLEQLKVLENGYKMKVIKVDHEAHGVDTPEDVQKIESYMLERNLS

SEQ ID NO: 19814 - protein, 300 aa, Rosmarinus officinalis
MTICAPSSFASSSSSSSSGQAWIYHGLAVGAALAVAIGAHTYLYLRRPSKFRTRVIGVIPARFASSRFPGKPLVQILGKPMIQRTWERAKMAPSLDHVVVATDDERIAECCRGFGADVVMTSESCRNGTERCNEALEMLGKKYDILVNIQGDEPLLEPEIIDGIVKSLQAAPDAVFSTAVTSLKPEDAFDPNRVKCVVDNRGYAIYFSRGLIPFNKSGRVNPKFPYLLHLGIQSYDTKFLKIYPELTPTPLQLEEDLEQLKVLENGYKMKVIKVDHEAHGVDAPEDVEKIESFMRERNLA

SEQ ID NO: 19815 - protein, 301 aa, Olea europaea
MPICTPSSSDSSSGSSSVSTKSWIIHGLAVGAAAAVALGAHVYLYYRRSGRFRSRVVGIIPARFASSRFQGKPLVHILGKPMIQRTWERAKMASLLDHIVVATDDDKIAECCRGFGADVIMTSESCRNGTERCNEAHQKLGNKYDIVVNIQGDEPLIEPEIIDGIVKALQATPDAVFSTAVTSLKSEDAFDPNRVKCVVDNRGYAIYFSRGLIPFNKSGKVNPQFPYLLHLGIQSLDSKFLEIYPELPPTPLQLEEDLEQLKVLENGYKMKVIKVDHEAHGVDTPEDVEKIERYMQEKNLS

SEQ ID NO: 19816 - protein, 300 aa, Triphysaria pusilla
MAICSPSSLSSSSSSSSSSKSWIIHSLAIGAAAAVALGAHAYFYYRRSGKFRSRVVGIIPARFASSRFEGKPLAYILGKPMIQRTWERAKMATSLDHIVVATDDDKIAECCRGFGADVVMTSESCRNGTERCNEALEKLGKQYDVVVNIQGDEPLIEPEIIDGIVKALQAAPDAVFSTAVTSLKPEDAFDPNRVKCVVDNRGYAIYFSRGLIPFNKSGKVNPQFPYLLHLGIQSFDSKFLKIYPELPSTPLQLEEDLEQLKVLENGYKMKVIKVDHEAHGVDVPEDIGKIEQYMRERNLE

SEQ ID NO: 19817 - protein, 296 aa, Rosmarinus officinalis
MTLCNTSSSSTGSGYSKSWIIHGVAVGAAAALALGAHYMYYRRSGKFRSRVVGIIPARFASSRFQGKPLVNILGKPMIQRTWERAKMATSLDHIVVATDDEKIADCCRGFGADVVMTSESCRNGTERCNEALSKLDKKYDVVVNIQGDEPLIEPEIIDGIVKALQAAPDAVFSTAVTSLKSEDAYDPNRVKCVVDNHGYAIYFSRGLIPFNKSGNVNPQFPYLLHLGIQSYDTKFLNIYPELPPTPLQLEEDLEQLKVLENGYKMKVIKVDHESHGVDIPEDVDKIESYMRERNLH

SEQ ID NO: 19818 - protein, 296 aa, Spinacia oleracea
MSICTSSSSSSSSSTKSWVVHGLVLGAAAAAAIGAHTYFYIRRSRKFRSRVIGIIPARFASSRFQGKPLVHILGKPMIQRTYEQAKLASMLDQVVVATDDNKIAECCRGFGADVIMTSESCRNGAERCSEALQKLNKKYDIVVNIQGDEPLIEPDIIDGIVKALQSAPDAVFSTAVTPLKPGDAFDTNRVKCVVDNLGYAIYFSRGLIPYNKSGMVNPDFPYLLHLGIQSYDAEFLKIYPELPSTPLQLEEDLEQLKVLENGYKLKVIKVEHEAHGVDVPEDVEKIERYMRERNLS

SEQ ID NO: 19819 - protein, 298 aa, Theobroma cacao
MSICSSSSSSSSSSSSSTAKAWIVHSILAGTAIAVAIGARAYLGRAKKFRSRVVGIIPARFASSRFQGKPLVQILGKPMIQRTWERSKLATTLDHIVVATDDEKIAECCRGFGADVIMTSESCQNGTERCNEALEKLEKKYDIVVNIQGDEPLIEPEIIDGVVKALQAAPDAVFSTAVTSLKPEDAFDPNRVKCVVDNHGYAIYFSRGLVPFNKSAKVNPHFPYLLHLGIQSYDSEFLKIYPKLQPTPLQLEEDLEQLKVLENGYKMKVIKVDHEAHGVDTPEDVEKIESLMRENNLS

SEQ ID NO: 19820 - protein, 299 aa, Trifolium pratense
MTICSSPSSSSSSSSSNNSKTWIIHGIVAGVAIVAAASGAHAYFRRFNKFRSRVVGIIPARFASSRFSGKPLVQILGKPMIQRTWERAKLAASLDHVVVATDDERIADCCRTFGADVIMTSESCRNGTERCNEALEKLGKKYDIVVNIQGDEPLVEPEIIDGVVKALQAAPDAVFSTAVTSLKPEDALDPNRVKCVVDNRGYAIYFSRGLIPFNKSGKVNQQFPYLLHLGIQSYDTKFLKIYPDLQPTPLQLEEDLEQLKVLENGYKMKVIKVDHDAHGVDTPEDVEKIESLMRERNLS

SEQ ID NO: 19821 - protein, 296 aa, Gossypium raimondii
MSVCSSSSSSSSSSSTGKAWIVHSILAGTAIAVAIGARAYLGRARKFRTRVVGIIPARYASSRFEGKPLVHILGKPMIQRTWERSKLATTLDHLVVATDDEKIAECCRGFGADVIMTSESCQNGTERCNEALEKLEKKYDIVVNIQGDEPLIEPEIIDGIVKALQAAPDAVFSTAVTSLKPEDAFDPNRVKCVVDNRGYAIYFSRGLIPFNKSAKVNPQFPYMLHLGIQSYDSKFLQIYPKLQPTPLQLEEDLEQLKVLENGYKMKVIKVEHEAHGVDTPEDVEKIESLMRERNLS

SEQ ID NO: 19822 - protein, 293 aa, Eutrema parvulum
MAICSSSSSSSSSQKTWIVHGILAGTAIAAAIGAHAYLGRSRKFRSRVVGIIPTRYASSRFEGKPLVQILGKPMIQRTWERSKLASTLDHVVVATDDERIANCCRGFGADVIMTSESCRNGTERCNEALEKLEKKYDVVVNIQGDEPLIEPEIIDGVVKALQVAPDAVFSTAVTSLKPEDGLDPNRVKCVVDNRGYAIYFSRGLIPYNKSGKVNPDFPYMLHLGIQSFDSKFLKVYSELQPTPLQLEEDLEQLKVLENGYKMKVIKVDHEAHGVDTPDDVEKIESLMRERNLS

SEQ ID NO: 19823 - protein, 290 aa, Populus trichocarpa
MSMCSSESSSSKFWIVHSIVAGAAIAAAIGAGAYLGRYRKFRSRVVGIIPARYASSRFEGKPLVNILGKPMIQRTWERAKLASTLDHIVVATDDEKIAECCRGFGADVIMTSESCRNGTERCNEALQKLDKKYDVVVNIQGDEPLIEPEIIDRIVKALQAAPDAVFSTAVTALKPEDAFDPNRVKCVVDNHGYAIYFSRGLIPYNKTGKVNPQFPYMLHLGIQSYDTKFLKIYPELRSTPLQLEEDLEQLKVLENGYKMKVIKVDHEAHGVDIPEDVEKIETLMREQSFS

SEQ ID NO: 19824 - protein, 292 aa, Tropaeolum majus
MTISSSSSSSSSTKSWILHGIVAGTAVALAIGARVYLARSSKLRTRVVGIIPARFASSRFEGKPLVHILGKPMIQRTWEQSKLATTLDHVVVATDDERIAECCRGFGADVIMTSEFCRNGTERCNEALEKLEKKYDIVVNIQGDEPLIEPEIIDGVVKALQAAPDAVFSTAVTSLKPEDAFDRNRVKCVVDNRGYAIYFSRGLIPHNKAGKVNPQFPYLLHLGIQSYDSKFLKVYPELQPTPLQLEEDLEQLKVLENGYKMKVIKVNHEAHGVDIPEDVEKIESFMRQRNLS

SEQ ID NO: 19825 - protein, 296 aa, Prunus mume
MSVCSSSSSSSGSWSSTKAWIVHGIVAGVAIAVAIGARVYLGPPKKFRSRVVGIIPARFASSRFQGKPLAQILGKPMIQRTWERAKLATTLDHVVVATDDEKIRECCRSFGADVVMTSESCRNGTERCSEAIQKLEKKYDIVVNIQGDEPLIEPEIIDGIVKALQEAPDAVFSTAVTSLKLEDAFDPNRVKCLVDNSGYAIYFSRGLIPFNKSGKANPQFPYMLHLGIQSYDTRFLKIYPQLEPTPLQLEEDLEQLKVLENGYKMKVIKVDHEAHGVDAPEDVEKIESLMRERNLS

SEQ ID NO: 19826 - protein, 293 aa, Arabidopsis lyrata
MSVCSSSSSSSSSQKTWIVHGILAGAAIAAAIGASAYLGRSRKFRSRVVGIIPARYASSRFEGKPLVQILGKPMIQRTWERSKLATTLDHIVVATDDERIAECCRGFGADVIMTSESCRNGTERCNEALEKLDKKYDVVVNIQGDEPLIEPEIIDGVVKALQVTPDAVFSTAVTSLKPEDGLDPNRVKCVVDNRGYAIYFSRGLIPYNKSGKVNPDFPYMLHLGIQSFDSKFLKVYSELQPTPLQQEEDLEQLKVLENGYKMKVIKVDHEAHGVDTPDDVEKIESLMRERNLS

SEQ ID NO: 19827 - protein, 297 aa, Triphysaria pusilla
MAICSPSSLSSSSSSSSSSKSWFIHSLAIGAVALGAHAYFYYRRSGKFRSRVVGIIPARFASSRFEGKPLAYILGKPMIQRTWERAKMATLLDHIVVATDDDKIAECCRGFGADVVMTSESCRNGTERCNEALEKLGKQYDVVVNIQGDEPLIEPEIIGGIVKALQAAPDAVFSTAVTSLKPEDAFDPNRVKCVVDNRGYAIYFSRGLIPFNKSGKVNPQFPYLLHLGIQSFDSKFLKIYPELPSTPLQLEEDLEQLKVLENGYKMKVIKVDHEAHGVDVPEDIGKIEQYMRERNLE

SEQ ID NO: 19828 - protein, 297 aa, Prunus persica
MSVCSSSSSSSSGSWSSTKAWIVHGIVAGVAIAVAIGARVYLGPPKKFRSRVVGIIPARFDSSRFQGKPLVQILGKPMIQRTWERAKLATTLDHVVVATDDEKIRECCRSFGADVIMTSESCRNGTERCSEAIQKLEKKYDIVVNIQGDEPLIEPEIIDGIVKALQEAPDAVFSTAVTSLKLEDAFDPNRVKCVVDNSGYAIYFSRGLIPFNKSGKANPQFPYMLHLGIQSYDTGFLKIYPQLEPTPLQLEEDLEQLKVLENGYKMKVIKVDHEAHGVDAPEDVEKIESLMLQRNLS

SEQ ID NO: 19829 - protein, 297 aa, Citrullus lanatus
MSVCSSSSSSSSGYLGSAKAWIVHGIVAGITIGAAVGARAYLGRSKKFRSRVVGIIPARFASSRFQGKPLVEILGKPMIQRTWERAKMATSLDCVVVATDDAKIAQCCRGFGADVVMTSESCRNGTERCNEALQKLEKKYDIVVNIQGDEPLIEPEIIDGIVKALQAAPDAVFSTAVTSLKPEDAFDPNRVKCVVDNHGYAIYFSRGLIPFNKSGKVNLHYPYLLHLGIQSFDSKFLSMYPELEPTPLQLEEDLEQLKVLEHGYKMKVIKVDHEAHGVDVPEDVEKIESFMKERNLA

SEQ ID NO: 19830 - protein, 295 aa, Malus domestica
MSTCSSSSSSGSWNSTKAWIVHGIVAGVAVAVAIGARVYLGPTKKFRSRVVGIIPARFASSRFQGKPLVQILGKPMIQRTWERAKLASTLDRVVVATDDERIQECCHSFGADVVMTSESCRNGTERCSEAIEKLEKNYDIVVNIQGDEPLIEPEIIDGIVKALQEAPDAVFSTAVTSLKFEDALDPNRVKCVVDNSGYAIYFSRGLIPFNKSGKANPQFPYLLHLGIQSYDTKFLKIYPELQPTPLQLEEDLEQLKVLENGYKMKVIKVDHEAHGVDAPEDVEKIESLMRERNLS

SEQ ID NO: 19831 - protein, 293 aa, Gossypium hirsutum
MSVCSSSSSSSSTGKAWIVHSILAGTAIAVAIGARAYLGRARKFRTRVVGIIPARYASSRFEGKPLVHILGKPMIQRTWERSKLATTLDHLVVATDDEKIAECCRGFGADVIMTSESCQNGTERCNEALEKLEKKYDIVVNIQGDEPLIEPEIIDGIVKALQAAPDAVFSTAVTSLKPEDAFDPNRVKCVVDNRGYAIYFSRGLIPFNKSAKVNPQFPYMLHLGIQSYDSKFLQIYPKLQPTPLQLEEDLEQLKVLENGYKMKVIKVEHEAHGVDTPEDVEKIESLMRERNLS

SEQ ID NO: 19832 - protein, 299 aa, Trifolium pratense
MTICSSPSSSSSSSSSNNSKTWIIHGIVAGVAIVAAASGAHAYFRRFNKFRSRVVGIIPARFASSRFSGKPLVQILGKPMIQRTWERAKLAASLDHVVVATDDERIADCCRTFGADVIMTSESCRNGTERCDEALEKLGKKYDIVVNIQGDEPLVEPEIIDGVVKALQAAPDAVFSTAVTSLKPEDALDPNRVKCVVDNRGYAIYFSRGLIPFNKSGKVNQQFPYLLHLGIQSYDTKFLKIYPDLQPTPLQLEEVLEQLKVLENGYKMKVIKVDHDAHGVDTPEDVEKIESLMRQRNLS

SEQ ID NO: 19833 - protein, 298 aa, Cucurbita pepo
MSVCSSSSSSSSGGYLGSAKAWIVHGIVAGITIGAAIGARAYLGRSRKFRSRVVGIIPARFASSRFQGKPLVEILGKPMIQRTWERAKMATTLDCVVVATDDAKIAQCCKGFGADVVMTSESCRNGTERCNEALQKLEKKYDIVVNIQGDEPLIEPEIIDGIVKALQAAPDAVFSTAVTSLKPEDAFDPNRVKCVVDNRGYAIYFSRGLIPFNKSGKVNLQYPYLLHLGIQSFDSKFLSIYPELQSTPLQLEEDLEQLKVLEHGYKMKVIKVDHEAHGVDVPGDVEKIESFMKERNLS

SEQ ID NO: 19834 - protein, 298 aa, Beta vulgaris
MNPLSMCSSSSSQSSSTKTWVVHGLVLGAAAAAAIGAHAYFFLRRSRKFRARVIGIIPARFASSRFEGKPLVEILGKPMIQRTYERAKLASMLDQVVVATDDNKIAECCRGFGADVIMTSESCRNGAERCSEALQKLTKKYDVVVNIQGDEPLIDPEIIDGIVKALQSAPDAVFSTAVTPLKPEDAFDPNRVKCVVDNLGYAIYFSRGLIPYNKSGKVNPDFPYMLHLGIQSYDAEFLKIYPDLQPTPLQLEEDLEQLKVLENGYKLKVIKVEHEAHGVDVPEDVEKIERYMREKNLS

SEQ ID NO: 19835 - protein, 297 aa, Euonymus alatus
MGPTSVCSPSSSGSSSSTKSLIVHGIVAGAAIAVAIGAGAYLGRFRKFRSRVVGIIPARFASSRFEGKPLIEILGKPMIQRTWERSKLATTLDHVVVATDDEKIAECCIGFGADVIMTSESCQNGTERCNEALQKLEKKYDIVVNIQGDEPLIEPEIIDGVVKALQAAPDAVFSTAVTSLKPEDAFDPNRVKCVVDNRGYALYFSRGLIPYNKSAQINPDFPYLLHLGIQSYDSKFLRIYPDLQPTPLQLEEDLEQLKVLENGYKMKVIKVDHEAHGVDIPEDVEKIEALMRERNLT

SEQ ID NO: 19836 - protein, 308 aa, Cajanus cajan
MAICSSPSSSSSSSSSSSSTSSFGSPNNAKTWIIHGIVAGVAIAAAVGARAYMTRFNKFRSRVVGIIPARYASSRFQGKPLVEILGKPMIQRTWERAKLAATLDHVVVATDDEKIADCCRQFGADVIMTSESCRNGTERCNEALQKLGKKYDIVVNIQGDEPLVEPEIIDGIVKALQAAPDAVFSTAVTSLKPEDAHDPNRVKCVVDNRGYAIYFSRGLIPFNKSGKVNQQFPYLLHLGIQSYDTKFLKIYPDLQPTPLQLEEDLEQLKVLENGYKMKVIKVDHEAHGVDTPEDVGKIESFMRERNLS

SEQ ID NO: 19837 - protein, 297 aa, Cucumis melo
MSVCSSSSSSSSGYLGSAKAWIVHSIVAGIAIGAAFGARSYLGRSKRFRSRVVGIIPARFASSRFEGKPLVEILGKPMIQRTWERAKMATTLDCVVVATDDAKIAQCCKGFGADVVMTSESCRNGTERCNEALHKLEKKYDIVVNIQGDEPLIEPEIIDGIVKALQAAPDAVFSTAVTSLKSEDAFDPNRVKCVVDSRGYAIYFSRGLIPFNKSGKVNLQFPYLLHLGIQSYDSKFLSIYPELEPTPLQLEEDLEQLKVLEHGYKMKVIKVDHEAHGVDVPEDVEKIESFMKERNLA

SEQ ID NO: 19838 - protein, 290 aa, Malus domestica
MSSSSGSWNSTKAWIVHGIVAGVAVAAAIGARAYLGPTRKFRSRVVGIIPARFASSRFQGKPLVQILGKPMIQRTWERAKLASTLDHVVVATDDEKIRECCRSFGADVIMTSESCRNGTERCSEAIEKLEKKYDIVVNIQGDEPLIEPEIIDGIVKALQAAPDAVFSTAVTSLKLEDAMDPNRVKCVVNNSGYAIYFSRGLIPFNKSGKANPQFPYLLHLGIQSYDTKFLKIYPELQPTPLQLEEDLEQLKVLENGYKMKVIKVDHEAHGVDTPEDVEKIESLMCERNLS

SEQ ID NO: 19839 - protein, 305 aa, Glycine max
MAICSSPSSSSSSSSSTSSFGSSNTAKAWIIHGIVAGVAIAAAVGARAYMTRFSKFRSRVVGIIPARFASSRFEGKPLVQILGKPMIQRTWERAKLAATLDHVVVATDDEKIADCCRQFGADVIMTSESCRNGTERCNEALQKLGKKYDIVVNIQGDEPLIEPEIIDGVVKALQAAPDAVFSTAVTSLKPEDAHDPNRVKCVVDNRGYAIYFSRGLIPFNKSGKVNQQFPYLLHLGIQSYDAKFLNIYPNLRPTPLQLEEDLEQLKVLENGYKMKVIKVHHEAHGVDTPEDVGKIESLMRERNLS

SEQ ID NO: 19840 - protein, 294 aa, Chenopodium quinoa
MSNSSSLSSSSSTKSWVVHGLVVGAAVAASIGAHTYFYFRRSRRFRSRVIGIIPARFASSRFEGKPLVDILGKPMIQRTYERAKLASMLDQVVVATDDNKIAECCRGFGADVIMTAESCRNGAERCSEALQKLNKKYDIVVNIQGDEPLIEPEIIDGIVKALQSAPDAVFSTAVTPLKPGDAFDTNRVKCVVDNLGYAIYFSRGLIPYNKSGQVNPDFPYLLHLGIQSYDAEFLKIYPDLPPTPLQLEEDLEQLKVLENGYKLKVIKVEHEAHGVDVPEDVEKIERFMREKNLS

SEQ ID NO: 19841 - protein, 294 aa, Eschscholzia californica
MSTLCSSSENNSSKSWIVHALVAGAAIAAAAGAYSLISLRRYGKFRSRVIGIVPARFASSRFEGKPLVKILGKPMIQRTWERAKLASTLDHIVVATDDERIAECCRGFGADVIMTSESCQNGTERCNEALMKIGKKYDIVVNIQGDEPLIEPDIIDGIVKALQEAPDAVFSTAVTSLKPEDSSDPNRVKCVVDNRGYAIYFSRGLIPYNKSGKVNPNFPYLLHLGIQSYDVKFLKIYPELTPTPLQLEEDLEQLKVLENGYKMKVIKVDHDAHGVDTPEDVEKIEALMRERNLS

SEQ ID NO: 19842 - protein, 288 aa, Trifolium pratense
SSSSSNNSKTWIIHGILAGVAIAAAASGAHAYFRRFNKFRSRVVGIIPARFASSRFSGKPLVQILGKPMIQRTWERAKLAASLDHVVVATDDEMIADCCRTFGADVIMTSESCRNGTERCDEALEKLGKKYDIVVNIQGDEPLIEPEIIDGVVKALQAAPDAVFSTAVTSLKPEDALDPNRVKCVVDNRGYAIYFSRGLIPFNKSGKVNQQFPYLLHLGIQSYDTKFLKIYPDLQPTPLQLEEDLEQLKVLENGYKMKVIKVDHDAHGVDTPEDVEKIESLMRERNLS

SEQ ID NO: 19843 - protein, 298 aa, Ambrosia trifida
MSPNSICTGSSSTDHGSTKLLILHGVAAAAALVAGAHAYLYYRRSTAMFRSRVVGIIPARFASSRFQGKPLVEILGKPMIQRTWERAKLATTLDRVVVATDDEKIAECCRGFGADVIMTAESCRNGAERCSEALQKLEKKYDIVVNIQGDEPLIEPEIIDGIVKALQTTPDAVFSTAVTALKPEDAFDPNRVKCVVDNRGYAIYFSRGLIPFNKSGKVNPAFPYNLHLGIQSYDSEFLKIYPDLTPTPLQLEEDLEQLKVLENGYKMKVIKVDHDAHGVDTPEDVAKIESFMRERNLS

SEQ ID NO: 19844 - protein, 306 aa, Glycine max
MAICSSLSSSSSSSSSSTSSFGSSSTAKAWIIHGIVAGVAIAAAVGARAYMTRFSKFRSRVVGIIPARFASSRFQGKPLVQILGKPMIQRTWERAKLAATLDHIVVATDDEKIADCCRQFGADVIMTSESCRNGTERCNEALQKLGKKYDIVVNIQGDEPLIEPEIIDGVVKALQAAPDAVFSTAVTSLKPEDAHDPNRVKCVVDNRGYAIYFSRGLIPFNKSGMVNQQFPYLLHLGIQSYDAKFLNIYPDLQPTPLQLEEDLEQLKVLENGYKMKVIKVDHEAHGVDTPEDVGKIESLMRERNLS

SEQ ID NO: 19845 - protein, 290 aa, Daucus carota
MSISTSSSSSSSSKSWIVHSLLVGAAMAVAAGAYLRRGNRFRSRVVGIIPARYASSRFEGKPLVEILGKPMIQRTWERANLATMLDHVVVATDDEKIATCCRGFGADVIMTSESCRNGTERCNEALQKLKKKYDVVVNVQGDEPLIEPEIIDGIVKALQAAPAAVVSTAVTALAPEDAFDLNRVKCVVDNSGYAIYFSRGLIPYNKSGKVNPKFPYMLDLGIQSFDTKFLKIYPELPPTPLQLEEDLEQLKVLENGYKMKVIKVDHNAHGVDTPEDVEKIERYMRERNLS

SEQ ID NO: 19846 - protein, 304 aa, Cicer arietinum
MAICSSPSSSSSSSSSSSYDSSNNSKSLIIHGIVAGVAVAAAVGARTYLTRFNKFRSRVVGIIPARFASSRFSGKPLVQILGKPMIQRTWERAKLAASLDHVVVATDDEKIADCCRQFGADVIMTSVSCRNGTERCNEALQKLGRKYDIVVNIQGDEPLVEPEIIDGVVKALQAAPDAVFSTAVTSLKPEDALDPNRVKCVVDNRGYAIYFSRGLIPFNKSGKVNQQFPYLLHLGIQSYDTKFLKIYPDLQPTPLQLEEDLEQLKVLENGYKMKVIKVDHDAHGVDTPEDVEKIEALMRQRNLS

SEQ ID NO: 19847 - protein, 295 aa, Musa acuminata
MAICAPSSSDSSSGSRAWVVHAALLGAAIAAAAGAHFYLRRWSSGFRSRVVGIIPARFDSSRFQGKPLAQILGKPMIQRTWERAKLASTLENVVVATDDEKIAECCRGFGADVVMTSVGCRNGTERCNEALEKLGKNYDIVVNIQGDEPLIEPEIIDGIVKALQGAPDAVFSTAVTSLKPEDGLDPNRVKCVVDNHGYAIYFSRGLIPFNKSGKVNPQFPYLLHLGIQSFDAKFLKIYPQLPPTPLQLEEDLEQLKVLENGYKMKVIKVNHDAHGVDTPEDVAKIEALMRERNIA

SEQ ID NO: 19848 - protein, 297 aa, Cucumis sativus
MSVCSSSSSSSSGYLGSAKAWIVHGIVAGIAIGAAFGARSYLGRSKKFRSRVVGIIPARFASSRFEGKPLVEILGKPMIQRTWERAKMATTLDCVVVATDDARIAQCCKGFGADVVMTSESCRNGTERCNEALQKLEKKYDIVVNIQGDEPLIEPEIIDGIVKALQAAPDAVFSTAVTSLKPEDAFDPNRVKCVVDSRGYAIYFSRGLIPFNKSGKVNLQYPYLLHLGIQSFDSKFLSMYPELESTPLQLEEDLEQLKVLEHGYKMKVIKVEHEAHGVDVPEDVDKIESFMKERNLA

SEQ ID NO: 19849 - protein, 296 aa, Lupinus angustifolius
MGICSSPSSSFESSNNGKTWIIHGIVVGVAVTAAVVAHAYLNRFNKIRTRVIGIIPARFASSRFPGKPLVLIHGKPMIQRTWERAKLAATLDHVVVATDDEKIADCCRQFGADVIMTSESCQNGTERCNEALQKLGKKYDVVVNIQGDEPLIEPEIIDGVVKALQADPDAVFSTAVTSLNPEDAHDPNRVKCVVDNRGYAIYFSRGLIPFNKSGKINQQFPYLLHLGIQSYDAKFLKIYPYLQPTPLQLEEDLEQLKVLENGYKMKVVKVDHEAHGVDTPEDVQKIESLMLERNLA

SEQ ID NO: 19850 - protein, 301 aa, Chenopodium quinoa
QSNPTNPMSNSSSLSSSSSTKSWVVHGLVVGAAVAAAIGAHTYFYFRRSRRFRSRVIGIIPARFASSRFEGKPLVDILGKPMIQRTYERAKLASMLDQVVVATDDNKIAECCRGFGADVIMTAESCRNGAERCSEALQKLNKKYDIVVNIQGDEPLIEPEIIDGIVKALQSAPDAVFSTAVTPLKPGDAFDTNRVKCVVDNLGYAIYFSRGLIPYNKSGQVNPDFPYLLHLGIQSYDAEFLKIYPDLPPTPLQLEEDLEQLKVLENGYKLKVIKVEHEAHGVDVPEDVEKIERFMREKNLS

SEQ ID NO: 19851 - protein, 290 aa, Amorphophallus konjac
MASSGSGVSSSKVWIVHGLMLGAAVAAGAYAAFSFRRGGRFRSRVVGIIPARFASSRFQGKPLVDILGKPMIQRTWERAKLATTLDHVVVATDDEKIAECCRGFGADVIMTSETCRNGTERCNEALQKLDKKYDIVVNIQGDEPLIEPEIIDGVVKALQGAPDAVFSTAVTSLKPEDGTDTNRVKCIVDNHGYAIYFSRGLIPFNKSGKVNPKFPYLLHLGIQSYDSNFLRIYPELPPTPLQLEEDLEQLKVLENGYKMKVIKVDHDAHGVDTPEDVEKLEALMRERNLA

SEQ ID NO: 19852 - protein, 293 aa, Raphanus sativus
MSPSSSSSSSSSSQKTWIVHAILAGTAIAAAIGARAYLGRSRKFRSRVVGIIPARYASSRFEGKPLVKILGKPMIQRTWERSKLASTLDHVVVATDDERIADCCRGFGADVIMTSESCRNGTERCSEALEKLEKKYDVVVNIQGDEPLIEPEIIDGVVKALQRAPDAVFSTAVTSLKPEDGLDPNRVKCVVDNRGYAIYFSRGLIPYNKSGKVNPDFPYMLHLGIQSFDSKFLKVYSELQPTPLQLEEDLEQLKVLENGYRMKVIKVDHEAHGVDTPDDVEKIESLMRERNLL

SEQ ID NO: 19853 - protein, 307 aa, Trigonella foenum-graecum
MAICSSPSSSSSSSSSSSSSSIDSPNNTKAWIIHGILVGVSIAAAAGAHAYLSRFNKFRSRVVGIIPARFASSRFQGKPLVHILGKPMIQRTWERAKLAASLDHVVVATDDEKIADCCRKFGADVIMTSESCQNGTERCNEALQKLGRKYDIVVNIQGDEPLVEPEIIDGVVKALQAAPDAVFSTAVTALKPEDAHDPNRVKCVVDNRGYAIYFSRGLIPFNKSGKVNQQFPYLLHLGIQSYDTKFLKIYPYLQPTPLQLEEDLEQLKVLENGYKMKVIKVDHEAHGVDTPEDVEKIEALMRQRNLS

SEQ ID NO: 19854 - protein, 290 aa, Arabidopsis thaliana
MSVCSSSSSSQKTWIVNGILAGTAIAAAIGARAYLGRSKKFRSRVVGIIPARYASSRFEGKPLVQILGKPMIQRTWERSKLATTLDHIVVATDDERIAECCRGFGADVIMTSESCRNGTERCNEALEKLEKKYDVVVNIQGDEPLIEPEIIDGVVKALQVTPDAVFSTAVTSLKPEDGLDPNRVKCVVDNRGYAIYFSRGLIPYNKSGKVNPDFPYMLHLGIQSFDSKFLKVYSELQPTPLQQEEDLEQLKVLENGYKMKVIKVDHEAHGVDTPDDVEKIESLMRERNMS

SEQ ID NO: 19855 - protein, 289 aa, Brassica napus
  Sequence also found in Organisms: Brassica oleracea, Brassica rapa
MALSSSSSSQKTWIVHGILAGTAIAAAIGARAYLGRSRKFRSRVVGIIPARYASSRFEGKPLVQILGKPMIQRTWERSKLASTLDHVVVATDDERIADCCRGFGADVIMTSESCRNGTERCNEALEKLEKKYDVVVNIQGDEPLIEPEIIDGVVKALQVAPDAVFSTAVTSLKPEDGLDPNRVKCVVDNRGYAIYFSRGLIPYNKSGKVNPDFPYMLHLGIQSFDSKFLKVYSELQPTPLQLEEDLEQLKVLENGYKMKVIKVDHEAHGVDTPDDVEKIESLMRERNLL

SEQ ID NO: 19856 - protein, 290 aa, Gossypium hirsutum
MSVCSSSSSTGKAWIVHSILAGTAIAVAIGAHAYLGRARKFRTRVVGIIPARYASSRFEGKPLVHILGKPMIQRTWERSKLATTLNHLVVATDDEKIAECCRGFGADVIMTSESCQNGTERCNEALEKLEKKYDIVVNIQGDEPLIEPEIIDGIVKALQAAPDAVFSTAVTSLKPEDAFDPNRVKCVVDNRGYAIYFSRGLIPFNKSAKVNPQFPYMLHLGIQSYDSKFLQIYPKLQPTPLQLEEDLEQLKVLENGYKMKVIKVEHEAHGVDTPEDVEKIESLMRERNLS

SEQ ID NO: 19857 - protein, 298 aa, Cannabis sativa
MSTRSSSSTSSSSSCGSSATTIAWIGYGIAAITAAAIGARFYLGRATKFRSRVVGIIPARFASSRFEGKPLVQILGKPMIQRTWERAKLAGSLDHIVVATDDDKIAECCRGFGADVVMTSVSCRNGTERCNEALQKLGKKYDIVVNIQGDEPLLEPEIIDGIVKALQDAPDAVFSTAVTSLKPEDAFDPNRVKCVMDNRGYAIYFSRGLLPYNKLGKVNPQFPYWLHLGIQSYDSKFLQIYSELEPTPLQLEEDLEQLKVLENGYKMKVIKVDHEAHGVDIPEDVEKIESLMRQNNLS

SEQ ID NO: 19858 - protein, 294 aa, Papaver somniferum
MDQGSSCGSNSNCKSWIMYGLVTGAAIAAAAIGAAFSIRGGSGKFRSRVIGIIPARYASSRFEGKPLVHILGKPMIQRTWERAKLASTLDHVVVATDDEKIAECCRGFGADVIMTSESCRNGTERCNEALEKLEKKYDIVVNIQGDEPLIEPEIIDGIVKALQGAPDAVFSTAVTSLTPEDSTDPNRVKCIVDNHGYAIYFSRGLIPFNKSGKVNPNFPYLLHLGIQSYDSKFLKIYSELAPTPLQLEEDLEQLKVLENGYKMKVIKVDHDAHGVDTPEDVGKLEALMRERNLV

SEQ ID NO: 19859 - protein, 282 aa, Cichorium intybus
MSTKSWVLHGVAVAAALVGAHAYFYYRRSATMFRSRVVGIIPARFASSRFQGKPLVEILGKPMIQRTWERAKLATTLDRVVVATDDEKIAECCRGFGADVIMTAESCRNGAERCSEALQKLDKKYDIVVNIQGDEPLIEPEIIDGIVKALQTTPDAVFSTAVTSLKPEDAFDPNRVKCVVDNRGYAIYFSRGLIPFNKSGKTNPEFPYNLHLGIQSYDSEFLKIYPDLTPTPLQLEEDLEQLKVLENGYKMKVIKVDHDAHGVDTPEDVAKIENFMRERNLS

SEQ ID NO: 19860 - protein, 294 aa, Ananas comosus
MTICASSSSDSTGSETSRAWIVHGVVVLAGAAAAAALYLRRSRNLRRRVVGIIPARFASSRFEGKPLVRILGKPMIQRTWERAKLASTLDHVVVATDNEKIAECCRGFGADVIMTSESCRNGTERCNEALQKLGKTYDIVVNIQGDEPLIEPEIIDGIVRALQGAPDAVFSTAVTALKPEDAFDPNRVKCVINNSGYAIYFSRGLIPFNKSGKVNPKFPYLLHLGIQSYDTKFLKIYPQLPPTPLQLEEDLEQLKVLENGYKMKVIKVDHDAHGIDTPEDVEKIEALMRERNIQ

SEQ ID NO: 19861 - protein, 293 aa, Papaver somniferum
MDQGSSCGSNSNCKSWIVYGLVTGAAIAAAAIGAAFSIRGSGKFRSRVIGIIPARYASSRFEGKPLVHILGKPMIQRTWERAKLASTLDHVVVATDDEKIAECCRGFGADVIMTSESCRNGTERCNEALEKLEKKYDIVVNIQGDEPLIEPEIIDGIVKALQGAPDAVFSTAVTSLTPEDSTDPNRVKCIVDNHGYAIYFSRGLIPFNKSGKVNPNFPYLLHLGIQSYDSKFLKIYSELAPTPLQLEEDLEQLKVLENGYKMKVIKVDHDAHGVDTPEDVGKLEVLMRERNLV

SEQ ID NO: 19862 - protein, 301 aa, Fragaria vesca
MNLKSVRPSSSSSSSSSSGSTAKVWIVHGLVAGVAIAAAIGARAYLGPIRKFRSRVVGIIPARYASSRFQGKPLVQILGKPMIQRTWERAKMASTLDHIVVATDDEKIAECCRSFGADVIMTSESCPNGTERCYEAIQKLEKKYDVVVNIQGDEPLVEPEIIDGIVKALQEAPDAVFSTAVTSLKLEDASDPNRVKCVVDNNGYAIYFSRGLIPFNKSGKANPQFPYMLHLGIQSYDTKFLKIYRELKPTPLQLEEDLEQLKVLENGYRMKVIKVDHEAHGVDTPEDVEKIEALMRERNIS

SEQ ID NO: 19863 - protein, 291 aa, Eutrema halophilum
MAACSSSSSSSQKTWIVHGILAGTAIAAAIGARAYLGRSRKFRSRVVGIIPARYASSRFEGKPLVQILGKPMIQRTWERSKLASTLDHVVVATDDERIADCCRGFGADVIMTSESCRNGTERCNEALEKLEKKYDVVVNIQGDEPLIEPEIIDGVVKALQLAPDAVFSTAVTSLRPEDGLDPNRVKCVVDNRGYAIYFSRGLIPYNKSGKVNPDFPYMLHLGIQSFDSKFLKVYSELQPTPLQLEEDLEQLKVLENGYKMKVIKVDHEAHGVDTPDDIEKIESLMRERNLS

SEQ ID NO: 19864 - protein, 297 aa, Echinacea purpurea
MSPKSICTGSSPDQTSTKSLILHGVAAAAALVVGAHAYFFYRRSATMFRSRVVGIIPARFASSRFQGKPLVEILGKPMIQRTWERAKLATTLDRVVVATDDEKIAECCRGFGADVIMTAESCRNGAERCSEALQKLEKKYDIVVNIQGDEPLIEPEIIDGIVKALQTTPDAVFSTAVTSLKPEDAFDPNRVKCVVDNRGYAIYFSRGLIPFNKSGKVNPAFPYNLHLGIQSYDSEFLKIYPDLTPTPLQLEEDLEQLKVLENGYKMKVIKVDHDAHGVDTPEDVAKIENYMRERNLS

SEQ ID NO: 19865 - protein, 284 aa, Cirsium arvense
MSSTKAWILHAVAAAAALAVGAPAYFYYRRSATMFRSRVVGIIPARFASSRFQGKPLVDILGKPMIQRTWERAKLATTLDCVVVATDDEKIAECCRGFGADVIMTAESCRNGAERCSEALQKLGKKYDIVVNIQGDEPLIDPEIIDGIVKALQTTPDAVFSTAVTSLKPEDAFDPNRVKCVVDNRGYAIYFSRGLIPFNKSGKTNPEFPYNLHLGIQSYDSEFLKIYPDLTPTPLQLEEDLEQLKVLENGYKMKVIKVDHDAHGVDTPEDVAKIESFMRERNLT

SEQ ID NO: 19866 - protein, 309 aa, Arachis hypogaea
MAFCPSPSSSSSSSDSSSSSSSPFESSNSAKFWILHGIMAGVAVAAAVGARAYWTRVKKFRNRVVGIIPARFASTRFQGKPLVEILGKPMIQRTWERAKLAATLDQVVVATDDEKIAECCRKFGADVVMTSESCRNGTERCSEALEKLGKNYDIVVNIQGDEPLIEPEIIDGIVKALQATPDAVFSTAVTSLKPEDALDPNRVKCVVDNRGYAIYFSRGLIPFNKSGKVNQQFPYLLHLGIQSYDTKFLKIYPDLQPTPLQLEEDLEQLKVLENGYKMKVIKVNHEAHGVDIPEDVQKIESLMRERNLS

SEQ ID NO: 19867 - protein, 301 aa, Cichorium intybus
MSWMISKSTSAGSSRPENVMSTKFWVLHGVAVAAALVGAHAYFYYRRSTTMFRSRVVGIIPARFASSRFQGKPLVQILGKPMIQRTWERAKLATTLDRVVVATDDEKIAECCRGFGADVIMTSESCRNGAERCSEALEKLDKKYDIAVNIQGDEPLIEPEIIDGIVKALQTTPDAVFSTAVTSLKPEDAFDPNRVKCVVDNRGYAIYFSRGLIPFNKSGKTNPEFPYNLHLGIQSYDSEFLKIYPDLTPTPLQLEEDLEQLKVLENGYKMKVIKVDHDAHGVDTPEDVAKIENFMRERNLS

SEQ ID NO: 19868 - protein, 301 aa, Cichorium intybus
MSWMISKSTSAGSSRPENVMSTKFWVLHGVAVAAALVGAHAYFYYRRSATMFRSRVVGIIPARFASSRFQGKPLVEILGKPMIQRTWERAKLATTLDRVVVATDDEKIAECCRGFGADVIMTAESCRNGAERCSEALQKLDKKYDIVVNIQGDEPLIEPEIIDGIVKALQTTPDAVFSTAVTSLKPEDAFDPNRVKCVVDNRGYAIYFSRGLIPFNKSGKTNPEFPYNLHLGIQSYDSEFLKIYPDLTPTPLQLEEDLEQLKVLENGYKMKVIKVDHDAHGVDTPEDVAKIENFMRERNLS

SEQ ID NO: 19869 - protein, 282 aa, Cichorium intybus
MSTKFWVLHGVAVAAALVGAHAYFYYRRSATMFRSRVVGIIPARFASSRFQGKPLVEILGKPMIQRTWERAKLATTLDRVVVATDDEKIAECCRGFGADVIMTAESCRNGAERCSEALQKLDKKYDIVVNIQGDEPLIEPEIIDGIVKALQTTPDAVFSTAVTSLKPEDAFDPNRVKCVVDNRGYAIYFSRGLIPFNKSGKTNPEFPYNLHLGIQSYDSEFLKIYPDLTPTPLQLEEDLEQLKVLENGYKMKVIKVDHDAHGVDTPEDVAKIENFMRERNLS

SEQ ID NO: 19870 - protein, 299 aa, Aquilegia formosa
MNSISTCLSSSSSSSSGTNSKALIVHGLLATAAIAGGAYVAISLCRTSKFRSRVIGIIPARFASTRFEGKPLVPILGKPMIQRTWERAKMATTLDHIVVATDDEKIAECCRGFGADVIMTSESCRNGTERCNEALLKLEKKYDVVVNIQGDEPLIEPEIIDGIVKALQGAPDAVFSTAVTSLKPEDGHDPNRVKCVVDNQGYAIYFSRGLIPFNKSGQVNPKFPYLLHLGIQSYDTKFLRIYPDLPPTPLQLEEDLEQLKVLENGYKMKVIKVDHDAHGVDTPEDVEKIESLMRERNIS

SEQ ID NO: 19871 - protein, 297 aa, Cocos nucifera
MVICSPSSESSSATSGRAWIIQALVAGAAVAVAVGAHAAVYFKWFRKGRSRVVGIIPARFASSRFEGKPLVQILGKPMIQRTWERAKLASTLDHIVVATDDERIAECCRGFGADVIMTAESCRNGTERCNEALLKLGKHYDIVVNIQGDEPLLEPDIIDGIVRALQGAPDAVFSTAVTSLKPEDGLDPNRVKCVVDNHGYAIYFSRGLIPYNKSGKVNPEFPYLLHLGIQSFDSKFLRIYPELPPTPLQLEEDLEQLKVLENGYKMKVIKVDHDAHGVDTPEDVEKIEALMRERNIS

SEQ ID NO: 19872 - protein, 277 aa, Echinacea purpurea
IIHGVAVGAAAALALGAHYMYYRRSGKFRSRVVGIIPARFASSRFQGKPLVNILGKPMIQRTWERAKMATSLDHIVVATDDEKIADCCRGFGADVVMTSESCRNGTERCNEALSKLDKKYDVVVNIQGDEPLIEPEIIDGIVKALQAAPDAVFSTAVTSLKSEDAYDPNRVKCVVDNHGYAIYFSRGLIPFNKSGNVNPQFPYLLHLGIQSYDTKFLNIYPELPPTPLQLEEDLEQLKVLENGYKMKVIKVDHESHGVDIPEDVDKIESYMRERNLH

SEQ ID NO: 19873 - protein, 294 aa, Papaver somniferum
MDQGSSCGSNSNCKSWIMYGLVTGAAIAAAAIGAAFSIRGGSGKFRSRVIGIIPARYASSRFEGKPLVHILGKPMIQRTWERAKLASTLDHVVVATDDEKIAECCRGFGADVIMTSESCRNGTERCNEALEKLEKKYDIVVNIQGDEPLIEPEIIDGIVKALQGAPDAVFSTAMTSLTPEDSTDPNRVKCIVDNHGYAIYFSRGLIPFNKSGKVNPNFPYLLHLGIQSYDSKFLKIYSELAPTPLQLEEDLEQLKVLENGYKMKVIKVDHHAHGVDTPEDVGKLEALMRERNLL

SEQ ID NO: 19874 - protein, 299 aa, Helianthus annuus
MSLNSICTGSSSSDRGSTKSSLILHGVAAAAALVVGAHAYYFYRRSATVFRSRVVGIIPARFASSRFQGKPLVEILGKPMIQRTWERAKLATTLDRVVVATDDEKIAECCRGFGADVIMTAESCRNGAERCSEALQKLEKKYDIVVNIQGDEPLIEPEIIDGIVKALQTTPDAVFSTAVTALKPEDAFDPNRVKCVVDNRGYAIYFSRGLIPFNKSGKVNPSFPYNLHLGIQSYDSEFLKIYPDLTPTPLQLEEDLEQLKVLENGYKMKVIKVDHDAHGVDTPEDVAKIESYMREKNLS

SEQ ID NO: 19875 - protein, 300 aa, Flaveria ramosissima
MTPKSICTSSSPANSDFPMTTKALILHGVAAAAALVVGAHAYYYYHRSTKFRSRVVGIIPARFASTRFQGKPLVEILGKPMIQRTWERAKLATTLDCVVVATDDEKIAECCRGFGADVIMTAESCRNGAERCSEALQKLKKKYDIVVNIQGDEPLIEPEIIDGIVKALQTTPDAVFSTAVTSLKPEDAFDPNRVKCVVDNRGYAIYFSRGLIPFNKSGKANLEFPYNLHLGIQCYDSEFLKIYPDLTPTPLQLEEDLEQLKVLENGYKMKVIKVDHDAHGVDTPEDVAKIENFMRERNLS

SEQ ID NO: 19876 - protein, 301 aa, Cichorium intybus
MSWMISRWTCAGSSRPEIGMSTKSWVLHGVAVAAALVGAHAYFYYRRSATMFRSRVVGIIPARFASSRFQGKPLVEILGKPMIQRTWERAKLATTLDRVVVATDDEKIAECCRGFGADVIMTAESCRNGAERCSEALQKLDKKYDIVVNIQGDEPLIEPEIIDGIVKALQTTPDAVFSTAVTSLKPEDAFDPNRVKCVVDNRGYAIYFSRGLIPFNKSGKTNPEFPYNLHLGIQSYDSEFLKIYPDLTPTPLQLEEDLEQLKVLENGYKMKVIKVDHDAHGVDTPEDVAKIENFMRERNLS

SEQ ID NO: 19877 - protein, 297 aa, Cocos nucifera
MAVCSPSSKSSSATSGRAWVVHALVVGAAVVAALGAHAAVYFKWIRKDRSRVVGIIPARFASSRFEGKPLVRILGKPMIQRTWERTKLASTLDHVVVATDSEKIAECCREFGADVIMTSESCKNGTERCNEALQKLGKNYDIVVNIQGDEPLIEPDIIDGVVRALQGAPDAVFSTAVTSLKPEDGLDPNRVKCVVDNHGYAIYFSRGLIPYNKSGKVNPEFPYLLHLGIQSFDSKFLRIYPELPPTPLQLEEDLEQLKVLENGYKMKVIKVDHDAHGVDTPEDVEKIEALMRERNIS

SEQ ID NO: 19878 - protein, 300 aa, Flaveria ramosissima
MTPKSICTSSSPANADFPMSTKSLILHGVAAAAALLVGAHAYYYYHRSTKFRTRVVGIIPARFASSRFQGKPLVEILGKPMIQRTWERAKLATTLDCVVVATDDEKIAECCRGFGADVIMTAESCRNGAERCSEALQKLKKKYDIVVNIQGDEPLIEPEIIDGIVKALQTTPDAVFSTAVTSLKPEDAFDPNRVKCVVDNRGYAIYFSRGLIPFNKSGKANLEFPYNLHLGIQCYDSEFLKIYPDLTPTPLQLEEDLEQLKVLENGYKMKVIKVDHDAHGVDTPEDVAKIENFMRERNLS

SEQ ID NO: 19879 - protein, 290 aa, Brassica napus
  Sequence also found in Organisms: Brassica rapa
MTLCSSSSSSQKTWIVHGILAGMAIAAAIGARAYLGRSRKFRSRVVGIIPARYASSRFEGKPLVQILGKPMIQRTWERSKLASTLDHVVVATDDERIADCCRGFGADVIMTSESCRNGTERCNEALEKLEKEYDVVVNIQGDEPLIEPEIIDGVVKALQVSPDAVFSTAVTSLKPEDGLDPNRVKCVVDNRGYAIYFSRGLIPFNKSGGVNPEFPYMLHLGIQSFDSKFLNVYSELQPTPLQVEEDLEQLKVLENGYKMKVIKVDHEAHGVDTPEDVEKIESLMRERNLS

SEQ ID NO: 19880 - protein, 301 aa, Phaseolus vulgaris
MAPCSSSSSSSSTASFGSSTTAKTWIVHGIVAGVAITAAVGARAYMTRFSKFRSRVVGIIPARYASSRFQGKPLVQILGKPMIQRTWERAKLAVTLDHLVVATDDEKIADCCRQFGADVIMTSESCKNGTERCNEALQKLGKNYDIVVNIQGDEPLIEPEIIDGVVKTLQAAPDAVFSTAVTSLKPEDAHDPNRVKCVVDNSGYAIYFSRGLIPFNKSGKVNPKFPYLLHLGIQSYDAKFLRIYPDLQPTPLQLEEDLEQLKVLENGYKMKVIKVNHEAHGVDTPEDVGKLESLMRERNLS

SEQ ID NO: 19881 - protein, 299 aa, Helianthus annuus
MSLNSICTGSSSSDRGSTKSSLILHGVAAAAALVVGAHAYYFYRRSATVFRSRVVGIIPARFASSRFQGKPLVEILGKPMIQRTWERAKLATTLDRVVVATDDEKIAECCRGFGADVIMTAESCRNGAERCSEALQKLEKKYDIVVNIQGDEPLIEPEIIDGIVKALQTTPDAVFSTAVTALKPEDAFDPNRVKCVVDNRGYAIYFSRGLIPFNKSGKVNPSFPYNLHLGIQSYDSEFLKIYPDLTPTPLQLEEDLEQLKVLENGYKMKVIKVNHDAHGVDTPEDVAKIESYMREKNLS

SEQ ID NO: 19882 - protein, 292 aa, Valeriana officinalis
NGSKVRICTSSSPGPSSRAWIIHGLAVGAAVAVAIGAHAYINLLRPAKFRTRVIGIIPARMASSRFHGKPLVQILGKPMIQRTWERAKLAKTLDHVVVATDDEKIAECCRGFGADVIMTAESCRNGTERCNEALEKLEKKYDVVVNIQGDEPLVEPEIIDGIVKALQEAPDAVFSTAVTSLKPDDAFDTNRVKCVVDNRGYAIYFSRGLIPHNKSGKANPEFPYLLHLGIQSYDTKFLKIYPELPPTPLQLEEDLEQLKVLENGYKMKVIKVEHDAHGVDTPEDIEKIESYM

SEQ ID NO: 19883 - protein, 301 aa, Conyza canadensis
MTPKSPCTGSSSSDHGGQFMMSTKSWILHGVAAAAIAVGAHGYFFYRRSTMFRSRVVGIIPARFASSRFEGKPLVEILGKPMIQRTWERAKLATTLDRVVVATDDEKIAECCRGFGADVIMTAESCRNGAERCSEALQKLEKKYDIVVNIQGDEPLIEPEIIDGIVKALQTTPDAVFSTAVTSLKPEDAFDPNRVKCVVDNRGYAIYFSRGLIPFNKAGKANPDFPYNLHLGIQSYDSEFLKIYPDLTPTPLQLEEDLEQLKVLENGYKMKVIKVDHEAHGVDTPEDVAKIEKYMRERNLS

SEQ ID NO: 19884 - protein, 295 aa, Lactuca sativa
MIPKSTCAESSRPMSTKAWVLHGVAVAAALVGAHAYFYYRRSATVFRSRVVGIIPARFASSRFQGKPLVEILGKPMIQRTWERAKLATTLDRVVVATDDEKIAECCRGFGADVIMTAESCRNGAERCSEALQKLDKKYDIVVNIQGDEPLIDPEIIDGIVKALQTTPDAVFSTAVTSLKPEDAFDPNRVKCVVDNRGYAIYFSRGLIPFNKSGKINTEFPYNLHLGIQSYDSEFLKIYPDLSPTPLQLEEDLEQLKVLENGYKMKVIKVEHDAHGVDTPEDVAKIEKFMLERNLS

SEQ ID NO: 19885 - protein, 309 aa, Lupinus angustifolius
MSISPSPSSSSSSSSSSSSSSSSLESWNNGKTWIINGIVAGVAIAAAVGARTYLNRFNKFRSRVVGIIPARFASSRFQGKPLVQILGKPMIQRTWERAKLAATLDHVVVATDDERIADCCRKFGADVIMTSESCRNGTERCNEALQKLGKKYDVVVNIQGDEPLIEPEIVDGVVKALQAAPDAVFSTAVTSLKPEDAHDPNRVKCVVDNRGYAIYFSRGLIPFNKSGKVNQQFPYLLHLGIQSYDAKFLKIYPHLQPTPLQLEEDLEQLKVLENGYKMKVIKVDHEAHGVDTPEDVQKIESLMRERNLS

SEQ ID NO: 19886 - protein, 301 aa, Cichorium intybus
MSWMISRWTCAGSSRPEIGMSTKSWVLHGVAVAAALVGAHAYFYYRRSATMFRSRVVGIIPARFASSRFQGKPLVEILGKPMIQRTWERAKLATTLDRVVVATDDEKIAECCRGFGADVIMTAESCRNGAERCSEALQKLDKKYDIVVNIQGDEPLIEPEIIDGIVKALQTTPDAVFSTAVTSLKPEDAFDPNRVKCVVDNRGYAIYFSRGLIPFNKSGKTNPEFPYNLHLGIQSYDSEFLKIYPDLTPTPLQLEEDLEQLKVLENGYKMKVIKVDHDAHGVDTPEDVAKIENFMRQRNLS

SEQ ID NO: 19887 - protein, 293 aa, Aristolochia fimbriata
MTICSPSSSSSSGKSWIVHGLLAGAAVVAAGTYAIISIRKSGNLRSRVVGIIPARFASSRFPGKPLIPILGKPMIQRTWERAKLASTLDHVVVATDDENIAECCRGFGADVIMTSESCRNGTERCNEALQKLGKKFDIVVNIQGDEPVIEPEIIDGVVKALQGAPDAVFSTAVTALKPEDGFDPNRVKCIVDNRGYALYFSRGLIPYNKSGKINPEFPYFLHLGIQSYDSNFLRIYPQLPPTPLQLEEDLEQLKVLENGYKMKVIKVDHDAHGVDTPDDVHKIELMMRERNIS

SEQ ID NO: 19888 - protein, 300 aa, Centaurea maculosa
MELNSICASPSSSSSSSSAKLLLLHGVAVAVAVAISADAYIFYQRRSAAKFRSRVVGIIPARFASSRFEGKPLVMILGKPMIQRTWERAKLATTLDHVVVATDDEKIADCCRGFGADVIMTSESCRNGAERCSEALEKLEKEYDIVVNIQGDEPLIEPEVIDGIVKALQTTPDAVFSTAVTSLKPEDAFDPNRVKCVVDSHGYAVYFSRGLIPFNKSGKFNSKFPYNLHLGIQSYDTKFLKIYPKLTPTPLQLEEDLEQLKVLENGYKMKVIHVDHDAHGVDTPEDVAKIESFMREKNLA

SEQ ID NO: 19889 - protein, 291 aa, Fagopyrum esculentum
MVVGSPPSSSSSSESSSSKAWIYGAVAAVVIGAHAYYRSRKFRTRVIGIIPARFASSRFPGKPLVQILGKPMIQRTWERAKLASTLDHVVVATDDDKIAECCRGFGADVVMTSESCRNGTQRCNEALQKLQKKYDVVVNIQGDEPLIDPYIIDGIVKALQSAPDAVFSTAVTPLKPEDAFDPNRVKCIVNNQGYAIYFSRGLIPFNKSGNVNPKFPYMLHLGIQSYDSSFLKVYAELPPTLLQLEEDLEQLKVLENGYKMKVIKVEHDTHGVDVPEDVEKMENFMRENNLA

SEQ ID NO: 19890 - protein, 297 aa, Cocos nucifera
MAVCSPSSKSSSATSGRAWVVHALVVGAAVVAALGAHAAVYFKWIRKDRSRVVGIIPARFASSRFEGKPLVRILGKPMIQRTWERTKLASTLDHVVVATDSEKIAECCREFGADVIMTSESCKNGTERCNEALQKLGKNYDIVVNIQGDEPLIEPDIIDGVVRALQGAPDAVFSTAVTSLKPEDGLDPNRVKCVVDNHGYAIYFSRGLIPFNKSGKVNPRFPYLLHLGIQSFDSKFLRIYPQLPPTPLQLEEDLEQLKVLENGYKMKVIKVDHDAHGVDTPEDVEKIEALMRERNIS

SEQ ID NO: 19891 - protein, 307 aa, Medicago truncatula
MTICSSSDSSSSSSSSSIDSSSSSNNNLKTWIIHGILFGVSIAAVAGARAYFNRFNKFRSRVVGIIPARFASSRFEGKPLVHILGKPMIQRTWESAKLAASLDHLVVATDDEKIADCCRKFGADVIMTSESCRNGTERCNEALQKLERKYDIVVNIQGDEPLLEPEVIDGVVKALQAAPDAVFSTAVTALKPEDAHDPNRVKCVVDNRGYAIYFSRGLIPFNKSGKVNQQFPYLLHLGIQSYDTKFLKIYPDLQPTPLQLEEDLEQLKVLENGYKMKVIKVDHEAHGVDTPEDVEKIEALMRQRNLS

SEQ ID NO: 19892 - protein, 294 aa, Silene vulgaris
SVSTPTMENQMSVKSWVTYGLLMGAATAVAIGAHALFFRRRSSKFRSRVVGIIPARYASSRFEGKPLVDILGKPMIQRTWERAKLASMLDQVVVATDDDKIANCCRGFGADVIMTSESCRNGAERCSEALQKLGKKYDIVVNIQGDEPLIEPEIIDGIVKALQCSPDAVFSTAVTSLKPEDAFDPNRVKCVIDNLGYAIYFSRGLIPFNKSGKVNSDFPYLLHLGIQSYDAKFLKIYSDLTPTPLQLEEDLEQLKVLENGYKMKVIKVEHEAHGVDVPEDVEKIERYMRERNLS

SEQ ID NO: 19893 - protein, 534 aa, Hordeum vulgare
MAATMMGISALRSHHPLPLPTARPAAALPRATSPTSHQPSLLTLLGCGCRRRRGLPHSPCSSPPRASLSSGGPDSAAFMALAPNNAALRHRLIAPNSTGGSGDAAAAAAGGLPSVVGIAHLAVSLGIVLATDKYLKQAFVAASIKFPSALFGMFCIFSVLVVLDTVAPALAKGFMDFFEPATLFIQRWLPLFYVPSLVVLPLAVRDVPAASGLKICLITFGGWFASLAVAGYTALTVRKIVKTELIAAEPMGKPSAFVTLEFWAWGAVFVASFATAFVNPTALGTTARTCLPFMLASTVLGYMVGSGLPSGIKTLLHPIICCALSANLSAVAYGYLSGSGMDAALGDYLTKVPSNPGAGDVLMGFLGSVILSFAFSMFKQRKLVKRHAAEIFTSIAIASTFSLYSTAILGRLVGLEPTLTISILPRCITVALALSIVSFFEGANTSVTAAVVVLTGLIGANFVQAAMDKLGLNDPIARGIGTASSAHGLGTAALSAKEPEALPFCAIAYALTGIFGSLICSSPAVRQSLVFIAG

SEQ ID NO: 19894 - protein, 532 aa, Secale cereale
MAAMIMGISALRSHHPLRLPTARPAAALPRATSPTSHQPRSLTLLRCRCRRSLPHCSCSSSPRASLSSGAPDSAAFMALAPNNAALRHRLVAPNSTAGPGDGAATATGGLPSVLGIAHLAVSLGIVLATDKYLKQAFVAASIKFPSALFGMFCIFSVLVVLDIVAPALAKGFMDFFEPATLFIQRWLPLFYVPSLVVLPLAVRDIPAASGLKICIITLGGWFASLAVAGYTALTVRKIVKTELIAAEPMGKPSAFATLEFWAWGAVFVASFATAFVNPTALGTTARTCLPFMLASTVLGYMVGSGLPSGIKKLLHPIICCALSANLSAVAYGYFSGSGIDAALGDYLTKVPSNPGAGDVLMGFLGSVILSFAFSMFKQRKLVKRHAAEIFTSIAIASTFSLYSTAILGRLIGLEPTLTISILPRCITVALALSIVSFFEGANTSLTAAVVVLTGLIGANFVQAAMDKLGLNDPIARGIGTASSAHGLGTAALSAKEPEALPFCAIAYALTGIFGSLICSSPAVRQSLVFIAG

SEQ ID NO: 19895 - protein, 540 aa, Avena sativa
MAAMIGISALRSLHPLPLTFSGSAAAPPRATLTLPLPLHQQPRSCTTPRCRCRCQRRSLPHSTPRVRAAASSPPSGDTSSAAFMASPPDNAALRHRLIAPNSTAGTGDSTTAAASGVLPSVLGVAHLAVSLGIVLATDKYLKQAFVAASIKFPSALFGMFCVFSVLVVLDVAAPALAKGFMDFFEPASLFIQRWLPLFYVPSLVVLPLAVRDVPAAAGLKICLITFAGWFASLTVAGYTALTVRKIVKTELVAAEPMGKPSPFATLEFWAWGAVFVASFATAFVNPTALGTTARTCLPFMLASTVLGYMVGSGLPSGIKKLLHPIICCALSANFAAVAYGYLSGSGIDAALGDYLTKVPSDPGAGDVLMGFLGSVIISFAFSMFKQRKLVKRHAAEIFTSIAVASTFSLYSTAILGRLIGLEPTLTISILPRCITVALALSIVSFFEGANTSVTAAVVVLTGLIGANFVQAAMDKLGLNDPIARGIGTASSAHGLGTAALSAKEPEALPFCAIAYALTGIFGSLICSSAAVRQSLVFIAG

SEQ ID NO: 19896 - protein, 529 aa, Brachypodium distachyon
MAATMIGMTALGFHNTHRPLLLHSALPRATSPPVPRFCTLPRCRCQSSSSSSCGCSARATRALPPSSAAFMASPPHNAALGHRLIAPNSTAGTGDAAAAAPPPGGILPSVVGVAHLAVSLGIVLATDKYLKQAFAAAAIKFPSALFGMFCVFSVLLVLDTLAPSLAKGFMDFFEPATLFIQRWLPLFYVPSLVVLPLAVRDIPAASGLKIGLITFGGWFASLTVAGYTALAVRKVVKTELIAAEPMSKPSAFATLEFWAWGAVFVASFATAFVNPTALGTTARTCLPFLLASTVLGYMVGSGLPSGVKKVLHPIICCALSADLAAVAYGYLSGSGIDAALGDYLTKVPSNPGAGDVLMGFLGSVIISFAFSMFKQRKLVKRHAAEIFTSIAIASTFSLYSTAILGRLIGLEPTLTISILPRCITVALALSIVSFFEGANTSLTAAVVVLTGLIGANFVQAAMDKLGLNDPIARGIGTASSAHGLGTAALSAKEPEALPFCAIAYALTGIFGSLICSSSAVRQSLVFIAG

SEQ ID NO: 19897 - protein, 623 aa, Hordeum vulgare
MATQGSQSGYILDWCSWPHTYTCRPASGRAPKSPSGSHQQQREAANPAASVSVSASAPLHWALGGRSSMAATMMGISALRSHHPLPLPTARPAAALPRATSPTSHQPSLLTLLGCGCRRRRGLPHSPCSSPPRASLSSGGPDSAAFMALAPNNAALRHRLIAPNSTGGSGDAAAAAAGGLPSVSAPPPHLPVDRESNNRPRQMVVGIAHLAVSLGIVLATDKYLKQAFVAASIKFPSALFGMFCIFSVLVVLDTVAPALAKGFMDFFEPATLFIQRWLPLFYVPSLVVLPLAVRDVPAASGLKICLITFGGWFASLAVAGYTALTVRKIVKTELIAAEPMGKPSAFVTLEFWAWGAVFVASFATAFVNPTALGTTARTCLPFMLASTVLGYMVGSGLPSGIKTLLHPIICCALSANLSAVAYGYLSGSGMDAALGDYLTKVPSNPGAGDVLMGFLGSVILSFAFSMFKQRKLVKRHAAEIFTSIAIASTFSLYSTAILGRLVGLEPTLTISILPRCITVALALSIVSFFEGANTSVTAAVVVLTGLIGANFVQAAMDKLGLNDPIARGIGTASSAHGLGTAALSAKEPEALPFCAIAYALTGIFGSLICSSPAVRQSLVFIAG

SEQ ID NO: 19898 - protein, 95 aa, Triticum aestivum
MGMEESAGGAARQAKESLELAFQMSQILDTGLDRHTLSLLMALCDRGANPEALAALVRELSSTAPPSAAAPTAPASNAVAAPTAPSLFPSGFRQL

SEQ ID NO: 19899 - protein, 95 aa, Secale cereale
MGMEESAGGAARQAKESLELAFQMSQILDTGLDRHTLSLLMALCDRGANPEALAALVRELSSTAPPSAAAPAAPASIAVAAPTVPSLFPSGFRQL

SEQ ID NO: 19900 - protein, 94 aa, Triticum aestivum
MGMEESAGGAARQAKESLELAFQMSQILDTGLDRHTLSLLMALCDRGANPEALAALVRELSSAAPPSAAATAPASNTTAAPATPSLFPSGFRQL

SEQ ID NO: 19901 - protein, 97 aa, Avena sativa
MGTDASAGVAARQAKESLELAFQMSQILDTGLDRHTLSLLMALCDRGANPEALAALVRELSSSAPPTAAPAPSSNGAAAPTPTPTAASLFPSAFRQP

SEQ ID NO: 19902 - protein, 92 aa, Festuca arundinacea
MGTEGAAARQAKESLELAFQMSQILDTGLDRHTLSLLMALCDRSANPEALAALVRELSSAAPPTATPASNGAAPPAPTPTAASLFPSGFRQP

SEQ ID NO: 19903 - protein, 251 aa, Saccharum officinarum
MDDGDGGLSFDFEGGLDSVPAAGGGGPVPSSTDPGAGGGGGGDGLGMHGRGRGRGSYRQTVCRHWLRGLCMKGEACGFLHQFDKARMPVCRFFRDFGECREPDCAYKHSYDDVKECNMYKMGFCPNGPNCRYKHIKLPGPPPSVEEVLQKILQMRSFNRYGQNRNNNYNQQGERPQHPQGSGMPNQNSAENATAAAPPAGGQQAQTLNQQPPQQQQKPNTNDQAQGVSNGHQATRIATPLPQGPSRCVWSF

SEQ ID NO: 19904 - protein, 716 aa, Saccharum officinarum
MATVDRTRTFMKDVKRVIIKVGTAVVTTHDGRLALGRLGALCEQVKELNALGYEVIIVTSGAVGVGKQRLKYRKLVNSSFADLQKPQMELDGKACAAVGQSGLMALYDMLFTQLDVSSSQLLVTDSDFENPNFRERLRETVESLLDLKVVPIFNENDAISTRKAPYEDSSGIFWDNDSLAGLLAIELKADLLVLLSDVDGLYNGPPSEPQSKIIHTYIKEKHHNEITFGDKSRVGRGGMTAKVKAAFVASNSGTPVVITSGFASQSILRVLQGEKIGTLFHKDASLWEPSKDVSAREMAVSARECSRCLQNLSSDERKKILLDVADALEENEDLIKTENEADVAAAQDAGYEKSLIARLTLKPGKIASLAKSIRTLAHMEDPINQILKRTEVAEDLVLEKTSCPLGVLLIVFESRPDALVQIASLAIRSGNGLLLKGGKEAMRSNTVLHKVITGAIPSNVGEKLIGLVTSRDEIADLLKLDDVIDLVIPRGSNKLVSQIKASTKIPVLGHADGICHVYIDKSADMNMAKRIVMDAKIDYPAACNAMETLLVHKDLIKAPGLEDLLLSLKTEGVTLYGGPVAQELLCIPKADSFHHEYSSMACTIEFVDDVQAAIDHIHRYGSGHTDCIVTTDDKVAETFLRQVDSAAVFYNASTRFSDGARFGLGAEVGISTGRIHARGPVGVEGLLTTRWIMRGSGQVVNGDKDIAYTHKNLPLQ

SEQ ID NO: 19905 - protein, 717 aa, Zea mays
MATADRTRTFMKDVKRVIIKVGTAVVTRGDDGRLAVGRLGCLCEQVKELNVLGYEVILVTSGAVGVGKQRLKYRKLVNSSFADLQKPQMELDGKACAAVGQSGLMALYDMLFTQLDVSSSQLLVTDSDFENPNFRERLCETVESLLDLKVVPIFNENDAISTRKAPYEDSSGIFWDNDSLAGLLAIELKADLLVLLSDVDGLYSGPPSEPGSKIIHTYIKDKHYSGITFGDKSRVGRGGMTAKVKAAFVASNSGTPVVITSGFASQSIVRVLQGEKIGTLFHKDASLWEPSKDVSAREMAVAARECSRRLQNLSSDERKKILLDIADALEQNEDLIRTENEADVSAAQDAGYQKSLVDRLTLKPEKIASLAKSIRTLANMEDPINQILKRTEVAEDLVLEKTSCPLGVLLIVFESRPDALVQIASLAVRSGNGLLLKGGKEAMRSNTVLHKVITGAIPDNVGQKLIGLVTSRDEIADLLKLDDVIDLVIPRGSNKLVSQIKASTKIPVLGHADGICHVYIDKSADMNMAKRIVMDAKTDYPAACNAMETLLVHKDLIKAPGLDDILLSLKTEGVAIYGGPVAHEVLCIPKADSFHHEYSSMACTIEFVDDVQSAINHIHRYGSAHTDCIITTDDKVAETFLRQVDSAAVFHNASTRFSDGARFGLGAEVGISTGRIHARGPVGVEGLLTTRWIMRGSGQVVNGDKNVAYTHKNLPLQ

SEQ ID NO: 19906 - protein, 716 aa, Pennisetum glaucum
MATADRTRSFMKDVKRVIIKVGTAVVTRHDGRLALGRLGALCEQVKELNTLGYEVIMVTSGAVGVGRQRLKYRKLVNSSFADLQKPQMELDGKACAAVGQSGLMALYDMLFTQLDVSSSQLLVTDSDFENPNFRERLCETVESLLDLKVVPLFNENDAISTRKAPYEDSSGIFWDNDSLAGLLAIELKADLLVLLSDVDGLYSGPPSEPQSKLIHTYIKEKHHNEITFGDKSRVGRGGMTAKVKAAFVASNSGTPVVITSGFASQSILRVLQGEKIGTLFHKDANLWEPSKDVSAREMAVAARECSRRLQNLSSDERKKILLDVADALEAKEDLIRAENEADVIAAQYAGYEKSLVARLTLKPGKIASLAKSIRTLANMEDPINQILKRTEVAEDLVLEKTSCPLGVLLIVFESRPDALVQIASLAIRSGNGLLLKGGKEAMRSNTILHKVITDVLPDTVGKRLIGLVTSRDEIADLLKLDDVIDLVIPRGSNQLVSQIKASTKIPVLGHADGVCHVYIDKSANMDIAKRIVIDAKIDYPAACNAMETLLVHKDLIKSPGLDDILLSLKTEGVAIYGGPVAHELLSIPKADSFHHEYSSMACTIEFVDDVQSAIDHIHRYGSAHTDCIVTTDSKVAETFLRQVDSAAVFHNASTRFSDGARFGLGAEVGISTGRIHARGPVGVEGLLTTRWIMRGSGQVVNGDKDVTYTHKNLPLQ

SEQ ID NO: 19907 - protein, 716 aa, Panicum virgatum
MATADRTRSFMKDVKRVIIKVGTAVVTRHDGRLALGRLGSLCEQVKELNTLEYEVIMVTSGAVGVGRQRLKYRKLVNSSFADLQKPQMELDGKACAAVGQSGLMALYDMLFNQLDVSSSQLLVTDSDFENPNFRERLRETVESLLDLKVVPVFNENDAISTRKAPYEDSSGIFWDNDSLAGLLAIELKADLLVLLSDVDGLYSGPPSEPQSKIIHTYIKEKHHSEITFGDKSRVGRGGMTAKVKAAFVASNSGTPVVITSGFASQSILRVLQGEKIGTLFHKDASLWEPSKDVSAREMAVAARECSRRLQNLSSDERKKILLDVADALEANEDLIRAENEADVLAAQDAGYEKSLVARLTLKPGKIASLAKSIRTLAHMEDPINQILKRTEVAENLVLEKTSCPLGVLLIVFESRPDALVQIASLAIRSGNGLLLKGGKEAMRSNTILHKVITDALPGSVGKRLIGLVTSRDEIADLLKLDDVIDLVIPRGSNKLVSQIKASTKIPVLGHADGVCHVYIDKSADMDIAKRIVMDAKIDYPAACNAMETLLVHKDLIKSPGLDDILISLKTEGVSIYGGPVAHEVLSIPKADSFHHEYSSMACTVEFVDDVQSAIDHIHRYGSAHTDCIVTTDSKVAETFLRQVDSAAVFHNASTRFSDGARFGLGAEVGISTGRIHARGPVGVEGLLTTRWIMRGSGQVVNGDKDVAYTHKNLPLQ

SEQ ID NO: 19908 - protein, 716 aa, Echinochloa colona
MATADRTRSFMKEVKRVIIKVGTAVVTRHDGRLALGRLGALCEQVKELNTLGYEVIMVTSGAVGVGRQRLKYRKLVNSSFADLQKPQMELDGKACAAVGQSGLMALYDMLFTQLDVSSSQLLVTDSDFENPNFRERLRETVESLLDLKVVPVFNENDAISTRKAPYEDSSGIFWDNDSLAGLLAIELKADLLVLLSDVDGLYSGPPSEPQSKIIHTYIKEKHHNEITFGDKSRVGRGGMTAKVKAAFVASNSGTPVVITSGFASQSIVRVLQGEKIGTLFHKDASLWEPSKDVSAREMAVAARECSRRLQNLSSDERKKILLDVADALEANEELIRTENEADIVTAQDAGYEKSLVARLTLKPGKIASLAKSIRTLANMEDPINQILKRTEVAENLVLEKTSCPLGVLLIVFESRPDALVQIASLAIRSGNGLLLKGGKEAMRSNAILHKVITDALPDNVGKRLIGLVTSRDEIADLLKLDDVIDLVIPRGSNKLVSQIKASTKIPVLGHADGVCHVYIDKSANMEIAKRIVMDAKIDYPAACNAMETLLVHKDLIKSPGFDDILLSLKTEGVSIYGGPVAHEVLSIPKADSFHHEYSSMACTVEFVDDVQSAIDHIHRYGSAHTDCIVTTDSKVAETFLHQVDSAAVFHNASTRFSDGARFGLGAEVGISTGRIHARGPVGVEGLLTTRWIMRGSGQVVNGDKDVAYTHKNLALQ

SEQ ID NO: 19909 - protein, 716 aa, Avena sativa
MARADPNRNFMKDVKRIIIKVGTAVITRNDGRLALGRIGALCEQVKDLNAQGYEVIMVTSGAVGVGRQRLRYRKLVNSSFADLQKPQNELDGKACAAVGQSGLMALYDMLFTQLDVSSSQLLVTDSDFENSNFRERLRETVESLLELRVIPIFNENDAISTRKAPYEDSSGIFWDNDSLAGLLALELKADLLLLLSDVDGLYSGPPSEPASKIIHTYIKEKHYHEITFGDKSRVGRGGMTAKVQAAVWASTGGVPVVITSGCASQSIVKVLQGEKIGTLFHKNASLWEPSMDASVREMAVSARDCSRRLQNLSSEERKKILLDVADALEANEDLIKSENEADVAVAHEAGYESSLIARLTLKQGKIASLAKSVRTLANMEDPINEILKRTEVADGLVLEKTSCPLGVLLIVFESRPDALVQIASLAIRSGNGLLLKGGKEAMRSNAILHKVITNAIPDNVGEKLIGLVTTRDEIADLLKLDDVIDLVIPRGSNKLVAQIKATTKIPVLGHADGVCHVYIDKSADMDMAKRIVMDAKIDYPAACNAMETLLVHKDLAKTSELNDILVALKTEGVNIYGGPVAHKILGYPKADSLHLEYSSMACTVEFVDDVQSAIDHIHRYGSAHTDCVVTTDDKVAETFLRQVDSAAVVYNASTRFSDGARFGLGAEVGISTGRIHARGPVGVEGLLTTRWLLRGKGQVVNGDKDVAYTHKTLPLH

SEQ ID NO: 19910 - protein, 716 aa, Secale cereale
MAGADPNRSFMKDVKRIIIKVGTAVITRNDGRLALGRIGALCEQVKDLNAQGYEVIMVTSGAVGVGRQRLRYRKLVNSSFADLQKPQMELDGKACAAVGQSGLMALYDMLFTQLDVSSSQLLVTDSDFDNSNFRERLRETVESLLELRVIPIFNENDAISTRKAPYEDSSGIFWDNDSLAGLLALELKADLLVLLSDVDGLYSGPPSEPSSKLIHTYIKEKHYHEITFGDKSRVGRGGMTAKVQAAVWASTGGVPVVITSGCASQSLVKVLRGEKIGTLFHKNASSWEPSKDASVREMAVAARDCSRRLQNLSSEERKKILLDVADALEANEDLIRSENEADVAAAHEAGYESALVARLTLKPGKIASLAKSVRTLANMEDPINEILKRTEVADGLVLEKTSCPLGVLLIIFESRPDALVQIASLAIRSGNGLLLKGGKEAMRSNAILHKVITNAIPDNVGEKLIGLITTRDEIADLLKLDDVIDLVIPRGSNKLVAQIKSSTKIPVLGHADGVCHVYIDKSADMDMAKRIVMDAKIDYPAACNAMETLLVHKDIVKTPELNGILLALKTAGVNLYCGPVAHKVLGYPKADSLHLEYSSLACTVEIVDDVQSAIDHIHRYGSAHTDCVVTTDDKVAETFLRQVDSAAVLYNASTRFSDGARFGLGAEVGISTGRIHARGPVGVEGLLTTRWLLRGKGQIVNGDKDVAYTHKSLPLQ

SEQ ID NO: 19911 - protein, 716 aa, Triticum aestivum
MAGADPNRSFMKDVKRIIIKVGTAVITRNDGRLALGRIGALCEQVKDLNAQGYEVIMVTSGAVGVGRQRLRYRKLVNSSFADLQKPQMELDGKACAAVGQSGLMALYDMLFTQLDVSSSQLLVTDSDFDNSNFRERLRETVESLLELRVIPIFNENDAISTRKAPYEDSSGIFWDNDSLAGLLALELKADLLVLLSDVDGLYSGPPSEPSSKLIHTYIKEKHYHEITFGDKSRVGRGGMTAKVQAAVWASTGGVPVVITSGCASQSLVKVLRGEKIGTLFHKNASLWEPSKDTSVREMAVAARDCSRRLQNLSSEERKKILLDVADALEANEDLIRSENEADLAAAHEAGYESALVSRLTLKPGKIASLAKSVRTLANMEDPINEILKRTEVADGLVLEKTSCPLGVLLIIFESRPDALVQIASLAIRSGNGLLLKGGKEAMRSNAILHKVITNAIPDNVGEKLIGLITTRDEIADLLKHDDVIDLVIPRGSNKLVAQIKSSTKIPVLGHADGVCHVYIDKSADMDMAKRIVMDAKIDYPAACNAMETLLVHKDLMKTPELNDILVALKTAGVNLYCGPVAHKVLGYPKADSLHLEYSSMACTVEIVDDVQSAIDHIHRYGSAHTDCVVTTDDKVAETFLRQVDSAAVLYNASTRFSDGARFGLGAEVGISTGRIHARGPVGVEGLLTTRWLLRGKGQVVNGDKDVEYTHKSLPLQ

SEQ ID NO: 19912 - protein, 716 aa, Triticum aestivum
MAGADLNRSFIKDVKRIIIKVGTAVITRNDGRLALGRIGALCEQVKDLNAQGYEVIMVTSGAVGVGRQRLRYRKLVNSSFADLQKPQMELDGKACAAVGQSGLMALYDMLFTQLDVSSSQLLVTDSDFDNSNFRERLRETVESLLELRVIPIFNENDAISTRKAPYEDSSGIFWDNDSLAGLLALELKADLLVLLSDVDGLYSGPPSEPSSKLIHTYIKEKHYHEITFGDKSRVGRGGMTAKVQAAVWASTGGVPVVITSGCASQSLVKVLRGEKIGTLFHKNASLWEPSKDTSVREMAVAARDCSRRLQNLSSEERKKILLDVADALEANEDLIRSENEADLAAAHEAGYESALVSRLTLKPGKIASLAKSVRTLANMEDPINEILKRTEVADGLVLEKTSCPLGVLLIIFESRPDALVQIASLAIRSGNGLLLKGGKEAMRSNAILHKVITNAIPDNVGEKLIGLITTRDEIADLLKHDDVIDLVIPRGSNKLVAQIKSSTKIPVLGHADGVCHVYIDKSADMDMAKRIVMDAKIDYPAACNAMETLLVHKDLMKTPELNDILVALKTAGVNLYCGPVAHKVLGYPKADSLHLEYSSMACTVEIVDDVQSAIDHIHRYGSAHTDCVVTTDDKVAETFLRQVDSAAVLYNASTRFSDGARFGLGAEVGISTGRIHARGPVGVEGLLTTRWLLRGKGQVVNGDKDVEYTHKSLPLQ

SEQ ID NO: 19913 - protein, 716 aa, Hordeum vulgare
MASADPNRSFIKDVKRIIIKVGTAVITRNDGRLALGRIGSLCEQVKDLNAQGYEVIMVTSGAVGVGRQRLRYRKLVNSSFADLQKPQMELDGKACAAVGQSGLMALYDMLFTQLDVSSSQLLVTDSDFDNSNFRERLRETVESLLELRVIPIFNENDAISTRKAPYEDSSGIFWDNDSLAGLLALELKADLLVLLSDVDGLYSGPPSEPSSKLIHTYIKEKHYHEITFGDKSRVGRGGMTAKVQAAVWASTGGVPVVITSGCASQSLVKVLRGEKIGTLFHKNASSWEPSKDASVREMAVAARDCSRRLQNLSSEERKKILLDVADALEANEDLIRSENEADVAAAHEAGYESALVARLTLKPGKIASLAKSVRTLANMEDPINEILKRTEVADGLVLEKTSCPLGVLLIIFESRPDALVQIASLAIRSGNGLLLKGGKEAMRSNAILHKVITNAIPDNVGEKLIGLITTRDEIADLLKLDDVIDLVIPRGSNKLVAQIKASTKIPVLGHADGVCHVYIDKSADMDMAKRIVVDAKIDYPAACNAMETLLVHKDLMKTPELDDILVALKTAGVNLYCGPVAHKILGYPKADSLHLEYSSMACTVEIVDDVQSAIDHIHRYGSAHTDCVVTTDDTVAETFLRQVDSAAVLYNASTRFSDGARFGLGAEVGISTGRIHARGPVGVEGLLTTRWLLRGKGQIVNGDKDVVYTHKSLPLQ

SEQ ID NO: 19914 - protein, 716 aa, Hordeum vulgare
MASADPNRSFIKDVKRIIIKVGTAVITRNDGRLALGRIGSLCEQVKDLNAQGYEVIMVTSGAVGVGRQRLRYRKLVNSSFADLQKPQMELDGKACAAVGQSGLMALYDMLFTQLDVSSSQLLVTDSDFDNSNFRERLRETVESLLELRVIPIFNENDAISTRKAPYEDSSGIFWDNDSLAGLLALELKADLLVLLSDVDGLYSGPPSEPSSKLIHTYIKEKHYHEITFGDKSRVGRGGMTAKVQAAVWASTGGVPVVITSGCASQSLVKVLRGEKIGTLFHKNASSWEPSKDASVREMAVAARDCSRRLQNLSSEERKKILLDVADALEANEDLIRSENEADVAAAHEAGYESALVARLTLKPGKIASLAKSVRTLANMEDPINEILKRTEVADGLVLEKTSCPLGVLLIIFESRPDALVQIASLAIRSGNGLLLKGGKEAMRSNAILHKVITNAIPDNVGEKLIGLITTRDEIADLLKLDDVIDLVIPRGSNKLVAQIKASTKIPVLGHADGVCHVYIDKSADMDMAKRIVVDAKIDYPAACNAMETLLVHKDLMKTPELDDILVALKTAGVNLYCGPVARKILGYPKADSLHLEYSSMACTVEIVDDVQSAIDHIHRYGSAHTDCVVTTDDTVAETFLRQVDSAAVLYNASTRFSDGARFGLGAEVGISTGRIHARGPVGVEGLLTTRWLLRGKGQIVNGDKDVVYTHKSLPLQ

SEQ ID NO: 19915 - protein, 730 aa, Brachypodium distachyon
MASADPNRAFMKDVKRIIIKVGTAVITRNDGRLALGRIGALCEQVKDLNSQGYEVIMVTSGAVGVGRQRLRYRKLVNSSFADLQKPQNELDGKACAAVGQSGLMALYDMLFTQLDVSSSQLLVTDSDFDNSNFRERLCETVESLLELRVIPIFNENDAVSTRKAPYEDSSGIFWDNDSLAGLLALELKADLLVLLSDVDGLYSGPPSEPSSKIIHTYIKEIHYQEITFGDKSRVGRGGMTAKVQAASLASGGGIPVVITSGFDSQSIVKVLQGEKIGTLFHKNASLWEPSKDASVHEMAVAARDCSRRLQNLSSEERKKILFDVADALEANEDLIRSENEADIAAAQEAGYETSLVSRLTLKPGKIASLAKSIRTLANMEDPINEILKRTEVADGLVLEKTSSPLGVLLIVFESRPDALVQIASLAIRSGNGLLLKGGKEAMRSNTILHKVITNAIPGNVGEKLIGLVTTRDEIADLLKLDDVIDLVIPRGSNKLVSQIKASTKIPVLGHADGVCHVYIDKSADMDMAKRIVLDAKIDYPAACNAMETLLVHKDLAKTPELDDILLALKTAGVNIYSGPVAHKVLGYPKADSFHLEYSSLACTVEFVDDVQSAIDHIHRYGSAHTDCVVTTDDKVAESFLRQVDSAAVFYNASTRFSDGARFGLGAEVGISTGRIHARGPVGVEGLLTTRWILRGKGQVVNGDKDVAYTHKTLPLQSGPLLLDQDSVKNL

SEQ ID NO: 19916 - protein, 706 aa, Secale cereale
MKDVKRIIIKVGTAVITRNDGRLALGRIGALCEQVKDLNAQGYEVIMVTSGAVGVGRQRLRYRKLVNSSFADLQKPQMELDGKACAAVGQSGLMALYDMLFTQLDVSSSQLLVTDSDFDNSNFRERLRETVESLLELRVIPIFNENDAISTRKAPYEDSSGIFWDNDSLAGLLALELKADLLVLLSDVDGLYSGPPSEPSSKLIHTYIKEKHYHEITFGDKSRVGRGGMTAKVQAAVWASTGGVPVVITSGCASQSLVKVLRGEKIGTLFHKNASSWEPSKDASVREMAVAARDCSRRLQNLSSEERKKILLDVADALEANEDLIRSENEADVAAAHEAGYESALVARLTLKPGKIASLAKSVRTLANMEDPINEILKRTEVADGLVLEKTSCPLGVLLIIFESRPDALVQIASLAIRSGNGLLLKGGKEAMRSNAILHKVITNAIPDNVGEKLIGLITTRDEIADLLKLDDVIDLVIPRGSNKLVAQIKSSTKIPVLGHADGVCHVYIDKSADMDMAKRIVMDAKIDYPAACNAMETLLVHKDIVKTPELNGILLALKTAGVNLYCGPVAHKVLGYPKADSLHLEYSSLACTVEIVDDVQSAIDHIHRYGSAHTDCVVTTDDKVAETFLRQVDSAAVLYNASTRFSDGARFGLGAEVGISTGRIHARGPVGVEGLLTTRWLLRGKGQIVNGDKDVAYTHKSLPLQ

SEQ ID NO: 19917 - protein, 619 aa, Saccharum officinarum
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYYQAEVQGQKITWITPHALQQVLTDDVDFNVMLSFLEFYETLLGFVNFKLYHSINVNYPPILDPRLEALAAELYALCRYMSAGSRRMIGNSQSDEVMEDRDEKTKADGVIEEEKDVKNKASSKADESELRLAQLQHQLPTNEPGALMNLVEESTADDADDDDTKECKGLFKNLKFYLSREVPRESLLFTIPAFGGTVSWEGEGAPFKEEDEDITHQIVDRPTQSHVFLSREYVQPQWVFDCVNARIILPTEGYLVGRVPPPHLSPFVDNDAEGYIPEYAETIKRLQAAARNEVLPLPGIGDEDLDNSLVAAMMDRTESNEAAEKKRKLEMLEKQYHDELKMEIDGVAFSSLSNKEGDKSPDAKDDTQSDREEDASKQEEKDDDDIGTALMSRKQRGLYKAMKMGKEKKKDKIELLKKRKKNADSSASSKKRH

SEQ ID NO: 19918 - protein, 619 aa, Zea mays
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYMSAGSRRMIGNSQTDEVMEDKDEKSKAEEVIKEEKVVKNKASSKADESELRLAQLQHQLPTNEPGALMNLVEESTADDADDDDTKDCKGLFKNLKFYLSREVPRESLLFIIPAFGGTVSWEGEGAPFKEIDEDITHQIVDRPTQSHVFLSREYVQPQWVFDCVNARIILPTEGYLVGRVPPPHLSPFVDNDAEGYMPEYAETIKRLQAAARNEVLPLPGIGDEDLDNSLVAAMMDRTASNEAAEKKRKLEMLEKQYIDELKKEIDGVAFSSLSNKEADKSPNAKDDTQSDREEDASKQEEDDDDDIGTALMSRKQRGLYKAMKMGKEKKKEKVELLKKRKKNADSGASSKKRH

SEQ ID NO: 19919 - protein, 613 aa, Panicum virgatum
MPKHYRPAGKKKEGNAAKYITRTKAVNYLQVSLAIFRKLCILKGVFPRQPKKKVEGNHKTYYHMKDIAFIAHDPLIEKFRQIKVHRKKVKKAIAKKNRDLADRLLNRPPTYKLDRLVLERYPAFVDALRDLDDCLTLVHLFAALPAVDGERVEVKRIHSCRRLSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYISTGSGRVTGNSESDGVKEKESGGAIKEKEDENNKASSKADESELRLAQLQHQLPANEPGALMHLVEESTAIDTDDDETKECKSLFKNLKFYLSREVPRESLLFIIPAFGGTVSWEGEGAPFNEVDEDITHQIVDRPTQSHVFLSREYVQPQWVFDCVNARIILPTEGYLVGRIPPPHLSPFVDNDAEGYIPEYAETIKRLQAAARNEILPLPGDEDLDNSLVTAMMDRTESNEAAEKKMKLEMLEKQYHDELKMEIDGITFSNLSNKKADKSLDTTDKDDTKSDHEDDEKKQAEKDSADISTALMSRKQRGLYKAIEIGKERKRDKVELLKKRKKDADSSASAKRR

SEQ ID NO: 19920 - protein, 626 aa, Setaria italica
MPKHYRPAGKKKEGNAAKYITRTKAVNYLQVSLAIFRKLCILKGVFPRQPKKKVEGNHKTYYHMKDIAFLAHDPLIEKFRQIKVHRKKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYFQAEVQGQKITWLTPHALQQVLTDDVDFNVMLSFLEFYETLLGFVNFKLYHSINVNYPPILDSRLEALAAELYALCRYMSTGSGKVIRNSESGGAIKENEDENNKTSSKADETGGAIKENEDANNKTSSKADESELRLAQLQHQLPANEPGALMHLVEETTAVDTDDDETKECKSLFKNLKFYLSREVPRESLLFIIPAFGGTVSWEGEGAPFTEVDEDITHQIVDRPTQSHVFLTREYVQPQWIFDCVNARIILPTEGYIVGRVPPPHLSPFVDNDAEGYIPEYAETIKRLQAAARNEVLPLPGDEDLDNSLVAAMMDRTESNEAAEKKRKLEMLEKQYHDELKMEIDGVTFSNLSNKKADKSPDTMDKDDTNSDHVDDEKKQAEKDSADISTVTMSRKGRGLYKAMKIGKERKQDKVEILKKRKKSAESSASAKQR

SEQ ID NO: 19921 - protein, 604 aa, Echinochloa colona
MPKHYRPAGKKKEGNAAKYITRTKAVNYLQVSLANFRKLCILKGVFPRQPKKKVEGNHKTYYHMKDIAFLAHDPLIETFRQIKVHRKKVKKAIAKKNRDLADRLLNRPPTYKLDKLVLERYPTFVDALRDMDDCLTMVHLFAALPAVDGERVKVKRIHNCRRLSHEWQAYISRTHSLRKTFISVKGIYYQAEVQGQKITWLTPHALQQVLTDDVDFNVMLSFLEFYETLLRFVNFKLYHSINVNYPPILDPRLEALAAELYALCRYMSAGSGRVIGNSESGGVTKEKEDENNKASSKADESELRLAQLQHQLTANEPGALMHLVEELTAVDADDDDTKECKSLFKNLKFYLSREVPRESLLFIIPAFGGTVSWEGEGAPFNEVDEAITHQIVDRPTQSHVFLSREYVQPQWVFDCVNARIILPTEGYLVGRVPPPHLSPFVDNDAEGYIPEYAETIKRLQAAAHNEVLPMPGDEDLDNSLVAMMDQTESNEAAEKKRKLEMLEKQYHDELKMEIDGVTFSNLSNKKADRSPDTMDKDDTQSDHEKDENKQAEKDNTDISTALMSRRRRGLYEAMQLGKERKQDKVELLKKRKKKAESSASAKRR

SEQ ID NO: 19922 - protein, 603 aa, Echinochloa colona
PKHYRPAGKKKEGNAAKYITRTKAVNYLQVSLANFRKLCILKGVFPRQPKKKVEGNHKTYYHMKDIAFLAHEPLIEEFRQIKVYEKKVKKAIAKKNRDLVDRLLNRPPTYKLDRLVLERYPTFVDALRDMDDCLTMVHLFAALPAVDGERVEVKRIHNCRRLSHEWQAYISRTHSLRKTFISVKGIYYQAEVQGQKITWLTPHALQQVLTDDVDFNVMLSFLEFYESLLGFVNFKLYHSINVNYPPILDPRLEALAAELYALCRYMSAGSGRVIGNSESGGVTKEKEDENNKASSKADESELRLAQLQHQLTANEPGALMHLVEELTSVDVDDDDTKECKSLFKNLKFYLSREVPRESLLFIIPAFGGTVSWEGEGAPFNEVDEAITHQIVDRPTQSHVFLSREYVQPQWVFDCVNARIILPTEGYLVGRVPPPHLSPFVDNDAEGYIPEYAETIKRLQAAARNEVLPLPGDEDLDNSLVAMMDQTESNEAAEKKRKLEMLEKQYHDELKMEIDGVTFSNLSNKKADRSPDTMDKDDTQSDHEKDENKQAEKDNADISTALMSRRQRGLYEAMQIGKGRKQDKVELLKKRKKKAESSVSAKRR

SEQ ID NO: 19923 - protein, 605 aa, Panicum virgatum
MPKHYRPAGKKKEGNAAKYITRTKAVNYLQVSLAIFRKLCILKGVFPRQPKKKVEGNHKTYYHMKDIAFIAHDPLIEKFRQIKVHRKKVKKAIAKKNRDLADRLLNRPPTYKLDKLVLERYPTFVDALRDLDDCLTLVHLFAALPAVDGERVEVNRIHNCRRLSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYISTGSGRVTGNSESGGAIKEKEDENKKESSKADESELRLAQLQHQLPANEPGTLMHLVEESTAVDTDDDETKECKSLFKNLKFYLSREVPRESLLFIIPAFGGTVSWEGEGAPFNEVDEDITHQIVDRPTQSHVFLSRAYVQPQWVFDCVNARIILPTEGYLVGRVPPPHLSPFVDNDTEGYIPEYAETIKRLQAAARNEILPLPGDEDLDNSLVAAMMDRTESNEAAEKKMKLEMLEKQYHDELKMEIDGITFSNLSNKKADKSLDTMDKDDSKSDHEDDEKKQAEKDSADISTALMSRKQRGLYKAIEIGKERKRDKVELLKKRKKNSESSASAKRR

SEQ ID NO: 19924 - protein, 605 aa, Pennisetum glaucum
MPKHYRPAGKKKEGNAAKYITRTKAVKYLQVSLANFRKLCILKGVFPRQPKKKVEGNHKTYYHMKDIAFLAHEPLIETFRKIKRHRAKVKKAVAKKNRDLADRLLNRPPTYKLDRLVLERYPTFVDALRDMDDCLTMVHLFAALPAVDGERVEVKRIHNCRRLSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYMSTGSGKMIGNSESGGAIQENEDENNKTSSKADESELRLAQLQHQLPANEPGALMHLVEETTAVDTDDDETKECKSLFKNLKFYLSREVPRESLLFIIPAFGGTVSWEGEGAPFTEVDEDITHQIVDRPTQSHVFLTRQYVQPQWIFDCVNARIILPTEGYIVGRVPPPHLSPFVDNDAEGYIPEYAETIKRLQAAARNEVLPLPGDEDLDNSLVAAMMDRTESDEAAEKKRKLEMLEKQYHDELKMEIDGITFSNLSNKKVDKSPDTMDKDDTNSDHEEDEKKQAQRDSADISKALMSRKKLGLYEAMEKGKARKQDKVEMLKKRKKNAESSASAKRR

SEQ ID NO: 19925 - protein, 607 aa, Cenchrus ciliaris
MPKHYRPAGKKKEGNAAKYITRTKAVKYLQVSLANFRKLCILKGVFPRQPKKKVEGNHKTYYHMKDIAFLAHEPLIEKFRQIKVHRKKVKKAIAKKNRDLAERLLNRPPTYTLDRLVLERYPTFVDALRDMDDCLTMVHLFAALPAVDGERVEVKRIHNCRKLSHEWQAYISRTHSLRKTFISVKGIYYQAEVQGQKITWLTPHALQQVLTDDVDFNVMLSFLEFYESLLTFVNFQLYHSINVKYPPILDPRLEALADELYALCRYMSTGSGKMSGNSESGAAIKDNEDENNKTSSKADESELRLAQLQHQLPANEPGALMHLVEETTAVDTDDDETKECKSLFKNLKFYLSREVPRESLLFIIPAFGGTVSWEGEGAPFTEVDEDITHQIVDRPTQSHVFLTREYVQPQWIFDCVNARIILPTEGYIVGRVPPPHLSPFVDNDAEGYIPEYAETIKRLQAAARNEVLPLPGDEDLDNSLVAAMMDQAETNEAAEKKRKLEMLEKQYHDELKMEIDGVTFSNLSNKKADKSPDTMDKDDTKSDHGEDEKKQAEKDSADISTARALMSRKQLGLYDAMKISKERKQDKVEILKKRKKNAESSASAKRR

SEQ ID NO: 19926 - protein, 604 aa, Oryza sativa
MPKHYRPAGKKKEGNAAKYITRTKAVKYLQISLATFRKLCILKGVFPRDPKKKVEGNHKTYYHMKDIAFLAHDPLIEKFREIKVHRKKVKKAFAKKNKDLADRLLNRPPTYKLDRLILERYPTFVDALRDLDDCLTMVHLFAALPAVEGERVQVQRIHNCRRLSHEWQAYISRTHSLRKTFISVKGIYYQAEVQGQKITWLTPHALQQVLTDDVDFNVMLTFLEFYETLLGFINFKLYHSINVNYPPVLDPRLEALASELYALCRYMSSGRVPGNSEPAGLIEDKEGEDNKESSKTDESELRLAQLQHQLPTNEPGALMHLVQESTAADADDADAKECRSLFKNLKFYLSREVPRESLLFIIPAFGGTVSWEGEGAPFDETDEDITHQIVDRPTQSHVFLSREYVQPQWIYDCVNARIILPTEGYIVGRVPPPHLSPFVDNDAEGYIPEYAETIKRLQAAAQSQVLPLPSLGDEDMENSLVEAIIDRSESNEIADKKRKLEMLEKQYHDELRMEYEGKTFSNRTADNQPDVVDKSDTKEADDHMEDSHKQAEKDAADISKTLMSRKQRGLLQAIEINQERKKDKVNLLKKRKKNADSSASAKGR

SEQ ID NO: 19927 - protein, 604 aa, Oryza sativa
MPKHYRPAGKKKEGNAAKYITRTKAVKYLQISLATFRKLCILKGVFPRDPKKKVEGNHKTYYHMKDIAFLAHDPLIEKFREIKVHRKKVKKAFAKKNKDLADRLLNRPPTYKLDRLILERYPTFVDALRDLDDCLTMVHLFAALPAVEGERVQVQRIHNCRRLSHEWQAYISRTHSLRKTFISVKGIYYQAEVQGQKITWLTPHALQQVLTDDVDFNVMLTFLEFYETLLGFINFKLYHSINVNYPPVLDPRLEALASELYALCRYMSSGRVPGNSEPAGLIEDKEDEDNKESSKTDESELRLAQLQHQLPTNEPGALMHLVQESTAADADDADAKECRSLFKNLKFYLSREVPRESLLFIIPAFGGTVSWEGEGAPFDETDEDITHQIVDRPTQSHVFLSREYVQPQWIYDCVNARIILPTEGYIVGRVPPPHLSPFVDNDAEGYIPEYAETIKRLQAAAQSQVLPLPSLGDEDMENSLVEAIIDRSESNEIADKKRKLEMLEKQYHDELRMEYEGKTFSNRTADNQPDVVDKSDTKEADDHMEDSHKQAEKDAADISKTLMSRKQRGLLQAIEINQERKKDKVNLLKKRKKNADSSASAKGR

SEQ ID NO: 19928 - protein, 467 aa, Glycine max
MEKPAEAENVLVLPPHKQPDNDDNNNNNRPKPKPKRFVKNQIPESILNDPVLNAAISVLPSNYNFEVHKCVWRVLSSGAKRVALQFPEGLLMYSLPLSDILTSFAAVTHCYVLGDVTYGACCVDDLAASALGADLLIHYGHSCLVPIDSTTIPCLYIFVDIKIDVPHFVDTLILNLHKAKTLVIAGTIQFASAIRTAKPQLEELGFRVLIPQSKPLSAGEVLGCTAPKVSSKLLGDDGESSVLVFVADGRFHLEAFMIANPGIRAFRYDPYMGKLFLEEYDHLGMKRSRKNAIFKAREEARSWGLVLGTLGRQGNPRILERLEKMMRDRGFDYTVVLMSEMSPARIALFEDSIDAWIQIACPRLSIDWGEAFVKPVLTPFEADIALGVIPGWWEKNNEVVCCNKSGSCCGDAKGGGEDFGGDYPMDYYAQDGGEWNSSYVIKSTRPPARRVFVVSSVADTTAISQQP

SEQ ID NO: 19929 - protein, 446 aa, Cajanus cajan
MEWSEQAKAEAEVLLVNPPKPKAKPKRFIKNQIPDSILNDPLLNAAISVLPSNYNFEVHKSVWRILSSGAKRLALQFPEGLLMYSLPLSDIFTTFANVTHCYILADVTYGACCVDDFAASALSADLLIHYGHSCLVPIDSTTLPCLYVFVDIKIDVPHFLHTLTLNLHSKTLVLAGTIQFASAIRAAKPQLEELGFRVLIPQAKPLSAGEVLGCTAPRVSSNLLGESVLVFVADGRFHLEAFMIANPGIKAFRYDPYLGKLFLEEYDHLGMKRSRKNAIFKAREARSWGLVLGTLGRQGNPRILERLEKMMREKGFDYTVGLMSELSPGRIALFEDSVDAWIQIACPRLSIDWGEAFVKPVLTPFEAEVALGAIPGWWEKNEVCEEDGVGCCKKSGSCCGGDENDFGGDYPMDYYAQDGGEWNSSYVKKSSRPVRRVSIADSAISQ

SEQ ID NO: 19930 - protein, 340 aa, Brassica napus
MGSAFRDRTAEFRSLSQTLKKIGAAIPSVHQAESDPTSSKRSPPGSSRSEFNKKASQIGLRIHETSQKTARLAKLAKESSIFNDRTLEIQELTVLIRNDITGLNMALSDLQTLQNMEIADGSYSHDKVGHYTAVCDDLKTRLMGATKQFQDVLTARSENMKAHENRKQLFSAKNAAVDNQNNAKAVPEPPPWSSSSVPSGNLQQQPLLPPVNSGASSGSQLRRRSAIENAPSQQMEMSMLQQTVPRQENYSQNRAVALHSVESTITELSGIFTHLATMVTQQGELAIRIDDNMDESLVNVEGARSALLQHLTRISSNRWLMIKIFAVIILFLIVFLFFVA

SEQ ID NO: 19931 - protein, 340 aa, Brassica rapa
MGSAFRDRTAEFRSLSQTLKKIGAAIPSVHQAESDPTSSKRSSPGSSRSEFNKKASQIGLRIHETSQKTARLAKLAKESSIFNDRTLEIQELTVLIRNDITGLNMALSDLQTLQNMEIADGSYSHDKVGHYTAVCDDLKTRLMGATKQFQDVLTARSENMKAHENRKQLFSAKNAAVDNQNNAKAVPEPPPWSSSSVPSGNLQQQPLLPPVNSGASSGSQLRRRSAIENAPSQQMEMSMLQQTVPRQESYSQNRAVALHSVESTITELSGIFTHLATMVTQQGELAIRIDDNMDESLVNVEGARSALLQHLTRISSNRWLMIKIFAVIILFLIVFLFFVA

SEQ ID NO: 19932 - protein, 343 aa, Raphanus sativus
MGSTFRDRTAEFRSLSQTLKKIGAIPSSVHQAESDPTTSSTKRSPPGSSRSEFNKKASQIGLRIHETSQKTARLAKLGKESSIFNDRTLEIQELTVLIRNDITGLNMALSDLQTLQNMEIADGSYSHDKVGHYTAVCDDLKTRLMGATKQFQDVLTARSENMKAHENRKQLFSAKNAAVDNNQNNAKAVPEPPPWSSSSVPSGNLQQQPLLPPVNSGAPSGSQLRRRSAIENPPSQQMEMSMLQQTVPRQENYSQNRAVALHSVESTITELSGIFTHLATMVTQQGELAIRIDDNMDESLVNVEGARSALLQHLTRISSNRWLMIKIFVVIILFLIVFLFFVA

SEQ ID NO: 19933 - protein, 341 aa, Brassica napus
  Sequence also found in Organisms: Brassica oleracea
MGSTFRDRTAEFHSLSQTLKKIGAAIPSVHQAESDPTSSKRSSPPGSSRSEFNKKASQIGLRIHETSQKTARLSKLAKESSIFNDRTLEIQELTVLIRNDITGLNMALSDLQTLQNMEIADGSYSHDKVGHYTAVCDDLKTRLMGATKQFQDVLTARSENMKAHENRKQLFSAKNAAVDNQNHAKAVPEPPPWSSSSTPSGSLQQQPLLPPVNSGAPSGSQLRRRSAIENAPSQQMEMSMLQQTVPRQENYSQNRAVALHSVESTITELSGIFTHLATMVTQQGELAIRIDDNMDESLVNVEGARSALLQHLTRISSNRWLMIKIFAVIILFLIVFLFFVA

SEQ ID NO: 19934 - protein, 340 aa, Eutrema parvulum
MGSTFRDRTAEFYSLSQTLKKIGAIPSVNQVEGDPTTSKRSPPGSSRSEFNKRASQIGLHIHETSEKIARLAKLAKQSSIFNDRTVEIQELTVLIRNDITGLNTALSDLQTLQNMEIADGNYSQDKVGHYTAICDDLKTRLMGATKQLQDVLTTRSENMKAHENRKQLFSTKNAAVDSPPQNNAKSVPEPPPWSSSSNPSGNLQQPLLPPLNSGAPTGSQLRRRSAIENAPSQQMEMSMLQQTVPRQENYSQNRAVALHSVESTITELSGIFTHLATMVTQQGELAIRIDDNMDESLVNVEGARSALLQHLTRISSNRWLMIKIFAVITLFLIVFLIFVA

SEQ ID NO: 19935 - protein, 336 aa, Arabidopsis lyrata
MGSTFRDRTVEFHSLSQTLKKIGAIPSVHQDEDDPASSKRSSPGSEFNKKASRIGLGIHETSQKIARLAKLAKQSSIFNDRTVEIQELTVLIRNDITGLNMALSDLQTLQNMEIADGNYSQDKVGHYTAVCDDLKTRLMGATKQLQDVLTTRSENMKAHENRKQLFSTKNAVDSPPQNNAKSVPEPPPWSSSSNPYGNLQQPLLPPVNTGAPPGSQLRRRSAIENAPSQQMEMSMLQQTVPRQENYSQSRAVALHSVESTITELSGIFTHLATMVTQQGELAIRIDDNMDESLVNVEGARSALLQHLTRISSNRWLMMKIFAVIILFLIVFLFFVA

SEQ ID NO: 19936 - protein, 341 aa, Eutrema halophilum
MGSTFRDRTAEFYSLSQTLKKIGVVPSVHQAEDDPATSKRSPPGSSRSEFNKKASQIGVRIQETFQKIARLVKLAKQSSIFNDRTVEIQELTLVIRNDITGLNMALSDLQTLQNLEIADGNYSQDKVGHYTAVCDDLKTRLMGATKQLQDVLTTRSENMKAHENRKQLFSTKNAVVDSPPQNNARSVVPEPPPWSSSSNPTGNLQQPLLPPLNSGAPSGSQLRRRSAIENAPSQQMEMSMLQQTVPRQENYSQGRAVALHSVESTITELSGIFTHLATMVTQQGELAIRIDDNMDESLVNVEGARSALLQYLTRISSNRWLMIKIFAVIILFLIVFLFFVA

SEQ ID NO: 19937 - protein, 316 aa, Brassica napus
MGSAFRDRTAEFRSLSQTLKKIGGAIPSVHQAESDPTSSKRSSPGSSRSEFNKKASQIGLRIHETSQKTARLAKLAKESSIFNDRTLEIQELTVLIRNDITGLNMALSDLQTLQNMEIADGSYSHDKVSHYTAVCDDLKTRLMGATKQFQDVLTARSENMKAHENRKQLFSAKNAAVDNQSNAKAVPEPPPWSSSSVSSGNLQQQPLLPPSNSGAPSGSQLRRRSAIENAPSQQMEMSMLQQTVPRQESYSQNRAVALHSVESTITELSGIFTHLATMVTQQGELAIRIDDNMDESLVNVEGARSALLQHLTRISS

SEQ ID NO: 19938 - protein, 336 aa, Arabidopsis thaliana
MGSTFRDRTVELHSLSQTLKKIGAIPSVHQDEDDPASSKRSSPGSEFNKKASRIGLGIKETSQKITRLAKLAKQSTIFNDRTVEIQELTVLIRNDITGLNMALSDLQTLQNMELADGNYSQDQVGHYTAVCDDLKTRLMGATKQLQDVLTTRSENMKAHENRKQLFSTKNAVDSPPQNNAKSVPEPPPWSSSSNPFGNLQQPLLPPLNTGAPPGSQLRRRSAIENAPSQQMEMSLLQQTVPKQENYSQSRAVALHSVESRITELSGIFPQLATMVTQQGELAIRIDDNMDESLVNVEGARSALLQHLTRISSNRWLMMKIFAVIILFLIVFLFFVA

SEQ ID NO: 19939 - protein, 132 aa, Vigna unguiculata
MASVLRNVKVLPNSASVEEARQRVFEFFRVACRSLPSVMEIYNLYDVTSVAQLRSTIASEIRKNINLSDPKVIDMLLFKGMEELKNVVNHSKQRHHIIGQYVVGQQGQVQDSASKDPGTSPFLKNFYSSNYF

SEQ ID NO: 19940 - protein, 403 aa, Glycine max
MACGSVLSSFLHITNSMAIKGVLSFAPNPPLLLRLPKAVTFLSFSASTKSPTKSFQVRSIAGTTEAASGFDEMVSGTKRKYYMLGGKGGVGKTSCAASLAVKFANNGHPTLVVSTDPAHSLSDSFAQDLTGGALVPVEGPDYPLFALEINPEKSREEFRNAAQKNGGTGVKDFMDGMGLGMIADQLGELKLGELLDSPPPGLDEAIAISKVMQFLESQEYSMFTRIVFDTAPTGHTLRLLSLPDFLDASIGKILKLRQKIASATSAIKSVFGQEETRQNAADKLEKLRERMIKVRELFRDTDSTEFVIVTIPTVMAISESSRLSASLKKENVPVKRLIVNQILPPSTSDCKFCAMKRKDQMRALDIVQNDPELSSLLMIQAPLIDVEIRGVPALKFLGDIIWK

SEQ ID NO: 19941 - protein, 403 aa, Cajanus cajan
MACRSVISSSLHITNSMAIKGVLSFAPNPPLLHRLPKAVTFVSFSASTKPPTKSFQVRSVASTTEAASGFDEMVSGTTRKYYMLGGKGGVGKTSCAASLAVKFANNGHPTLVVSTDPAHSLSDSFAQDLTGGALVPVEGPDYPLFALEINPEKSREEFRNAAQKNGGTGVKDFMDGMGLGMIADQLGELKLGELLDSPPPGLDEAIAISKVMQFLDSQEYSMFTRIVFDTAPTGHTLRLLSLPDFLDASIGKILKLRQKIASATSAIKSVFGQEETRQNASDKLEKLRERMIKVRDLFRDTDSTEFVIVTIPTVMAVSESSRLSASLKKENVPVKRLIVNQILPPSTSDCKFCAMKRKDQMRALDIIQNDPDLSSLLMIQAPLVDVEIRGVPALKFLGDIIWK

SEQ ID NO: 19942 - protein, 387 aa, Phaseolus vulgaris
MAVKGVLSFAPNPPLFHHLPKVVTFVSLSASVKLPTKSFQVRSVVGTTEAASEFDEMVSGTKRKYYMLGGKGGVGKTSCAASLAVKFANNGHPTLVVSTDPAHSLSDSFAQDLTGGALVPVEGPDFPLFALEINPEKSREEFRNAAQKNGGTGVKDFMDGMGLGMIADQLGELKLGELLDSPPPGLDEAIAISKVMQFLESQEYSMFTRIVFDTAPTGHTLRLLSLPDFLDASIGKILKLRQKIASATSAIKSVFGQENTQQNSADKLEKLRERMLKVRELFRDTDSTEFVIVTIPTVMAVSESSRLSASLKKENVPVKRLVVNQILPPSPSDCKFCAMKRKDQMRALDLIQNDPELSSLLMIQAPLVDVEIRGVPALKFLGDIIWK

SEQ ID NO: 19943 - protein, 405 aa, Cicer arietinum
MACYSTSSVSSSLRITNSMAMNGVLSFPPTSSPILPFNKAFTFVSMRASIKPPTNSFQVRSVATPTESVAGFDDMVAGTERKYYMLGGKGGVGKTSCAASLAVKFANNGHPTLVVSTDPAHSLSDSFAQDLTGGALVPVDGPDYPLFALEINPEKARDDFRDASKQNGGTGVKDFMDGMGLGMIVDQLGELKLGELLDTPPPGLDEAIAISKVMQFLESQEYNMFTRIVFDTAPTGHTLRLLSLPDFLDASIGKILKLRQKIASATSAIKSVFGQEQNRPDAADKLEKLRERMIKVRELFRDTDSTEFVIVTIPTVMAVSESSRLSASLKKENVPVKRLIVNQILPPSASDCKFCAMKRKDQTRALDMIQNDPELSSLSMIQAPLVDVEIRGVPALKFLGDIIWT

SEQ ID NO: 19944 - protein, 404 aa, Trifolium pratense
MASSTAISSSLRITNSMAIKGRLSFPPTPSPLLPFHKASTFISLRASNKPPTKSFQVRAVATPTESVAGFDDMVAGTERKYYMLGGKGGVGKTSCAASLAVKFANNGHPTLVVSTDPAHSLSDSFAQDLTGGALVQVDGPDYPLFALEINPEKARDDFRDAAKQNGGSTGVKDFMDGMGLGMIVDQLGELKLGELLDTPPPGLDEAIAISKVMQFLESQEYKMFTRVVFDTAPTGHTLRLLSLPDFLDASIGKILKLRQKIASATSAIKSVFGQEKNPQDAADKLEKLRERMIKVRDLFRDTDSTEFVIVTIPTVMAVNESSRLSASLKKESVPVKRLIVNQILPPSASDCKFCAVKRKDQTRALDVIRSDPELSSLLMIQAPLVDVEIRGVPALKFLGDIIWK

SEQ ID NO: 19945 - protein, 410 aa, Arachis hypogaea
MPLLLGIQQLMASHTLISSSSLRITNSMPIKCVPSSFTPTKAFSFLSLSLSTTTTTIPTKSFQVRSVAAPTESVAGFDDMVSGTQRKYYMLGGKGGVGKTSCAASLAVKFANNGHPTLVVSTDPAHSLSDSFAQDLTGGQLVPVEGPDYPLFALEINPEKAREEFRNATKKNGGTGVKDFMDGMGLGMIVEQLGELKLGELLDTPPPGLDEAIAISKVMQFLESQEYSMFTRIVFDTAPTGHTLRLLSLPDFLDASIGKILKLRQKIASATSAIKSVFGQEETQQAAADKLEKLRERMIKVRELFRDTDATEFVIVTIPTVMAVSESSRLSASLKKENVPVKRLIVNQILPPSASDCKFCAMKRKDQMRALDMIQNDPELASLTMIQAPLVDVEIRGVPALKFLGDIIWK

SEQ ID NO: 19946 - protein, 388 aa, Medicago truncatula
MAIKGALSFSPTPSPLFPFHKASSFVSLRFSTKPPTKSFQVKSVAAPTESISVFDDMVAGTERKYYMLGGKGGVGKTSCAASLAVKFANNGHPTLVVSTDPAHSLSDSFAQDLTGGALVQVDGPDYPLFALEINPEKAREDFRDVAKQNGGSTGVKDFMDGMGLGMIVDQLGELKLGELLDTPPPGLDEAIAISKVIQFLESQEYNMFTRIVFDTAPTGHTLRLLSLPDFLDASIGKILKLRQKIASATSAIKSVFGQENPRQDATDKLEKLRERMIKVRELFRDTDSTEFVIVTIPTVMAVNESSRLSASLKKESVPVKRLIVNQLLPPSASDCKFCAMKRKDQTRALDMIQSDPELSSLSMIQAPLVDVEIRGVPALKFLGDIIWK

SEQ ID NO: 19947 - protein, 409 aa, Trifolium pratense
MASYTSSSAISSSSLRITNSMPIKGLLSFPPTPSPLLPFHKASTFISLRASNKPLTKSFQVRAVATPTESVAGFDDMVAGTERKYYMLGGKGGVGKTSCAASLAVKFANNGHPTLVVSTDPAHSLSDSFAQDLTGGALVQVDGPDYPLFALEINPEKARDDFRDAAKQNGGSTGVVKDFMDGMGLGMIVDQLGELKLGELLDTPPPGLDEAIAISKVMQFLESQEYKMFTRVVFDTAPTGHTLRLLSLPDFLDASIGKILKLRQKIASATSAIKSVFGQENNPQDAADKLEKLRERMIKVRDLFRDTDSTEFVIVTIPTVMAVNESSRLSASLKKESVPVKRLIVNQILPPSASDCKFCAVKRKDQTRALDVIRSDPELSSLLMIQAPLVDVEIRGVPALKFLGDIIWK

SEQ ID NO: 19948 - protein, 409 aa, Castanea mollissima
MATRLVSSTFSAPLHSLASRSSMAMVGLVSCSPKTLTPFSLTKSFNFISLSTTRKPLTKSLQVRSVSTPAEGVTVFDDMVSGTKRKYYMLGGKGGVGKTSCAASLAVKFANSGHPTLVVSTDPAHSLSDSFAQDLTGGTLVPVEGPESPLFALEINPEKAREEFRSATQKNGGTGVQDFMNGMGLGMLADQLGELKLGELLETPPPGLDEAMAISKVIQFLESQEYNMFTRIVFDTAPTGHTLRLLSLPDFLDASIGKILKLRQKIASATSAIKSVFGQEETRMDAADKLEKLRERMVKVRELFRDTDSTEFVIVTIPTVMAVSESSRLRASLKKEHVPVKRLIVNQILPPSASDCKFCAMKRKDQSRALDMIRDDTELSSLELIQAPLVDVEIRGVPALKFLGDIIWK

SEQ ID NO: 19949 - protein, 409 aa, Quercus alba
MATRLVPSTFSASLHSLASRSSMAMVGLVSCSPKTLTPFSLTKSFNFISLSTTRKPLTKSLQVRSVSTPAEGVTVFDDMVSGTKRKYYMLGGKGGVGKTSCAASLAVKFANSGHPTLVVSTDPAHSLSDSFAQDLTGGTLVPVEGPDSPLFALEINPEKAREEFRSATQKNGGTGVQDFMNGMGLGMLADQLGELKLGELLETPPPGLDEAMAISKVIQFLESQDYNMFTRIVFDTAPTGHTLRLLSLPDFLDASIGKILKFRQKIASATSAIKSVFGQEETRLDAADKLEKLRERMVKVRELFRDTDSTEFVIVTIPTVMAVSESSRLRASLKKENVPVKRLIVNQILPPSASDCKFCAMKRKDQSRALDMIRNDTELSSLELIQAPLVDVEIRGVPALKFLGDIIWK

SEQ ID NO: 19950 - protein, 379 aa, Trigonella foenum-graecum
MDENDVSNEVVKGKKKGKHDKPKPWDDDPNIDHWKVEKFDPSWNESGMLEVSSFSTLFPQYREKYLQEAWPLVKSSLKEFGISAELNLVEGSMTVSTTRKTRDPYIIVKARDLIRLLSRSVPAPQAIKIIDDEMQCDIIKISGLVRNKERFVKRRQHLVGPNSSTLKALEILTGCYILVQGNTVSVMGSYKGLKQVRRIVEECMLNKLHPVYNIKILMMKKELEKDPALAQENWDRFLPKFNNKNVKQKKVTAKPKKPYTPFPPPQQPSKVDIQLETGEYFMSDKKKSAKKWQERQVQQAEKTAENKRKRDESFIPPKEPTKLVDNSEDANNVAEITLSLKEKARKFGKRKSEENINAETYIMGSSEQPSKKKSKKQKS

SEQ ID NO: 19951 - protein, 380 aa, Trifolium pratense
MDENDVTNEVVKTKKKGKHDKPKPWDDDPNIDHWKVEKFDPSWNEGGMLDVSSFSTLFPQYREKYLQEAWPLVKSSLKEFGISAELNLVEGSMTVSTTRKTKDPYIVVKARDLIRLLSRSVPAPQAIKILDDEMQCDIIKISGLVRNKERFVKRRQHLVGPNSSTLKALEILTGCYILVQGNTVSVMGSYKGLKQVRRIVEECMLNKMHPVYNIKILMMKKELEKDPALAQESWDRFLPKFNKKNVKQKKVSAKQKKPYTPFPPPQQPSKVDIQLETGEYFMSDKKKSAKKWQERQEKQAEKTAENKRKRDESFIPPKEPTKLVDNSEDANNNVSEMAMSLKKKAKKFGKSKSEENINAEAYIIGSSDQPSRKKSKKQRS

SEQ ID NO: 19952 - protein, 380 aa, Trifolium pratense
MDENDVTNEVVKTKKKGKHDKPKPWDDDPNIDRWKVEKFDPSWNEGGMLEVSSFSTLFPQYREKYLQEAWPLVKSSLKEFCISAELNLVEGSMTVSTTRKTKDPYIIVKARDLIRLLSRSVPAPQAIKILDDEMQCDIIKISGLVRNKERFVKRRQHLVGPNSSTLKALEILSGCYILVQGNTVSVMGSYKGLKQVRRIVEECMLNKMHPVYNIKILMMKKELEKDPALAQENWDRFLPKFNKKNVKQKKVSAKQKKPYTPFPPPQQPSKVDIQLETGEYFMSDKKKSAKKWQERQEKQAEKTAANKRKRDESFIPPKEPTKPVDNSEDANNNVAEMAMSIKKKAKNFGKRNSEENIDAETYIMGSSEQPSRKKSKKQKS

SEQ ID NO: 19953 - protein, 380 aa, Trifolium pratense
MDENDVTNEVVKTKKKGKHDKPKPWDDDPNIDHWKVEKFDPSWNEGGMLDVSSFSTLFPQYREKYLQEAWPLVKSSLKEFGISAELNLVEGSMTVSTTRKTKDPYIVVKARDLIRLLSRSVPAPQAIKILDDEMQCDIIKISGLVRNKERFVKRRQHLVGPNSSTLKALEILTGCYILVQGNTVSVMGSYKGLKQVRRIVEECMLNKMHPVYNIKILMMKKELEKDPALAQESWDRFLPKFNKKNVKQKKVNAKQKKPYTPFPPPQQPSKVDIQLETGEYFMSDKKKSAKKWQERQEKQAEKTAENKRKRDQSFIPPKEPVKPADNSEDANNNVSEMAMSLKKKAKKFGKSKSEENINAEAYIIGSSDQPSRKKSKQQRS

SEQ ID NO: 19954 - protein, 382 aa, Cicer arietinum
MDENELRNEVVVKEKKKKGKHDKPKPWDDDPNIDHWKVEKFDPSWNEGGMLEVSSFSTLFPQYREKYLQEAWPLVKSSLKDFGISAELNLVEGSMTVSTTRKTKDPYIIVKARDLIRLLSRSVPAPQAIKILDDEMQCDIIKISGMVRNKERFVKRRQHLVGPNSSTLKALEILSGCYILVQGNTVSVMGSFKGLKQVRRIVEECMLNKMHPVYNIKVLMMKKELEKDPALAEENWDRFLPKFNKKNVKKKKANSKQKKPYTPFPPPQQPSKVDIQLETGEYFMTEKKKSAKKWQERQEKQAEKTAENKRKREEAFIPPKEHAKPVDNSDDATNNVSEMAMSLKKKAKKFGKRKSEENINAETYIMGSSEQPSKKKSKQHRS

SEQ ID NO: 19955 - protein, 382 aa, Cicer arietinum
MDENELRNEVVPKEKKKKGKHDKPKPWDDDPNIDHWKVEKFDPSWNEGGMLEVSSFSTLFPQYREKYLQEAWPLVKSSLKDFGISAELNLVEGSMTVSTTRKTKDPYIIVKARDLIRLLSRSVPAPQAIKILDDEMQCDIIKISGMVRNKERFVKRRQHLVGPNSSTLKALEILSGCYILVQGNTVSVMGSFKGLKQVRRIVEECMLNKMHPVYNIKVLMMKKELEKDPALAEENWDRFLPKFNKKNVKKKKANSKQKKPYTPFPPPQQPSKVDIQLETGEYFMTEKKKSAKKWQERQEKQAEKTAENKRKREEAFIPPKEHAKPVDNSEDANNNVSEMAKSLKKKAKKFEKRKSEENINAETYIMGSSEQPSKKKSKQHRS

SEQ ID NO: 19956 - protein, 389 aa, Glycine max
MEIHSEEENGVANESQALEQKEKRKGKHDKPKPWDDDPNIDHWKIEKFDPSWNDGGMLEVSSFSTLFPQYREKYLQEAWPMVKSALKEFGVACELNLVEGSMTVSTTRKTRDPYIIIKARDLIKLLSRSLPAPQAIKILDDEMQCDIIKISGMVRNKERFVKRRQHLVGPNSSTLKALEILTGCYILVQGNTVAAMGSFKGLKQVRRIVEECMLNKMHPVYNIKVLMMKKELEKDPALAQENWDRFLPKFKKKNVKQKKVNTKQKKPYTPFPPPQQPSKIDIQLETGEYFLSNKRKSAKIWQEKQEKQAEKTAENKRKREEAFIPPKEPANLVDKSEDANSNVADMAMSLKKKTKKFGKRKSEENINAETYIIGSSEQASGKKSKKQRS

SEQ ID NO: 19957 - protein, 386 aa, Lotus japonicus
MAEEDYNNGATNEAPKENTKRKGKHDKPKPWDDDPNIDRWKVEKFDPSWNEGGMVEVSSFSTLFPQYREKYLQEAWPLVKSSLKEFGVSCELNLVEGSMTVSTTRKTRDPYIIVKARDLIKLLSRSVPAPQAIKILDDEVQCDIIKISGMVRNKERFVKRRQHLVGPNSSTLKALEILTGCYILVQGNTVSAMGSFKGLKQVRRIVEECMLNKLHPVYNIKILMMKKELEKDPALAQENWDRFLPKFKKKNVKQKKVKAKEKKPYTPFPPPQPLSKEDEQLLTGEYFMSDKRKSAKKWQERQEKQAEKTAENKRKRDEAFIPPKEPAKPLDKSEDANDNVADMAMSLKKKAKKFGERKSGENVDAEAYIMGSSEQASGKKSKKQRS

SEQ ID NO: 19958 - protein, 391 aa, Arachis hypogaea
MVRDGDATDQNGDALVPPLPTNEKRKGKHDKPKPWDEDPHIDHWKVEKFDPSWNEGGMLEVSSFSTLFPQYREKYLQEAWPLVKSALKEFGISCELNLVEGSMTVSTTRKTRDPYIIVKARDLIKLLSRSVPAPQAIKILDDEVQCDIIKISGLVRNKERFVKRRQHLVGPNSSTLKALEILTGCYILVQGNTVAAMGSFKGLKQVRRIVEECMLNKMHPVYNIKVLMLKKELEKDPALAQENWDRFLPKFKKKNVQQKKVKSKEKKPYTPFPPPQQPSKVDIELETGEYFLSAKKKSAKKWQEKQEKQAEKTAENKRKREEAFIPPKEPAKPVDKSEDANNNNVADMAKSLKQKAKKLGMRKSEENINAETYIIGSSEQPSGKKSKKQKS

SEQ ID NO: 19959 - protein, 387 aa, Lupinus angustifolius
MDDEIDANGTITKEENAPKEKRKGKHDKPKPWDDDPNIDHWKVDKFDPSWNEGGMLEVSSFSTLFPQYREKYLQQAWPLVKSSLKEFGVSCELNLVEGSMTVTTTRKTRDPYIIIKARDLIKLLSRSVPAPQAIKILDDEVQCDIIKISGMVRNKERFVKRRQHLVGPNSSTLKALEILTGCYILVQGNTVAAMGSFKGLKQVRRIVEECMLNKLHPVYNIKILMMRKELEKDPALAQENWDRFLPKFKKKNVKQKKVNTKQKKPYTPFPPPQPPSKVDIQLETGEYFLSDRKKSQKKWQEKQEKQAEKTAENKRKRDEAFIPPKEPAKLADKSEVANNNVADIAMSLKKKAKKFGERKSEENLNAETYIIGSSEQVSRKKSKKQRT

SEQ ID NO: 19960 - protein, 389 aa, Glycine max
MEKHSDGENGVEEEPRSLEQKEKRKGKHDKPKPWDDDPNIDHWKIDKFDPSWNDGGMLEVSSFSTLFPQYREKYLQEAWPMVKSSLKEFGVACELNLVEGSMTVSTTRKTRDPYIIIKARDLIKLLSRSIPAPQAIKILDDEMQCDIIKISGMVRNKERFVKRRQHLVGPNSSTLKALEILTGCYILVQGNTVAAMGSFKGLKQVRRIVEECMLNKMHPVYNIKVLMMKKELEKDPALAQENWDRFLPKFKKKNVKQKKVNTKQKKPYTPFPPPQQPSKIDIQLETGEYFLSNKRKSAKIWQEKQEKQAEKTAENKRKREEAFIPPKEPANLVDKSEDANNNVADMAISLKKKTKKFGKRKSEENIDAETYIVGSSEQASGKKPKKQRS

SEQ ID NO: 19961 - protein, 428 aa, Trifolium pratense
MLTKRNHKLNGNPNKHSTFYSLPRPAPTRRIYHSSAVTLTGPRPYSTAMDENDVTNEVVKTKKKGKHDKPKPWDDDPNIDHWKVEKFDPSWNEGGMLDVSSFSTLFPQYREKYLQEAWPLVKSSLKEFGISAELNLVEGSMTVSTTRKTKDPYIIVKARDLIRLLSRSVPAPQAIKILDDEMQCDIIKISGLVRNKERFVKRRQHLVGPNSSTLKALEILTGCYILVQGNTVSVMGSYKGLKQVRRIVEECMLNKMHPVYNIKILMMKKELEKDPALAQENWDRFLPKFNKKNVKQKKVNTKQKKPYTPFPPPQQPSKVDIQLETGEYFMSDKKKSAKKWQERQEKQAEKTAANKRKRDESFIPPKESTKSVDNSEDANNNVAEMAMSLKKKAKNFGKRKSDENINAETYIMGSSEQPSRKKSKQQKS

SEQ ID NO: 19962 - protein, 389 aa, Vigna unguiculata
MKNLEEDENGVVREESQMKEKRKGKHDKPKPWDDDPNIDHWKVEKFDPSWNEGGMLEVSSFSTLFPQYREKYLQEAWPTVKSALKQYGIACELNLVEGSMTVSTTRKTRDPYIIVKARDLIRLLSRSVSAPQAIKILDDEIQCDIIKISGLVRNKERFVKRRQHLVGPNSATLRALEILTGCYILVHGNTVAAMGSFKGLKQIRRIVEECMLNKMHPVYNIKILMMKKELEKNPDLANENWDRFLPKFKKKNVKQKKANSKQKKPYTPFPPPQQPSKIDIQLETGEYFLSNKRKSAKIWQEKQEKQAEKTAESKRKREEAFIPPKEPVKPVDKSEDAANNVADIAKSLKTKTEKFGKRKSEENLNAETYIMGSSEHASRKKSKKQKSSA

SEQ ID NO: 19963 - protein, 389 aa, Phaseolus vulgaris
MKNLEEDENGVEQEELQKKEKRKGKHDKPKPWDDDPNIDHWKVEKFDPSWNEGGMLEVSSFSTLFPQYLEKHLQEIWPTVKSALKQYGIACELNLVEGSMTVSTTRKTRDPYIIIKARDLIKLLARSVTPTQAIKILDDEVQCDIIKISGLVRNKERFVKRRQHLLGPNSSTLKALEILTGCYILVQGNTVSAMGSFKGLKQVRRIVEECMLNKMHPVYNIKVLMMKKELEKDPSLAQENWDRFLPKFKKKNVKQKKVNSKQKKPYTPFPPPQQPSKIDIQLETGEYFLNNKRKSAKIWQEKQEKQAEKTAENKRKRDEAFIPPKEPVNPVDKSEDANNKVTDITMSLKKKTEKFGKRKSEENINAESYIMGSSEQTSGKKSKKQRSLA

SEQ ID NO: 19964 - protein, 744 aa, Trifolium pratense
MSGDPPVESPTSVLEEEEVEVKSEEEVVADDGSSSLVLKSMVEEEEKLLKASAKEEEELCEEAPNLNDTQFNKLDELLTQTKLYSEFLLEKMDDITLNPGEQENQDEEESQPSVKKKGRGAKRKAATQCNTRKAKKAVEAMITRSKENVKTEDVNLTEEERTEKEQKELMPLLTGGKLKSYQLKGVKWLISLWQNGLNGILADQMGLGKTIQTIGFISHLKSKGLDGPYMIIAPLSTLSNWVNEITRFTPSLPVVIYHGDKKLRDQIRRKHMPRTVGPKFPIVITSYEIAMNDARKCFGSYSWKYLVVDEGHRLKNSNCKLVNMLRYIKVENKLLLTGTPLQNNLAELWSLLNFILPDIFSSLEEFEKWFNLSGKCTNGATMEEMEEKRRNQVVAKLHGILRPFLLRRMKSDVELMLPRKKEIIIYANMTEHQKSLQDHLINETLGKYLDAKLSVGRAATKLNNLVIQLRKVCNHPDLLESAFDGSYLYPPVNEIIEQCGKFHLLDRLLQRLFARNHKVLIFSQWTKVLDIMDYYFSEKGFEVCRIDGSVKLDDRKRQIENFNDTNSNCRIFLLSTRAGGLGINLTAADTCILYDSDWNPQMDLQAMDRCHRIGQTKPVHVYRLATAQSVEGRMLKRAFSKLKLEHVVIEKGQFHQERVTPSIADEMEGEDILALLRDEETAEDKMIQKDISDEDLEKLLDRSDLVINSSTDDKAPVSTFPVKGPGWEVVIPTASGGMLSTLNS

SEQ ID NO: 19965 - protein, 743 aa, Cicer arietinum
MEVKNKEKNDDPTVESPTSVLEEELEEVVVADDGVVSKSMAEEEEKLLKARVEEEKEQCEEAPNLNDTQFNKLDELLTQTKLYSEFLLEKMDDITLTAGEQEKQDEEESQPVAKKNGRGSKRKAASQCNTRKAKRAVEAMITRSKENVKTEDVNLSEEEKTEKEQKELMPLLTGGKLKSYQLKGVKWLISLWQNGLNGILADQMGLGKTIQTIGFLSHLIAKGLNGPYMIISPLSTLSNWMNEISRFAPSLPAIIYHGNKQQRDDIRRNHMPRTVGPKFPIVITSYEIAMNDAKKCFRSYNWKYLVVDEGHRLKNSKCKLVKELKYIKVENKLLLTGTPLQNNLAELWSLLNFILPDIFSSLEEFESWFNLSGKSCNGATMEELEEKRRAQVVAKLHAILRPFLLRRMKSDVELMLPRKKEIIVYANMTEHQKSLQEHLINETLGKYLNDKLSIGRSVTKLNNLVLQLRKVCNHPDLLESAFDRSYFYPPVNEIIEQCGKFHLLNRLLERLFARNHKVLIFSQWTRVLDIMDYYFSEKGFEVCRIDGSVKLEDRKRQIQDFNDTNSNCRIFLLSTRAGGLGINLTAADTCILYDSDWNPQMDLQAMDRCHRIGQTKPVHVYRLATAQSVEGRMLKRAFSKLKLEHVVIEKGQFHQERTKPAIVDEMEEEDVLALLRDEETAEDKMIQKDISDEDLEKILDRSDLVINGSGDDKAPASTFPLKGPGWEVVIPTATGGMLSTLNS

SEQ ID NO: 19966 - protein, 750 aa, Trifolium pratense
MDDKNNVVNVDPPVESPTSVLEEEEVEVKSEEEVVADDGSSSLVSKLMAEEEKKLLEARAKEEEEPLEAPNLDDSQFNKLDELLTQTKLYSEFLLEKMDDITMNPSEQEKEDEEESQPSVKKKGRGAKRKAAKQCNTRKAKKAVEAMITRSKENLKTEDVNLTEEERTEKEQKDLMPLLTGGKLKSYQLKGVKWLISLWQNGLNGILADQMGLGKTIQTIGFISHLKSRGLDGPYMIIAPLSTLSNWVNEFSRFTPSLRVVIYHGNKNQRDQIRRKHMPRTVGPEFPIVITSYEIAMNDARKCFAPYSWKYLVVDEGHRLKNSNCKLVKSLRYINVDNKLLLTGTPLQNNLAELWSLLNFILPDIFSSLDEFEKWFNLSGKCTNGATMEEMEEKRRNQVVAKLHGILRPFLLRRMKSDVELMLPRKKEIIIYANMTEHQKSLQDHLINEKLGEYLETKLSVGRGATKLNNLVIQLRKVCNHPDLLESAYDGSYFFPPVNEIIEQCGKFHLLDRLLQRLFARNHKVLVFSQWTKVLDIMEYYFSEKGFEVCRIDGSVKLDDRKRQIEDFNDTNSNCRIFLLSTRAGGLGINLTAADTCIIYDSDWNPQMDLQAMDRCHRIGQTKPVHVYRLATAQSVEGRMLKRAFSKLKLEHVVIEKGQFHQERTAPSIVDEMEGEDILALLRDEETAEDKMIQKDISDEDLEKLLDRSDLVINSSTDEKAPVSTFPLKGPGWEVVISAASGGMLSTLNS

SEQ ID NO: 19967 - protein, 762 aa, Glycine max
MEAKDKVKNEDSAAESPTSVLEDEDVCALKEEVKLEEMVTADVKDDGSSLISKTMVEEEEKLLEARIKEEEVQYEEAVDLNDIQFNKLDELLTQTRLYSEFLLEKMDDITLAVGEQENREEQESNPSAKKGRGSKRKVASQYNTRKAKKAVAAMLTRSKESEKTEDMNMTEEERVEKEQKELMPLLTGGKLKNYQLKGVKWLISLWQNGLNGILADQMGLGKTIQTIGFLSHLKAKGLDGPYMIIAPLSTLSNWVNEISRFAPSLPAVIYHGDKKQRDDIRRKHMPTRTIGPQFPIVITSYEIALNDAKKYFRSYNWKYLVVDEGHRLKNSQCKLVKALKFINVENKLLLTGTPLQNNLAELWSLLNFILPDIFASLEEFESWFNLSGKSNNGATKEELEEKRRSQVVAKLHAILRPFLLRRMKSDVEIMLPRKKEIIIYANMTEHQKNLQDHLVNKTLGNYLKENMSSGRSVPAGMIRNLAIQLRKVCNHPDLLESAFDDSYLYPPLEEIVGQCGKFHLLDRLLQRLFARNHKVLIFSQWTKVLDIMDYYFSEKGFEVCRIDGGVKLDERKQQIQDFNDVNSNCRVFLLSTRAGGLGINLTAADTCILYDSDWNPQMDLQAMDRCHRIGQTKPVHVYRLSTAQSIEGRMLKRAFSKLKLEHVVIEKGQFHQERTKPASMDEIEEDDVLALLRDEETAEDKMIHTDISDEDLEKLLDRSDLIVNDFNDDNFKAPVSVFPLKGPGWEVVIPTATGGMLSTLNS

SEQ ID NO: 19968 - protein, 762 aa, Cajanus cajan
FEMEAKDKVKEEDTAVESPTSVLEDEDVCATKEEVKSEEEVIADVKDDGSSLISKTMAEEEEKLLEARMKEEEVQCEEALDLNDTQFNKLDELLTQTKLYSEFLMEKMDDITLTVGEQENEEEQEANPSAKKKGRGSKRKAASQYNTRKAKQAVAAMLTRSKESEETEDTNMSEEEKVEKEQKELMPLLTGGKLKPYQLKGVKWLISLWQNGLNGILADQMGLGKTIQTIGFLSHLKAKGLDGPYMIIAPLSTLSNWMNEISRFAPSLPAIIYHGDKKQRDEIRRKHMPRAIGPKFPIVITSYEIALNDARKYFRPYNWKYLVVDEGHRLKNSQCKLVKELKYINVENKILLTGTPLQNNLAELWSLLNFILPDIFASLEEFESWFNLSGKCNNGTTKEELEDKRRAQVVAKLHAILRPFLLRRMKSDVEIMLPRKKEIIIYANMTEHQKNLQDHLINKTLENYLQEKSLNGHAVRKIHNLVIQLRKVCNHPDLIASPFDGSCLYPPVNEIVEQCGKFNLLDRLLQLLFARNHKVLIFSQWSKVLDIMDYYFSEKGYEVCRIDGSVKLDERKRQIQEFNDANSNCRIFLLSTRAGGLGINLTAADTCILYDSDWNPQMDLQAMDRCHRIGQTKPVHVYRLSTAQSVEGRMLKRAFSKLKLEHLVIEKGQFHHERSKPVSTDEMEEEDVLALLREDETAEDKMIQTDISDEDLEKLLDRSDLVINNSNDDNCKAPSSSFPLKGRGWEVVIPTATGGMLSTLNS

SEQ ID NO: 19969 - protein, 763 aa, Glycine max
MEAKNKVKIDDSTAESPTSVLEDEAVCAPKEEVKLEEEVTADIKDDGTSLISKTMVEEEENLIEARMKEEEVQCEEVPDLNDTQFNKLDELLTQTKLYSEFLLEKMDDITLAVGEQENREEQESNPSAKKKGCGSKRKAASQYNTRKAKKAVTAMLTRSEESEKTEDTNMTEEERVEKEQKELMPLLTGGKLKTYQLKGVKWLISLWQNGLNGILADQMGLGKTIQTIGFLSHLKAKGLDGPYMIIAPLSTLSNWVNEISRFAPSLPAVIYHGDKKQRDEIRRKHMPTRTIGPEFPIVITSYEIALNDAKKYFRSYNWKYIVVDEGHRLKNSQCKLVKALKFINVENKLLLTGTPLQNNLAELWSLLNFILPDIFASLEEFESWFNLSGKCNNEATKEELEEKRRSQVVAKLHAILRPFLLRRMKSDVEIMLPRKKEIIIYANMTEHQKNLQDHLVNKTLGNYLKENMSSGLSVPAIMIRNLAIQLRKVCNHPDLLESAFDDSYLYPPLEEIVGQCGKFHLLDRLLQRLFSRNHKVLIFSQWTKVLDIMDYYFSEKGFAVCRIDGSVKLEERKQQIQDFNDVNSNCRVFLLSTRAGGLGINLTVADTCILYDSDWNPQMDLQAMDRCHRIGQTKPVHVYRLSTAQSIEGRMLKRAFSKLKLEHVVIEKGQFHQERTKPASMDEIEEDDVLALLRDEETAEDKKIHTDISDEDLEKLLDRSDLIVNDSNDDNFKAPVSAFPLKGPGWEVVIPTATGGMLSTLNC

SEQ ID NO: 19970 - protein, 591 aa, Cicer arietinum
MISALDLYHVLTAVVPLYVAMILAYGSVKWWKIFTPDQCSGINRFVALFAVPLLSFHFISTNNPYAMNYRFIAADSLQKAIVLAILFIWSRTSSRGSLEWSITLFSLSTLPNTLVMGIPLLKGMYGDNSGTLMVQIVVLQCIIWYTLMLFLFEYRGARILIVEQFPDTAGSIISFKVDSDILSLDGKEPLQTEAEVGEDGKLHVKVRKSTSSRSEIFSRRSHGPNSGVSLTPRPSNLTNAEIYSLQSSRNPTPRGSSFNHTDFYSMVNGRNVSPRGSNFGNLGFDEENAVGKVNGVVNAGNGYPAPHSAGIFSPVAKKKGNGGGGDGGKDLHMFVWSSSASPVSEGGIHVFRGGGDYGNDQLNGVAHQKDYDEFGHDEFSFGNRTVANGVDKEGPVLSKLGSSSTTELHPKAGPQGEAKPTNMPPASVMTRLILIMVWRKLIRNPNTYSSLIGLTWSLISFKWNVVMPAIVAKSISILSDAGLGMAMFSLGLFMALQPKIIACGNSVASFAMAVRFLTGPAVMAVSSIAVGLRGVLLHIAIVQAALPQGIVPFVFAKEYNVHPDILSTGVIFGMLIALPITLVYYILLGLF

SEQ ID NO: 19971 - protein, 589 aa, Trifolium pratense
MISALDLYHVLTAVVPLYVAMILAYGSVKWWKIFTPDQCSGINRFVALFAVPLLSFHFISTNNPYTMNYKFIAADSLQKSIILIILFIWSRTSSRGSLEWSITLFSLSTLPNTLVMGIPLLKGMYGDDSGTLMVQIVVLQCIIWYTLMLFLFEYRGARILIGEQFPDTAGSIISFKVDSDVLSLDGKEPLQTEAEVGEDGKLHVKVRKSTSSRSEIFSRPSHGGVSLTPRPSNLTNAEIYSLQSSRNPTPRGSSFNHSDFYSMVNGRNVSPRQSNFGSLGFDEESGVGKVNGGANSGNGGNGYPTPHSAGIFSPVANKKKGHGGGDGKDLHMFVWSSSASPVSEGGIHVFRGGGDYGNDQLNGAAHQKDYEEFGHDEFSFGNRTVANGVDKEGPVLSKLGSSSTTELHPKAGSQSDSKPTNMPPASVMTRLILIMVWRKLIRNPNTYSSLIGLIWSLISFRWNIVMPAIIAKSIAILSDAGLGMAMFSLGLFMALQPRIIACGNTVASFAMAVRFLTGPAVMAVSSIVVGLRGVLLHIAIVQAALPQGIVPFVFAKEYNVHPDILSTGVIFGMLIALPITLVYYILLGL

SEQ ID NO: 19972 - protein, 589 aa, Trifolium pratense
MISALDLYHVLTAVVPLYVAMILAYGSVKWWKIFTPDQCSGINRFVALFAVPLLSFHFISTNNPYTMNYKFIAADSLQKSIILILLFIWSRASSRGSLEWSITLFSLSTLPNTLVMGIPLLKGMYGDDSGTLMVQIVVLQCIIWYTLMLFLFEYRGARILIGEQFPDTAGSIISFKVDSDVLSLDGKEPLQTEAEVGEDGKLHVKVRKSTSSRSEIFSRPSHGGVSLTPRPSNLTNAEIYSLQSSRNPTPRGSSFNHSDFYSMVNGRNVSPRQSNFGSLGFDEESGVGKVNGGANSGNGGNGYPTPHNAGIFSPVANKKKGHGGGDGKDLHMFVWSSSASPVSEGGIHVFRGGGDYGNDQLNGVAHQKDYEEFGHDEFSFGNRTVANGVEKEGPVLSKLGSSSTTELHPKASSQGESKPTNMPPASVMTRLILIMVWRKLIRNPNTYSSLIGLIWSLVCFRWNVVMPAIVAKSIAILSDAGLGMAMFSLGLFMALQPRIIACGNTVASFAMAVRFLVGPVVMAASSLIVGLRGVLLHIAIVQAALPQGIVPFVFAKEYSVHPDILSTGVIFGMLIALPITLVYYILLGL

SEQ ID NO: 19973 - protein, 592 aa, Lotus japonicus
MISASDLYHVLTAVVPLYVAMILAYGSVKWWKIFSPDQCSGINRFVALFAVPLLSFHFISTNNPYAMNYRFIAADSLQKTIVLAVLLIWSRTSSRGSLEWSITLFSLSTLPNTLVMGIPLLKGMYGDASGTLMVQIVVLQCIIWYTLMLFLFEYRGARLLIVEQFPDTAGSIISFKVDSDILSLDGKEPLQTEAEVGEDGKLHVTVRKSTSSRSEIFSRRSHGPNSGVSLTPRPSNLTNAEIYSLQSSRNPTPRGSSFNHTDFYSMVNGRNVSPRQSNFGGTLGFDEESGMGKANGGGGGGGYPAPHNAGIFSPVTGKKKANGGGADGGGGKDLHMFVWSSSASPVSEGGIHVFRGADYGNDQLGGVASHQKDYDEFGHDEFSFGNRTVANGVDKEGPVLSKLGSSSTTELHPKAQGESKTATNMPPASVMTRLILIMVWRKLIRNPNTYSSLIGLTWSLVSFKWNVVMPAIVAKSISILSDAGLGMAMFSLGLFMALQPKIIACGNSVAAFTMAVRFLTGPAVMAVASIVVGLRGVLLHIAIVQAALPQGIVPFVFAKEYNVHPDILSTGVIFGMLIALPITLVYYILLGL

SEQ ID NO: 19974 - protein, 585 aa, Phaseolus vulgaris
MITLLDLYHVLTAVVPLYVAMILAYGSVKWWKIFTPDQCSGINRFVALFAVPLLSFHFISTNNPYAMNYKFIAADSLQKTIVLAVLFVWSRTSSRGSLEWSITLFSLSTLPNTLVMGIPLLKGMYGDASGTLMVQIVVLQCIIWYTLMLFLFEYRGAKLLIVEQFPDTAGSIISFKVDSDILSLDGKEPLQTEAEVGDDGKLHVTVRKSTSSRSEIFSRRSHGPNSVSLTPRPSNLTNAEIYSLQSSRNPTPRGSSFNHTDFYSMVNNGRNVSPRQSSFGGVAFDEESGVRVNGGAGGYPAPHNAGIFSPVGKKKGGGGGEGGGKDLHMFVWSSSASPVSEGGIHVFRGGDYGNDQLPVGGVAHPKDYDDFGHDEFSFGNGTVPNGVEKEGPVLSKLGSSSTAELHPKAQVESKATSMPPTSVMTRLILIMVWRKLIRNPNTYSSLFGLTWSLISFKWNVVMPAIVARSISILSDAGLGMAMFSLGLFMALQPKIIACGNSVASFAMAVRFLTGPAVMAVASIVVGLRGVLLHIAIVQAALPQGIVPFVFAKEYNVHPDILSTGVIFGMLIALPITLVYYILLGL

SEQ ID NO: 19975 - protein, 593 aa, Arachis hypogaea
MISLSDLYHVLTAVVPLYVAMILAYGSVKWWKIFSPDQCSGINRFVALFAVPLLSFHFISTNNPYAMNYKFIAADSLQKAIVLVVLAIWSRISSRGSLEWSITLFSLSTLPNTLVMGIPLLKGMYGDSSGSLMVQIVVLQCIIWYTLMLFLFEYRGARLLIVEQFPDTAASIISFKVDSDIISLDGKEPLHTEAEVGEDGKLHVTVRKSTSSRSDIFSRRSHGAVSMTPRASNLTNAEIYSLQSSRNPTPRGSSFNHTDFYSMVNNGRNVSPRQSNFGNLGFDEENGRAVYSSHAGGGGGVYPGPTSAGIFSPVTGPGAKKKGGGGAADGGGKDLHMFVWSSSASPVSEGGIHVFRGGDYGNDHLGGVAHQKDYEEFGHDEFSFGNRTVANGVDKEGPVLSKLGSSSTAELHPKNGAQGESKPANMPPTSVMTRLILIMVWRKLIRNPNTYSSLIGLTWSLISFKWNVVMPAIVAKSISILSDAGLGMAMFSLGLFMALQPKIIACGNTVASFAMAVRFLTGPAVMAVASIVVGLRGVLLHVAIVQAALPQGIVPFVFAKEYNVHPDILSTGVIFGMLIALPITLVYYILLGL

SEQ ID NO: 19976 - protein, 587 aa, Lupinus angustifolius
MISLLDLYHVLTAVVPLYVAMILAYGSVKWWKIFSPDQCSGINRFVALFAVPLLSFHFISTNNPYKMNYRFIAADSLQKTIVLTVLAIWSRFSSRGSLEWSITLFSLSTLPNTLVMGIPLLKGMYGDSSGTLMIQIVVLQCIIWYTLMLFLFEYRGARILIVEQFPDTAGSIISFKVDSDILSLDGKEPLQTEAEVGEDGKLHVTVRKSTSSRSEIFSRKSHGPNSGVSLTQRPSNLTNAEIYSLQSSRNPTPRGSSFNHSDFYSMVNGRNMTSGVSPRQSNFGNLGYDEESGGNVSRTNGYPAPPNNGIFSPVTGSKKKGNGGEGGKDLHMFVWSSSASPVSEGGIHVFRGGDYGNELGGVATNHKDYDEFGHDEFSFGNRTVANGLDKEGPVLSKLGSSSTTELNPKCVQGESKPTSMPPTSVMTRLILIMVWRKLIRNPNTFSSIIGLTWSLISFKWNVVMPAIVAGSISILSNAGLGMAMFSLGLFMALQPRIIACGNSVASFAMAVRFLTGPAVMAVASIVVGLRGVLLHIAIVQAALPQGIVPFVFAKEYKVHPDILSTGVIFGMLIALPITLVYYILLGL

SEQ ID NO: 19977 - protein, 593 aa, Glycine max
MITLLDLYHVLTAVVPLYVAMILAYGSVKWWKIFTPDQCSGINRFVALFAVPLLSFHFISTNNPYAMNYKFIAADTLQKAIVLAVLLVWSRTSSRGSLEWSITLFSLSTLPNTLVMGIPLLKGMYGDDSGTLMVQIVVLQCIIWYTLMLFLFEYRGARLLIVEQFPDTAGSIISFKVDSDIISLDGKEPLQTEAEVGDDGKLHVTVRKSASSRSEIFSRRSHGGLNSVSLTPRPSNLTNAEIYSLQSSRNPTPRGSSFNHTDFYSIVNGGGGRNNNVSVSPRQSNFGGFDEESGGGMRVNGGYPGPANAGIFSPVAKKKGGESGGGGGGGGKDLHMFVWSSSASPVSEGGIHAFRGGGDYGSDQLPVCGVAHQKDYDEFGHDEFSFGNRTIANGVDKEGPVLSKLGSSSTAELHPKAQGESKPTSMPPTSVMTRLILIMVWRKLIRNPNTYSSLFGLTWSLISFKWNVVMPAIVAKSISILSDAGLGMAMFSLGLFMALQPKIIACGNSVASFAMAVRFLTGPAVMAVASIVVGLRGVLLHIAIVQAALPQGIVPFVFAKEYNVHPDILSTGVIFGMLIALPITLVYYILLGL

SEQ ID NO: 19978 - protein, 597 aa, Glycine max
MITLWDLYHVLTAVVPLYVAMILAYGSVKWWKIFTPDQCSGINRFVALFAVPLLSFHFISTNNPYAMNYKFIAADSLQKAIVLAVLLVWSRTSSRGSLEWSITLFSLSTLPNTLVMGIPLLKGMYGDASGTLMVQIVVLQCIIWYTLMLFLFEYRGARLLIVEQFPDTAASIISFKVDSDIISLDGKEPLQTEAEVGDDGKLHVTVRKSASSRSEIFSRRSHGPNSVSLTPRPSNLTNAEIYSLQSSRNPTPRGSSFNHTDFYSMVNGKNNNNNNNNVSMSPRQSNFGGFDEESGGGVRVNGGAGVGGYPGPANAGIFSPVAAKKKGGESGGGGKDLHMFVWSSSASPVSEGGIHVFRGGGGDYGSDQLPVGGVAHQKDYDEFGHDEFSFGNRTVANGVDKEGPVLSKLGSSSTAELRPKAQGEAKPTSMPPTSVMTRLILIMVWRKLIRNPNTYSSLFGLTWSLISFKWNVVMPAIVAKSISILSDAGLGMAMFSLGLFMALQPKIIACGNSVASFAMAVRFLTGPAVMAVASIVVGLRGVLLHIAIVQAALPQGIVPFVFAKEYNVHPDILSTGVIFGMLIALPITLVYYILLGL

SEQ ID NO: 19979 - protein, 593 aa, Cajanus cajan
MITALDLYHVLTAVVPLYVAMILAYGSVKWWKIFTPDQCSGINRFVALFAVPLLSFHFIAANNPYAMNYKFIAADSLQKAIVLGVLFLWSRTSSRGSLEWSITLFSLSTLPNTLVMGIPLLKGMYGDASGTLMVQIVVLQCIIWYTLMLFLFEYRGARLLIVEQFPDTAGSIISFKVDSDVISLDGKEPLQTEAEVGDDGKLHVTVRKSTSSRSDIFSRRSHGPNSLSLTPRPSNLTNAEIYSLQSSRNPTPRGSSFNHTDFYSMVNGGRNVSPRQSNYGFDEESGGRGNGYPAPANAGIFSPVAKKKGDPAAAAAAAAAAAAGGGGGGGGGKDLHMFVWSSSASPVSEGGIHVFRGGDFGNDQLPATGVPHHKDYDEFGHDEFSFGNRTVANGVDKEGPVLSKIGSSSTAELHPKAQGESKPTSMPPTSVMTRLILIMVWRKLIRNPNTYSSLFGLAWSLISFKWNVAMPAIVAQSIAILSNAGLGMAMFSLGLFMALQPKIIACGNSVASFAMAVRFLTGPAVMAVASIVVGLRGVLLHIAIVQAALPQGIVPFVFAKEYNVHPDILSTGVIFGMLIALPITLVYYILLGL

SEQ ID NO: 19980 - protein, 593 aa, Manihot esculenta
MISITDLYHVLTAVVPLYVAMILAYGSVKWWKIFSPDQCSGINRFVALFAVPLLSFHFISTNNPYAMNYRFIAADTLQKIIVLVVLAIWSRLSSRGSLEWSITLFSLSTLPNTLVMGIPLLKGMYGDSSGTLMVQIVVLQCIIWYTLMLFLFEYRGARILIGEQFPDTAGSIISFRVDSDIISLDGREPLQTEAELGEDGKLHVTVRKSTSSRSEIFSRRSHGPNSGLSLTPRPSNLTNAEIYSLQSSRNPTPRGSSFNHTDFYSMVNGKNASNVSPRQSNFGNLPFDEENGGIGVYGNVSRANGNAYPAPPNAGIFSPGTKKKANGADNGRDLHMFVWSSSASPVSEGGIHVFRGGATDYANELGGATHQKDYDEFGRDEFSFGNRQVANGVDREGPVLSKLGSSSTAELHPKAGADGEPKPTAMPPASVMTRLILIMVWRKLIRNPNTYSSLIGLTWSLVSFKWNVEMPAIIARSISILSDAGLGMAMFSLGLFMALQPKIIACGNSVASFAMAVRFLTGPAVMAAASIAVGLRGVLLHIAIVQAALPQGIVPFVFAKEYNVHPDILSTGVIFGMLIALPITLVYYILLGL

SEQ ID NO: 19981 - protein, 591 aa, Ricinus communis
MISATDLYHVLTAVVPLYVAMILAYGSVKWWKIFSPDQCSGINRFVALFAVPLLSFHFISTNNPYAMNYRFIAADTLQKVIVLFVLAIWSRTSSRGSLEWSITLFSLSTLPNTLVMGIPLLKGMYGDDSGSLMVQIVVLQCIIWYTLMLFLFEYRGARLLIGEQFPDTAGSIISFRVDSDIISLDGREPLQTEAEVGEDGKLHVTVRKSTSSRSEIFSRRSHGPNSGLSLTPRPSNLTNVEIYSLQSSRNPTPRGSSFNHTDFYSMVNGKNASNVSPRQSNFGNLPFDEENGGIGVFGNVSRTNGSAYPAPPNAGIFSPGAKKKANGAENGKDLHMFVWSSSASPVSEGGIHVFRGGDHGIDLGGVAHQKDYDEFGRDEFSFGNRPVPNGVDREGPVLSKLGSSSTAELHPKTGVDGEPRATAMPPASVMTRLILIMVWRKLIRNPNTYSSLIGLTWSLVSFKLHIEMPAIIAGSIAILSNAGLGMAMFSLGLFMALQPRIIACGNSIATFAMAVRFLTGPAVMAAASFAVGLRGVLLHIAIVQAALPQGIVPFVFAKEYNVHPDILSTGVIFGMLIALPITLVYYILLGL

SEQ ID NO: 19982 - protein, 596 aa, Prunus mume
MISFTDLYHVLTAVVPLYVAMILAYGSVKWWKIFSPDQCSGINRFVALFAVPLLSFHFISTNNPYAMNYRFIAADTLQKVIVLVALAVWSRTSSRGSLEWSITLFSLSTLPNTLVMGIPLLKGMYGDASGSLMVQIVVLQCIIWYTLMLFLFEYRGARLLIGEQFPDTAGSIISFRVDSDIISLDGKEPLQTEAEVGEDGKLHVTVRKSTSSRSEIYSRRSHGPNSGVSLTPRPSNLTNAEIYSLQSSRNPTPRGSSFNHTDFYSMVNGKNMSNASPRQSNYGNVGFDEEAGGVGMRGANGVYPPGNSGYPAPPTAGIFSPVTGPNAKKKPNGADGGKDLHMFVWSSSASPVSEGGIHVFRGGEYGNDIGGVAHQKDYDEFGRDEFSFDNRPNSNGVDREGPVLSKLGSSSTTELHPKTAHGEPKATAMPPASVMTRLILIMVWRKLIRNPNTYSSLIGLTWSLVSYKWHVVMPAIVARSIAILSDAGLGMAMFSLGLFMALQPKMIACGNSVASFAMAVRFLSGPAVMAAASIAVGLRGVLLHIAIVQAALPQGIVPFVFAKEYNVHPDILSTGVIFGMLIALPITLVYYILLGL

SEQ ID NO: 19983 - protein, 597 aa, Prunus persica
MISFTDLYHVLTAVVPLYVAMILAYGSVKWWKIFSPDQCSGINRFVALFAVPLLSFHFISTNNPYAMNYRFIAADTLQKVIVLVALAVWSRTSSRGSLEWSITLFSLSTLPNTLVMGIPLLKGMYGDASGSLMVQIVVLQCIIWYTLMLFLFEYRGARLLIGEQFPDTAGSIISFRVDSDIISLDGKEPLQTEAEVGEDGKLHVTVRKSTSSRSEIYSRRSHGPNSGVSLTPRPSNLTNAEIYSLQSSRNPTPRGSSFNHTDFYSMVNGKNMSNASPRQSNYGNVGFDEEAGGVGMRGGTNGVYPPGNSGYPAPPTAGIFSPVTGPNAKKKPNGADGGKDLHMFVWSSSASPVSEGGIHVFRGGEYGNDIGGVAHQKDYDEFGRDEFSFDNRPNSNGVDREGPVLSKLGSSSTTELHPKTAHGEPKATAMPPASVMTRLILIMVWRKLIRNPNTYSSLIGLTWSLVSYKWHVVMPAIVARSIAILSDAGLGMAMFSLGLFMALQPKMIACGNSVASFAMAVRFLSGPAVMAAASIAVGLRGVLLHIAIVQAALPQGIVPFVFAKEYNVHPDILSTGVIFGMLIALPITLVYYILLGL

SEQ ID NO: 19984 - protein, 585 aa, Gossypium hirsutum
MISATDLYHVLTAVVPLYVAMILAYGSVKWWKIFTPDQCSGINRFVALFAVPLLSFHFISTNNPYTMNLRFIAADTLQKLIVLVLLAIWSRTSSRGSLEWSITLFSLSTLPNTLVMGIPLLKGMYGDYSGSLMVQIVVLQCIIWYTLMLFLFEYRGAKLLIAEQFPDTAGSIISFKVDSDVLSLDGKEPLQTDAEVGDDGKLHVTVRKSTSSRSEIFSRRSHGLNSGMGLTPRPSNLTNAEIYSLQSSRNPTPRGSSFNHTDFYSMVNGGKNNVSPRQSNYGTGFDEENGVGVFGNNGIRSNGGSYPAPTSAGIFSPVTAPKKANGGGDGGGKDLHMFVWSSSASPVSEGGIHVFKGGDYGNDHHHKDYDEYGRDEFTFGNKAATNGGVDREGPVLSKLGSSSTTELNPKIETKPTAMPPASVMTRLILIMVWRKLIRNPNTYSSLIGLTWSLVSFKWNIQMPAIVAGSISILSNAGLGMAMFSLGLFMALQPRIIACGNTIATFAMAVRFLTGPAVMAAASIAVGLRGVLLRIAIVQAALPQGIVPFVFAKEYNVHPDILSTGVIFGMLIALPITLVYYILLGL

SEQ ID NO: 19985 - protein, 594 aa, Quercus alba
MITLTDLYHVLTAVVPLYVAMILAYGSVKWWKIFSPDQCSGINRFVALFAVPLLSFHFISTNNPYAMNFKLLAADTLQKVIVLVVLAIWSRASSRGSLEWSITLFSLSSLPNTLVMGIPLLKGMYGDASGTLMVQIVVLQCIIWYTLMLFLFEYRGARLLIVEQFPDTAGSIISFRVDSDIISLDGKEPLETQAEVGEDGKLHVTVRKSASSRSEIFSRRSHGPNSGLSLTPRPSNLTNAEIYSLQSSRNPTPRGSSFNHTDFYSMVNGKNASNVSPRQSNFGNLGFDEESGVNVFGNAGRANGAYPAPPSAGIFSPGTTKKKANGVGGGEGGKDLHMFVWSSSASPVSEGGIHVFRGGEYGNELGAGVGHQKDYDEFGRDEFSFGNRPVTNGVDREGPVLSKLGSSSTTELHPKTGAHVESKLTNMPPASVMTRLILIMVWRKLIRNPNTYSSLIGLTWSLVSFRWKIEMPAIVAGSIGILSSAGLGMAMFSLGLFMALQPKIIACGNSIAAFAMAVRFITGPAVMAAASYAIGLRGVLLHIAIVQAALPQGIVPFVFAKEYNVHPDILSTGVIFGMLIALPITLVYYILLGL

SEQ ID NO: 19986 - protein, 585 aa, Gossypium raimondii
MISATDLYHVLTAVVPLYVAMILAYGSVKWWKIFTPDQCSGINRFVALFAVPLLSFHFISTNNPYTMNLKFIAADTLQKLIVLVLLAIWSRTSSRGSLEWSITLFSLSTLPNTLVMGIPLLKGMYGDYSGSLMVQIVVLQCIIWYTLMLFLFEYRGAKLLIAEQFPDTAGSIISFKVDSDVLSLDGKEPLQTDAEVGDDGKLHVTVRKSTSSRSEIFSRRSHGLNSGMGLTPRPSNLTNAEIYSLQSSRNPTPRGSSFNHTDFYSMVNGGKNNVSPRQSNYGTGFDEENGVGVFGNNGIRSNGGSYPAPTSAGIFSPVTAPKKANGGGDGGGKDLHMFVWSSSASPVSEGGIHVFKGGDYGNDHHHKDYDEYGRDEFTFGNKAATNGGVDREGPVLSKLGSSSTTELNPKIETKPTAMPPASVMTRLILIMVWRKLIRNPNTYSSLIGLTWSLVSFKWNIQMPAIVAGSISILSNAGLGMAMFSLGLFMALQPRIIACGNTIATFAMAVRFLTGPAVMAAASIAVGLRGVLLRIAIVQAALPQGIVPFVFAKEYNVHPDILSTGVIFGMLIALPITLVYYILLGL

SEQ ID NO: 19987 - protein, 597 aa, Vitis vinifera
MISITDLYHVLTAVVPLYVAMILAYGSVKWWKIFSPDQCSGINRFVALFAVPLLSFHFISSNNPYAMNYRFIAADTLQKIIVLVVLAIWSRTSSRGCLEWSITLFSLSTLPNTLVMGIPLLKGMYGEASGTLMVQIVVLQCIIWYTLMLFLFEYRGARLLIVEQFPDTAGSIISFRVDSDIISLDGKEPLQTEAEVGEDGKLHVTVRKSTSSRSEIFSRRSHGPNSGVSLTPRPSNLTNAEIYSLQSSRNPTPRGSSFNHTDFYSMVNGKNMNNVSPRQSNFGNLTFDEENGIGGFPNPPRANGVYSQGGGYPAPPSAGIFSPVAGPGAKKKANGADGGKDLHMFVWSSSASPVSEGGIHVFRGGDYGNELGGVPHTKDYDEFGQDEFSFGNRASVNGGDREGPTMSKLGSSSTTELHPKTAPQSKPTSMPPASVMTRLILIMVWRKLIRNPNTYSSLIGLTWSLVSYKWEIEMPAIIAKSISILSDAGLGMAMFSLGLFMALQPKIIACGNSVATFAMAVRFLTGPAVMAAASIAVGLRGVLLHIAIVQAALPQGIVPFVFAKEYNVHPDILSTGVIFGMLIALPITLVYYILLGL

SEQ ID NO: 19988 - protein, 595 aa, Lactuca sativa
MITGSDLYHVLTAVVPLYVAMILAYGSVKWWKIFTPDQCSGINRFVALFAVPLLSFHFISTNNPYTMNTRFIAADTLQKLIVLVVLAIWSRVSARGSLEWSITLFSLSTLPNTLVMGIPLLKGMYGDFSGSLMVQIVVLQCIIWYTLMLFLFEYRGARLLIAEQFPDTAGSIISFRVDSDILSLDGKEPLQTEAEVGDDGKLHVTVRKSTSSRSEIFSRRSHGGMNSGVSLTPRPSNLTNAEIYSLQSSRNPTPRGSSFNHTDFYSMVNGKNASGVSPRGSNFGNVGYDEESGNNTVRVNGQGSTGYPAPTNAGIFSPVSGPAGKKKGGGGDGGGKDLHMFVWSSSASPVSEGGIHVFRGGEYGNDLGGVPHTKDYDDFGRNEFSFGNQPGPNGVDREASVLSKLGSSSTAELHPKSSPHGEPKASAMPPASVMTRLILIMVWRKLIRNPNTYSSLIGLTWSLVSFKWHVQMPAIVAKSIAILSDAGLGMAMFSLGLFMALQPKIIACGNSVATFAMAVRFLTGPAVMAAASIAVGLQGTLLHVAIVQAALPQGIVPFVFAKEYNVHPDILSTGVIFGMLIALPITLVYYIVLGL

SEQ ID NO: 19989 - protein, 599 aa, Vitis vinifera
MIAITDLYHVLTSVVPLYVAMILAYGSVKWWKIFSPDQCSGINRFVALFAVPLLSFHFISTNDPYAMNYRFIAADTLQKIIVLVVLAIWSRVSSRGCLEWSITLFSLSTLPNTLVMGIPLLKGMYGEYSGTLMVQIVVLQCIIWYTLMLFLFEYRGARLLIVEQFPDTAGSIISFRVDSDVISLDGKEPLQTEAEVGEDGKLHVTVRKSTSSRSEIFSRRSHGPNSGVSLTPRPSNLTNAEIYSLQSSRNPTPRGSSFNHTDFYSMVNGKNMSNVSPRQSNFGNLTFDEENGIGGFPNPPRANGVYSQGGGYPAPPSAGIFSPVGGPGAKKKANGADGGKDLHMFVWSSSASPVSEGGIHVFRGGDYGNEVAGGVLPQTKDYDESRQDEFSFGNRPVANGGDREGAMMSKLGSSSTAELNPKAAAQSKPTSMPPASVMTRLILIMVWRKLIRNPNTYSSLIGLTWSLVSFKWGIEMPAIIAKSISILSDAGLGMAMFSLGLFMALQPRIIACGNSIATFAMAVRFLTGPAVMAAASIAVGLRGVLLHIAIVQAALPQGIVPFVFAKEYNVHPDILSTGVIFGMLIALPITLVYYILLGL

SEQ ID NO: 19990 - protein, 598 aa, Malus domestica
MISFTDLYHVLTAVVPLYVAMILAYGSVKWWKIFSPDQCSGINRFVALFAVPLLSFHFISTNNPYAMNYRFIAADTLQKIIVLAVLAVWSRTSARGSLEWSITLFSLSTLPNTLVMGIPLLKGMYGDASGSLMVQIVVLQCIIWYTLMLFLFEYRGARLLIGEQFPDTAGSIISFRVDSDIISLDGKEPLQTEAEVGEDGKLHVTVRKSTSTRSEIHSRRSHGPNSGVSLTPRPSNLTNAEIYSLQSSRNPTPRGSSFNHTDFYSMVNGKNMSNASPRQSHYGNVGSDEEAGGVGGARGRANGGNSGYPAPPSAGIFSPVTGPAAGAKKKPIGADGGKDLHMFVWSSNNSPASEGGIHVFRGGEYGNELAGVAPHYKDYDEFGRNEFSFDNRPASNEADREGPVLSKLGSSSTTELHPKTANGGESKTAAMPPASVMTRLILIMVWRKLIRNPNTYSSLIGLTWSLVSYKWHIVMPAIVARSIAILSDAGLGMAMFSLGLFMALQPRMIACGNTIASFAMAVRFLTGPAVMAAASIAVGLRGVLLHIAIVQAALPQGIVPFVFAKEYNVHPNILSTGVIFGMLIALPITLVYYILLGL

SEQ ID NO: 19991 - protein, 588 aa, Populus trichocarpa
MISIGDLYHVLTAVVPLYVAMILAYGSVKWWKIFSPDQCSGINRFVALFAVPLLSFHFISTNNPYAMNLRFIAADTLQKIIVLVVLAIWSRASSRGSLEWSITLFSLSSLPNTLVMGIPLLKGMYGHSSGSLMVQIVVLQCIIWYTLMLFLFEYRGARILIGEQFPDTAGSIISFRVDSDILSLDGREPLQTEAEVGEDGKLHVTVRKSTSSRSEVFSHMSHGLNSGLSLTPRPSNLTNAEIYSLQSSRNPTPRASSFNHTDFYSMVNGKNASPRHSNFTNLQFDEESGGLGVFGNVPRANGSAYPAPPNAGIFSPGGKKKANGAENGKDLHMFVWSSSASPVSEGGLHVFKGGDYGNDLGGVAHHKDYDEFGRDEFSFGNRPGPNGVDRDGPVLSKLGSGSTAELHPKSAANGEAKPTVMPPTSVMTRLILIMVWRKLIRNPNTYSSLIGLTWSLVSFKWNIMMPAIIADSIAILSNAGLGMAMFSLGLFMALQPRIIACGNSIASFAMGVRFLTGPAVMAAASFAVGLRGDLLRIAIVQAALPQGIVPFVFAKEYNVHPDILSTGVIFGMLIALPITLVYYILLGL

SEQ ID NO: 19992 - protein, 585 aa, Echinacea purpurea
MITSSDLYHVLTAVVPLYVAMILAYGSVKWWKIFTPDQCSGINRFVALFAVPLLSFHFISTNNPYTMNSRFIAADTLQKLMVLVGLAFWSRLSARGSLEWSITLFSLSTLPNTLVMGIPLLKGMYGDFSGSLMVQIVVLQCIIWYTLMLFLFEYRGARLLIAEQFPDTAGSIISFRVDSDVLSLDGKEPLQTEAEVGEDGKLHVTVRKSASSHSEIFSRRSHGGMNSGLSLTPRPSNLTNAEIYSLQSSRNPTPRGSSFNHTDFYSMVNGKSGASPRGSNFAGYDEESGNAGRVNGHGSAGYPAPANAGIFSPVGGKRGGGGGKDLHMFVWSSSASPVSEGGIHVFRGGTGEYGNDLGGVPQTKEYDEFGRNEFSFGNQPGPNGVEREASVLSKLGSSSTAELHPKASPHAEIKPTSMPPASVMTRLILIMVWRKLIRNPNTYSSLIGLTWSLVSFKWNVEMPAIVAKSIAILSDAGLGMAMFSLGLFMALQPKIIACGNSVATFAMVVRFLIGPAVMVGASLAVGLHGTLLHVAIVQAALPQGIVPFVFAKEYNVHPDILSTGVIFGMLIALPITLVYYIVLGL

SEQ ID NO: 19993 - protein, 595 aa, Rosmarinus officinalis
MITITDLYHVLTAVVPLYVAMILAYGSVKWWKIFTPDQCSGINRFVALFAVPLLSFHFISTNDPYAMNYRFIAADTLQKLIVLAVLAVWSRISSRGSLEWSITLFSLSTLPNTLVMGIPLLKGMYGNDSGSLMVQIVVLQCIIWYTLMLFLFEYRGARMLIAEQFPDTAGSIISFRVDTDIISLDGKEPLQTEAEVGQDGKLHVTVRKSTSSRSEIFSRRSHGPNSGLSLTPRPSNLTNAEIYSLQSSRNPTPRGSSFNHTDFYSMVNGKNVSPRHSNYGNSGFDEENQYRANGVHGQGNNAGYPAPAGAGIFSPVSGPAAKKKANGAEVGSGGGGKDLHMFVWSSSASPVSEGGIHVFKGGEYGGTELNIGAHPKDYEDFGRDGFSFGNKQGPNGAERDGPVLSKLGSSSTAELNPKAPVDTKATAMPPTSVMTRLILIMVWRKLIRNPNTYSSLIGLTWSLVSFKWHVEMPAIVAKSIAILSDAGLGMAMFSLGLFMALQPRIIACGKSVAAFSMAVRFLTGPAVMAAASIAVGLRGVLLHIAIVQASLPQGIVPFVFAKEYNVHPDILSTGVIFGMLIALPITLVYYILLGL

SEQ ID NO: 19994 - protein, 588 aa, Citrus sinensis
MISATDLYHVLTAVVPLYVAMILAYGSVKWWKIFTPDQCSGINRFVALFAVPLLSFHFISTNDPYSMNFKFILADTVQKIIVLLLLAIWSKLSSSGSLEWSITLFSLSTLPNTLVMGIPLLKGMYGDYSGSLMVQIVVLQCIIWYTLMLFLFEYRGARMLIAEQFPDTAGSIISFKVDSDIISLDGKEPLQTEAEVGEDGKLHVTVRKSASSRSEIFSRRSHGPNSGVSLTPRPSNLTNCEIYSLQSSRNHTPRGSSFNHTDVFSMVNGKNMSNVSPRQSNFGNLGFDEENGVGVFGNVNRANGGPYPVPTTAGIFSPVSGAMRKANGAENGKDLHMFVWSSSASPVSEGGLHVFRGGDDLGGVHQKDYGEFGRDEFSFGNRPVTNGVENEGPVLSKLGSSSTTELNPKSVAQGEPKPTAMPPTSVMTRLILIMVWRKLIRNPNTYSSLIGLTWSLVSFRWHVEMPAIIARSIAILSDAGLGMAMFSLGLFMALQPRIIACGNTIATFAMGVRFLVGPAVMAAASMAVGLRGSLLHVAIVQAALPQGIVPFVFAKEYNVHPDILSTAVIFGMLVALPITLVYYILLGL

SEQ ID NO: 19995 - protein, 590 aa, Rosmarinus officinalis
MITITDLYHVLTSVVPLYVAMILAYGSVKWWKIFTPDQCSGINRFVALFAVPLLSFHFISTNDPYAMNYRFIAADTLQKLIVLAVLAVWSRISSRGSLEWSITLFSLSTLPNTLVMGIPLLKGMYGNDSGSLMVQIVVLQCIIWFTLMLFLFEYRGARMLIAEQFPDTAGSIISFRVDTDIISLDGKEPLQTEAEVGQDGKLHVTVRKSTSSRSEIFSRRSHGPNSGLSLTPRPSNLTNAEIYSLQSSRNPTPRGSSFNHTDFYSMVNGKNVSPRHSNFGNSGFDEESGYGNQSRANAGYPAPASAGIFSPVAGPAAKKKANGADGGGGGKDLHMFVWSSSASPVSEGGIHVFRGGEYGGTTELRIGANPKDYDDFGRDGFSFGNKPGSNGAEHDGPVLSKLGSSSTAELNPKAPVDTKATTMPPTSVMTRLILIMVWRKLIRNPNTYSSLIGLTWSLVSFKWHVEMPAIVAKSIAILSDAGLGMAMFSLGLFMALQPRIIACGKSVAAFSMAVRFLTGPAVMAAASIVVGLRGVLLHIAIVQASLPQGIVPFVFAKEYNVHPDILSTGVIFGMLIALPITLVYYILLGL

SEQ ID NO: 19996 - protein, 589 aa, Daucus carota
MITLTDFYHVLTAVVPLYVAMILAYGSVKWWKIFTPDQCSGINRFVALFAVPLLSFHFISTNNPYTMNFRFIAADTLQKLIVLGVLAIWSRTSSRGSLEWSITLFSLSTLPNTLVMGIPLLKGMYGEASGSLMVQIVVLQCIIWYTLMLFLFEYRGARLLIAEQFPDNANSIISFRVDSDVLSLDGKEPLQTEAEVGEDGKIHVTVRKSASSRSEIFSRRSHGHHSGVSYTPRPSNLSNAEIYSLQSSRNPTPRGSSFNHSDIYSMMNGKNATNASPRQSNFGNLGFDETKGNGAYGQGNAGYPAPPSAGIFSPVSGPGAKKKANGADGGKDLHMFVWSSSASPVSEGGIHVFRGGEYGNDLNGAAHAKDYDEFRRDEFSFENRQVQIGVEREGPMLPKLGSSSAELNPKSLANGEIKPVPMPPTSVMTRLILIMVWRKLIRNPNTYSSLFGLTWSLVCYKWDVEMPAIIAKSIAILSDAGLGMAMFSLGLFMALQPRIIACGNKVATFAMAVRFLMGPAVMAASSIVVGLRGVLLHIAIVQAALPQGIVPFVFAKEYNVHPDILSTGVIFGMLIALPITLVYYILLMV

SEQ ID NO: 19997 - protein, 588 aa, Citrus clementina
MISATDLYHVLTAVVPLYVAMILAYGSVKWWKIFTPDQCSGINRFVALFAVPLLSFHFISTNDPYSMNFKFILADTVQKIIVLLLLAIWSKLSSSGSLEWSITLFSLSTLPNTLVMGIPLLKGMYGDYSGSLMVQIVVLQCIIWYTLMLFLFEYRGARMLIAEQFPDTAGSIISFKVDSDIISLDGKEPLQTEAEVGEDGKLHVTVRKSASSRSEIFSRRSHGPNSGVSLTPRPSNLTNCEIYSLQSSRNHTPRGSSFNHTDVFSMVNGKNMSNVSPRQSNFGNLGFDEENGVGVFGNVNRANGGPYPVPTTAGIFSPVSGAMRKANGAENGKDLHMFVWSSSASPVSEGGLHVFRGGDDLGGVHQKDYGEFGRDEFSFGNRPVTNGVENEGPVLSKLGSSSTTELNPKSVAQGEPKPTAMPPTSVMTRLILIMVWRKLIRNPNTYSSLIGLTWSLVCFRWHVEMPAIIARSIAILSDAGLGMAMFSLGLFMALQPRIIACGNTIATFAMGVRFLVGPAVMAAASMAVGLRGSLLHVAIVQAALPQGIVPFVFAKEYNVHPDILSTAVIFGMLVALPITLVYYILLGL

SEQ ID NO: 19998 - protein, 599 aa, Eucalyptus grandis
MIKASDLYHVLTAVVPLYVAMILAYGSVKWWKIFSPDQCSGINRFVALFAVPLLSFHFISLNNPYKMNYRFIAADTLQKLIVLAVLAVWSRVSRRGSLEWSITLFSLSTLPNTLVMGIPLLQGMYGPESKSLMVQIVVLQCIIWYTLMLFLFEYRGARLLIAEQFPDTAASIISFRVDSDIISLDGKEPLQTEAAVGDDGKLHVTVRKSTSSRSEVFSRRSHGPNSGLSLTPRPSNLTNAEIYSLQSSRNPTPRGSSFNHTDFYSMVNGKGMSGVSPRQSNFGGLGFDEESGVPPVYGNGARANGGGAYPAPPNAGIFSPVAAAAAKKKGGDGKDLHMFVWSSSASPVSEGGLHVFRGGGDYGNELGVGGGGGVAHQKDYDEFGRDEFSFGNRQVPNGVDRDGPVLSKLGSSSTAELHPKAAVDGEAKLTSMPPASVMTRLILIMVWRKLIRNPNTYSSLFGLTWSLVSCRWNLAMPAIIGKSIAILSDAGLGMAMFSLGLFMALQPRIIACGNSIAAFSMAVRFLTGPAVMAAASIAVGLKHNLLHIAIVQAALPQGIVPFVFAKEYNVHPDILSTGVIFGMLIALPITLVYYIFLQL

SEQ ID NO: 19999 - protein, 590 aa, Conyza canadensis
MITGSDLYHVLTAVVPLYVAMILAYGSVKWWKIFTPDQCSGINRFVALFAVPLLSFHFISTNNPYTMNTRFIAADTLQKLMVLVVLAFWSRLSARGSLEWSITLFSLSTLPNTLVMGIPLLKGMYGDFSGSLMVQIVVLQCIIWYTLMLFLFEYRGARLLIAEQFPDTAGSIISFRVDSDILSLDGKEPLQTEAEVGDDGKLHVTVRKSSSSRSEIFSRRGSHGGIHTGVSITPRPSNLTNAEIYSLQSSRNPTPRGSSFNHTDFYSMVNGKNGVSPRGSNFGGYDEESGTINNVRVANGQGSAGYPGPNAGIFSPVTGPAAKKKGGDGGKDLHMFVWSSSASPVSEGGIHVFRGGEYGNDLGSVPHTKDYEDFGRNEFSFENQPGPNGVDREASVLSKLGSSSTAELHPKASPHGDAKATSMPPASVMTRLILIMVWRKLIRNPNTYSSLIGLTWSLVSFKWHVEMPAIVAKSIAILSDAGLGMAMFSLGLFMALQPKIIACGNSIATFAMGVRFFIGPAVMAAASYAVGLQGALLHVAIVQAALPQGIVPFVFAKEYNVHPDILSTGVIFGMLIALPITLVYYILLGL

SEQ ID NO: 20000 - protein, 587 aa, Populus trichocarpa
MISLTDLYHVLTAVVPLYVAMILAYGSVKWWKIFSPDQCSGINRFVALFAVPLLSFHFISTNNPYAMNYRFIAADTLQKIIVLVVLAIWTRVISRGSLEWSITLFSLSTLPNTLVMGIPLLKGMYGEASGSLMVQIVVLQCIIWYTLMLFLFEYRGARILIGEQFPDTAGSIISFRVDSDILSLDGREPLQTDAEVGEDGKLHVTVRKSTSSRSDVFSRMSHGLNSGLSMTPRPSNLTNAEIYSLQSSRNPTPRASSFNHTDFYSKNASNASPRHSNFSNLQFDEESGGLGVFGNVPRANGSAYPTPPNAGIFSPGGKKKANGTENGKDLHMFVWSSSASPVSEGGLHVFRGGDYGNDLGGVANQKDYEEFGRDEFSFGNRPVPNGVDRDGPVLSKLASSSTAELHPKSAANGEPKPTAMPPTSVVTRLILIMVWRKLIRNPNTYSSLIGLTWSLVSFKWDLEMPQIIAHSISILSDAGLGMAMFSLGLFMALQPRIIACGNSVAAFAMSVRFLTGPAVMAAASFAVGLRGVLLHIAIVQSALPQGIVPFVFAKEYNVHPDILSTGVIFGMLIALPITLVYYILLGL

SEQ ID NO: 20001 - protein, 591 aa, Petroselinum crispum
MITLSDFYHVLTAVVPLYVAMILAYGSVKWWKIFTPDQCSGINRFVALFAVPLLSFHFISTNNPYAMNFRFIAADTLQKLIVLGVLAVWSRVSARGSLEWSITLFSLSTLPNTLVMGIPLLKGMYGEASGSLMVQIVVLQCIIWYTLMLFLFEYRGARLLIAEQFPDNAAMISSFRVDNDVLSLDGKEPLQTEAEVGEDGKIHVTVRKSTSSRSEIFSRMSHGPHSGVSLTPRPSNLTNAEIYSLQSSRNPTPRGSSFNHNDIYSVMNGKNASNVSPRQSNYGNLGFDEESGAGGYGSHTKGNVAYPAPPSAGIFSPVAGPGAKKKANGADGGKDLHMFVWSSSASPVSEGGIHVFRGGEYGNGLNGVPHAKDYDEYRRDEFSFGNKQNGVEREGPMLSKLGSSSTTELHPKSLANMEIKATAMPPASVITRLILIMVWRKLIRNPNTYSSVIGLTWSLVSYKWDVEMPAIIAKSIAILSDAGLGMAMFSLGLFMALQPRIIACGNSVATFAMAVRFLTGPAVMAASSIAVGLRGVLLHIAIVQAALPQGIVPFVFAKEYNVHPDILSTGVIFGMLIALPITLVYYILLMV

SEQ ID NO: 20002 - protein, 594 aa, Solanum phureja
MISLSDLYHVLTAVVPLYVAMILAYGSVKWWKIFSPDQCSGINRFVALFAVPLLSFHFIASNNPYAMNYRFIAADTLQKIIVLFVLAIWSRVSSRGSLEWSITLFSLSTLPNTLVMGIPLLKGMYGDASGSLMVQIVVLQCIIWYTLMLFLFEYRGARMLIAEQFPDTGGSIISFKVDSDIISLDGKEPLETQAEVGDDGKLHVTVRKSTSSRSEIFSRRSHGPNSGLSLTPRPSNLTNAEIYSLQSSRNPTPRGSSFNHTDFYSMVNGKNANMSPRNSNFGNYGHDEESGVAGFGRGNGVYGQGNAGYPAPTNAGIFSPATGPVTKKKANGGTEGGKDLHMFVWSSSASPVSEGGIHVFRGGGDYGNELGVGAHPKDYDEFGREEFTFGNKQNLNGNDREGPVVRSSSTTELRPKIAQEETKATAMPPASVMTRLILIMVWRKLIRNPNTYSSLIGLTWSLVSFKWNVQMPAIIAKSISILSDAGLGMAMFSLGLFMALSPRIIACGKTIALFSMGVRFLTGPAVMAAASIAVGLRGVLLHIAIVQAALPQGIVPFVFAKEYGVHPDILSTGVIFGMLVALPITLVYYILLGL

SEQ ID NO: 20003 - protein, 594 aa, Solanum lycopersicum
MISLSDLYHVLTAVVPLYVAMILAYGSVKWWKIFSPDQCSGINRFVALFAVPLLSFHFIASNNPYAMNYRFIAADTLQKIIVLFVLAIWSRVSSRGSLEWSITLFSLSTLPNTLVMGIPLLKGMYGDASGSLMVQIVVLQCIIWYTLMLFLFEYRGARMLIAEQFPDTGGSIISFKVDSDIISLDGKEPLETQAEVGDDGKLHVTVRKSTSSRSEIFSRRSHGPNSGLSLTPRPSNLTNAEIYSLQSSRNPTPRGSSFNHTDFYSMVNGKNANMSPRNSNFGNYGHDEESGVAGFGRGNGVYGQGNAGYPAPTNAGIFSPATGPVTKKKANGGTEGGKDLHMFVWSSSASPVSEGGIHVFRGGGDYGNELGVGAHPKDYDEFGREEFTFGNKQNLNGNDREGPVVRSSSTTELRPKIAQEETKATAMPPASVMTRLILIMVWRKLIRNPNTYSSLIGLTWSLVSFKWNVQMPAIIAKSISILSDAGLGMAMFSLGLFMALSPRIIACGKTIAIFSMGVRFLTGPAVMAAASIAVGLRGVLLHIAIVQAALPQGIVPFVFAKEYGVHPDILSTGVIFGMLVALPITLVYYILLGL

SEQ ID NO: 20004 - protein, 592 aa, Nicotiana benthamiana
MISLSDLYHVLTAVVPLYVAMILAYGSVKWWKIFTPDQCSGINRFVALFAVPLLSFHFIASNNPYAMNYRFIAADTLQKIIVLFVLAIWSRASSRGSLEWSITLFSLSTLPNTLVMGIPLLKGMYGEASGSLMVQIVVLQCIIWYTLMLFLFEYRGARMLIAEQFPDTAGDIISFKVDSDIISLDGKEPLETQAEVGEDGKLHVTVRKSTSSRSEIFSRKSHGGLNSGLSLTPRPSNLTNAEIYSLQSSRNPTPRGSSFNHTDFYSMVNGKNANMSPRTSNFGNFGFDEESGTAGFGRGNGVYGQGNAGYPAPTNAGIFSPATGPVTKKKANGAEGGKDLHMFVWSSSASPVSEGGIHVFRGGDYGNELGVGAHPKDYDEFGREEFTFGNKQNLNGNEGPVLSKIGSTTELRPKISQEEIKATALPPASVMTRLILIMVWRKLIRNPNTYSSIIGLTWSLVSFKWNVQMPAIIAKSISILSDAGLGMAMFSLGLFMALSPRIIACGNTVAAFSMGVRFLTGPAVMAAASIAVGLQGVLLHIAIVQAALPQGIVPFVFAKEYGVHPAILSTGVIFGMLVALPITLVYYILLGL

SEQ ID NO: 20005 - protein, 599 aa, Petroselinum crispum
MITLTDFYHVLTAVVPLYVAMILAYGSVKWWKIFTPDQCSGINRFVALFAVPLLSFHFISTNNPYTMNFRFIAADTLQKLIVLAVLAIWSRISSRGSLEWSITLFSLSTLPNTLVMGIPLLKGMYGDASGSLMVQIVVLQCIIWYTLMLFLFEYRGARLLIAEQFPDNANSIISFKVDSDVLSLDGKEPLQTEAELGEDGKIHVTVRKSTSSRSEIFSRRSHGHHSGVSYTPRPSNLSNAEIYSLQSSRNPTPRGSSFNHTDIYSMMNGKNASNVSPRQSNFGNLGFDESGGTGGFGNQSKGNVVYGQGNAEYPAPPSAGIFSPVSGPGAKKKANGIDGGKDLHMFVWSSSASPVSEGGIHVFRGGEYGNDLNGAAHAKDYDEFRRDEFSFENRQVQIGVEREVPMLPKLGSSSVELHPKSLTNGEIKPIAMPPTSVMTRLILIMVWRKLIRNPNTYSSLFGLAWSLVSYKWDVEMPAIIAKSIAILSDAGLGMAMFSLGLFMALQPRLIACGKKVATFSMAVRFLAGPAVMAGASIVVGLRGVLLHIAIVQAALPQGIVPFVFAKEYNVHPDILSTGVIFGMLIALPITLVYYILLMV

SEQ ID NO: 20006 - protein, 592 aa, Nicotiana benthamiana
MISLSDLYHVLTAVVPLYVAMILAYGSVKWWKIFTPDQCSGINRFVALFAVPLLSFHFIASNNPYAMNYRFIAADTLQKIIVLFVLAIWSRMSSRGSLEWSITLFSLSTLPNTLVMGIPLLKGMYGEASGSLMVQIVVLQCIIWYTLMLFLFEYRGARMLIAEQFPDTAGDIISFKVDSDIISLDGKEPLETQAEVGEDGKLHVTVRKSTSSRSEIFSRKSHGGLNSGLSLTPRPSNLTNAEIYSLQSSRNPTPRGSSFNHTDFYSMVNGKNANMSPRTSNFGNFGFDEESGTAGFGRGNGVYGQGNAGYPAPTNAGIFSPATGPVTKKKVNGAEGGKDLHMFVWSSSASPVSEGGIHVFRGGDYGNELGVGAHPKDYDEFGREEFTFGNKQNLNGNERPVLSKIGSTTELRPKIAQEEIKATALPPASVMTRLILIMVWRKLIRNPNTYSSIIGLTWSLVSFKWNVQMPAIIAKSISILSDAGLGMAMFSLGLFMALSPRIIACGNTVAAFSMGVRFLTGPAVMAAASIAVGLQGVLLHIAIVQAALPQGIVPFVFAKEYGVHPAILSTGVIFGMLVALPITLVYYILLGL

SEQ ID NO: 20007 - protein, 584 aa, Chrysanthemum coronarium
MITGSDLYHVFTAVVPLYVAMILAYGSVKWWKIFTPDQCSGINRFVALFAVPLLSFHFISTNNPYTMNTKFIAADTLQKLIVLVILGIWSRMSARGSLEWSITLFSLSTLPNTLVMGIPLLKGMYGDFSGSLMVQIVVLQCIIWYTLMLFLFEYRGARLLIAEQFPDTAGSIISFRVDSDILSLDGKEPLQTEAEVGDDGKLHVTVRKSTSSRSEVFSRSHGGMNTGVSLTPRPSNLTNAEIYSLQSSRNPTPRGSSFNHTDFFGMVKSGSGASPRSSNFGNNVGGDEETRVNGSQQGYPGPTSAGIFSPVAGKRKGGGGDGKDLHMFVWSSSASPVSERGIHVFRGGEYGSDLAGVPHTKDYDDFGRNEFSFGNQPGQNGADREASVLSKLGSSSTAELHPKAIPHGEIKATAMPPASVMTRLILIMVWRKLIRNPNTYSSLIGLTWSLVSFKWHVEMPAIVAKSIAILSDAGLGMAMFSLGLFMALQPKIIACGNSTATFTMVIRFLAGPAVMLAASMAVGLQGTLLHVAIVQAALPQGIVPFVFAKEYNVHPDILSTGVIFGMLIALPITLVYYIVLGLIK

SEQ ID NO: 20008 - protein, 584 aa, Mimulus guttatus
MISLTDLYHVLTAVVPLYVAMILAYGSVKWWKIFTPDQCSGINRFVALFAVPLLSFHFISSNNPYAMNYRFIAADTLQKLIVLAVLAVWSRTSARGSLEWSITLFSLSTLPNTLVMGIPLLKGMYGENSGTLMVQIVVLQCIIWYTLMLFLFEYRGARMLIAEQFPDTAASIISFRVDSDILSLDGKEPLQTEAEVGDDGKLHVTVRKSTSSRSEIFSRRSHGPNSGVSLTPRPSNLTNAEIYSLQSSRNPTPRGSSFNHTDFYSMVNGKNASNTNISPRQSNYGNFDEENGGYGNQPRQGNINTAYPAPASAGIFSPVAGPAAAAAAKKKPNGNEGGGKDLHMFVWSSSASPVSEGGIHVFRGGDYGNELNVGAHPKDYDDFGPDRNGPVLSKLGSSSTAELHPKNGGLDAKSTAMPPASVMTRLILIMVWRKLIRNPNTYSSLVGLTWSLVSYKWHVEMPAIIAKSISILSDAGLGMAMFSLGLFMALQPRIIACGKSVAAFSMAVRFLTGPAVMAAASIAVGLRGVLLHIAIVQAALPQGIVPFVFAKEYNVHPDILSTGVIFGMLVALPITLVYYILLGL

SEQ ID NO: 20009 - protein, 603 aa, Aquilegia formosa
MITGTDLYHVFTAVVPLYVAMILAYGSVKWWKIFSPDQCSGINRFVALFAVPLLSFHFISSNDPYHMNFRFIAADTLQKIIVLVVLAIWSRFSARGSLEWSITLFSLSTLPNTLVMGIPLLKGMYGDASGTLMVQIVVLQCIIWYTLMLFLFEYRGAKLLINEQFPDTAGSIISFRVDSDILSLDGKEPLQTEAEVGEDGKLHVTVRKSTSSRSEIFSRRSHGPNSTVSLTPRPSNLTNAEIYSLQSSRNPTPRGSSFNHTDFYSMVNGRNMNNASPRQSNFGNMGFDEESGLNGFSNPPSKANGVQGNAYPAPPSAGIFSPAAGPGAKKSTPNGTDGKDLHMFVWSSSASPVSQGGLHVYREFEHGGVAPQTAHHIDTHTKEYGEYGGDEFSFGNKKAGEVADRDGPTLSKLGSSSTTELHPKSGVHGDSKNTSMPPASVMTRLILIMVWRKLIRNPNTYSSLIGLTWSLVSFRWGIQMPIIIAKSISILSDAGLGMAMFSLGLFMALQPRIIACGKSVAAFSMAVRFLTGPAVMAAASITVGLRGVLLHIAIVQASLPQGIVPFVFAKEYNVHPDILSTGVIFGMLIALPITLVYYILLGL

SEQ ID NO: 20010 - protein, 591 aa, Nicotiana benthamiana
MISLSDLYHVLTAVVPLYVAMILAYGSVKWWKIFSPDQCSGINRFVALFAVPLLSFHFIASNNPYAMNYKFIAADTLQKVIVLVVLAIWSRISSRGSLEWSITLFSLSTLPNTLVMGIPLLKGMYGEASGSLMVQIVVLQCIIWYTLMLFLFEYRGARMLIAEQFPDTAGDIISFKIDSDVISLDGKEPLETQAEVGEDGKLHVTVRKSCSSRSEVFSRMSHGLNTGVSLTPRPSNLSNAEIYSLQSSRNPTPRGSSFNHTDLYSMVNGKSANMSPRTSNFGNMGFDEESGFGGRANGVYGQGNVGYPAPANAGIFSPATGPGAKKKANGTEGGKDLHMFVWSSNASPASEGGIHVFRGGECGNELGVGAHPKDYDDFGREEFTSSSKNPNGCDREGPVLKKLGSSSTVVLFPKTANDTKANAMPPASVMTRLILIMVWRKLVRNPNTYSSLIGLTWSLVSFRWNVEMPVIIAKSISILSDAGLGMAMFSLGLFMALQPRMIACGKTIASFSMAVRFITGPAVMAAASIAVGLRGVLLHIAIVQAALPQGIVPFVFAKEYNVHPDILSTGVIFGMLIALPITLVYYILLGL

SEQ ID NO: 20011 - protein, 596 aa, Cucumis sativus
MISVSDLYHVLTAVVPLYVAMILAYGSVKWWKIFSPDQCSGINRFVALFAVPLLSFHFISSNNPFSMNLRFIAADTLQKLIVLVALAVWSHLSSKGSLEWSITLFSLSTLPNTLVMGIPLLKGMYGDSTGTLMVQIVVLQCIIWYTLMLFLFEYRGARLLIAEQFPDTAGEIVSFRVDSDILSLDGKEPLQTEAEIGEDGKLRVVVRKSTSSRSEVFSRRSHGGGGGVSLTPRPSNLTNAEIYSLQSSRNPTPRGSSFNHSDFFLGNASPRHSNFGNFGNFDEENGGMKGRGISGNVNGIFPSANGYPAPASGGLFSPVTGPAATKKRNGGDGGKDLHMFVWSSSASPVSEGGINVFRSGDYDAPGAGGMNPKDFNEYGGDEFSFGNKSAVNGGGHDGGPVLSKLGSSSTAELHPKHGDDTAESKPTSMPPASVMTRLILIMVWRKLIRNPNTYSSLIGLAWSLISFRWNIAMPAIVARSIAILSDAGLGMAMFSLGLFMALQPKIIACGNTIASFAMAVRFITGPAVMAAASIAVGLRGVLLHIAIVQAALPQGIVPFVFAKEYNVHPDILSTGVIFGMLIALPITLVYYILLGL

SEQ ID NO: 20012 - protein, 598 aa, Citrullus lanatus
MISVSDLYHVLTAVVPLYVAMILAYGSVKWWKIFSPDQCSGINRFVALFAVPLLSFHFISTNNPFSMNLRFIAADTLQKLLVLAALAVWSHLSSKGSLEWSITLFSLSTLPNTLVMGIPLLKGMYGDSTGTLMVQIVVLQCIIWYTLMLFLFEYRGARLLIAEQFPDTAGEIVSFRVDSDILSLDGKEPLQTEAEIGEDGKLRVVVRKSTSSRSEVFSRRSHGGGGGVSLTPRPSNLTNAEIYSLQSSRNPTPRGSSFNHSDFFLGNASPRHSNFGNFDEESGGLKGRGISGNVNVNGVFPSSNGYPAPTSGGLFSPVTGPAAAAAKKRVNGGDGGKDLHMFVWSSSASPVSEGGINIFRSGDYDGAGAGGMNQKDFDEFGRDEFSFGNKSAVNGGGHDGGPVLSKLGSSSTAELHPKNGDDTAESKPTAMPPASVMTRLILIMVWRKLIRNPNTYSSLIGLAWSLISFRWNIVMPAIVARSIAILSDAGLGMAMFSLGLFMALQPKIIACGNTIASFAMAVRFITGPAVMAAASIAVGLRGVLLHIAIVQAALPQGIVPFVFAKEYNVHPDILSTGVIFGMLIALPITLVYYILLGL

SEQ ID NO: 20013 - protein, 597 aa, Phalaenopsis aphrodite
MITAADFYHVLTAVVPLYVAMILAYGSVKWWKIFSPDQCSGINRFVALFAVPLLSFHFISTNNPYAMNYRFIAADTLQKLIVLSALTFWANLSRRGCLEWAITLFSLSTLPNTLVMGIPLLKGMYGPDSGSLMVQIVVLQCIIWYTLMLFLFEYRGARLLIAEQFPDTAGSIISFRVDSDIISLDGKEPLQTEAEVGEDGKLRVTVRKSTSSRSEIFSRRSHGMNSVTPRPSNLTNAEIYSLQSSRNPTPRGSSFNHTDFYSMVNGKNLAGVSPRHSNFGNLGFDEEAPATRVNGVPAVYPPPPASGLFSPVGAKKKGNSCEGGKDLHMFVWSSSASPVSEGGIHVFRGGDFAGEHARVAQMGDHRHQKDGSDAYNEYSREDFSFRNQPTAHGADALERDMPSLSKLGSNSTTELHPKTGGGGELKPAAMPPTSVMTRLILIMVWRKLIRNPNTYSSLIGLTWSLVSFRWEIEMPAIIARSISILSDAGLGMAMFSLGLFMALQPRIIACGNGVASFAMAVRFVTGPAVMAAASIAVGLRGVLLHIAIVQAALPQGIVPFVFAKEYNVHPDILSTGVIFGMLIALPITLVYYILLGL

SEQ ID NO: 20014 - protein, 136 aa, Zea mays
MSSGGGRGKPKGSKAVSRSTKAGLQFPVGRIARYLKAGKYAERVGGGAPVYLSAVLEYLAAEVLELAGNAARDNKKNRIVPRHIQLAVRNDEELSKLLGAVTIAAGGVLPNIHQTLLPKKAGGKGKADIGSASQEF

SEQ ID NO: 20015 - protein, 136 aa, Cynodon dactylon
MSSGAGRGKAKGTKAVSRSSKAGLQFPVGRIARYLKVGKYAQRVGAGAPVYLSAVLEYLAAEVLELAGNAARDNKKNRIVPRHIQLAVRNDEELSRLLGAVTIAAGGVLPNIHQTLLPKKAGSKDKADIGSASQEF

SEQ ID NO: 20016 - protein, 136 aa, Pennisetum glaucum
MSSGGGRGKPKGTKAVSRSSKAGLQFPVGRIARYLKTGKYAERVGGGAPVYLSAVLEYLAAEVLELAGNAARDNKKNRIVPRHIQLAVRNDEELSKLLGAVTIAAGGVLPNIHQTLLPKKAGGKGKADIGSASQEF

SEQ ID NO: 20017 - protein, 136 aa, Avena sativa
MSSAGAGRGKAKGSKAVSRSSKAGLQFPVGRIARYLKIGKYAQRVGAGAPVYLSAVLEYLAAEVLELAGNAARDNKKNRIVPRHIQLAVRNDEELSRLLGAVTIAAGGVLPNIHTTLLPKKAGKAKGDIGSASQEF

SEQ ID NO: 20018 - protein, 136 aa, Sorghum bicolor
MSSVGGRGKPKGTKSVTRSAKAGLQFPVGRIARYLKAGKYAERVGGGAPVYLSAVLEYLAAEVLELAGNAARDNKKNRIVPRHIQLAVRNDEELSKLLGAVTIAAGGVLPNIHQTLLPKKAGGKGKADIGSASQEF

SEQ ID NO: 20019 - protein, 136 aa, Saccharum officinarum
MSSGGGRGKPKGTKAVTRSTKAGLQFPVGRIARYLKAGKYAERVGGGAPVYLSAVLEYLAAEVLELAGNAARDNKKNRIVPRHIQLAVRNDEELSKLLGAVTIAAGGVLPNIHQTLLPKKAGGKGKADIGSASQEF

SEQ ID NO: 20020 - protein, 136 aa, Saccharum officinarum
MSSGGGRGKPKGTKAVSRSSKAGLQFPVGRIARYLKTGKYAERVGGGAPVYLSAVLEYLAAEVLELAGNAARDNKKNRIVPRHIQLAVRNDEELSKLLGAVTIAAGGVLPNIHQTLLPKKAGGKGKAEIGSASQEF

SEQ ID NO: 20021 - protein, 137 aa, Oryza sativa
MSSSQGGGGRGKAKTTKAVSRSSKAGLQFPVGRIARYLKAGKYAERVGAGAPVYLSAVLEYLAAEVLELAGNAARDNKKNRIVPRHIQLAVRNDEELSRLLGTVTIAAGGVLPNIQQVLLPKKGGGKGDIGSASQEF

SEQ ID NO: 20022 - protein, 140 aa, Panicum virgatum
MSSGGGGGSGRGRAKGTKSVSRSSKAGLQFPVGRVARFLKTGKYAERVGGGAPVYLAAVLEYLAAEVLELAGNAARDNKKNRIVPRHIQLAVRNDEELSKLLGAVTIAAGGVLPNIHQTLLPKKAGGKGKADIGSASQEF

SEQ ID NO: 20023 - protein, 139 aa, Trifolium pratense
MSSTGTTKGGRGKPKAAKSVSRSSKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKTGKGKGDIGSASQEF

SEQ ID NO: 20024 - protein, 139 aa, Trifolium pratense
MSSTGTTKGGRGKPKAAKSVSRSSKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKVGKGKGDIGSASQEF

SEQ ID NO: 20025 - protein, 139 aa, Cyclamen graecum
MSSQGATKGGRGKPKATKSVSRSSKAGLQFPVGRIARFLKAGKYAERVGAGAPVYLSAVLEYLAAEVLELAGNAARDNKKNRIVPRHIQLAVRNDEELSKLLGAVTIANGGVLPNIHQNLLPKKTGKDKGDIGSASQEF

SEQ ID NO: 20026 - protein, 136 aa, Setaria italica
MSSSGGRGKPKGTKAVSRSSKAGLQFPVGRVARYLKTGKYAERVGGGAPVYLSAVLEYLAAEVLELAGNAARDNKKNRIVPRHIQLAVRNDEELSKLLGAVTIAAGGVLPNIHQTLLPKKAGGKGKADIGSASQEF

SEQ ID NO: 20027 - protein, 139 aa, Gnetum gnemon
MSSTGGAKGGRGKAKSSKSVSRSQKAGLQFPVGRIARFLKAGKYAERVGAGAPVYLAAVLEYLAAEVLELAGNAARDNKKNRIVPRHIQLAVRNDEELSKLLGAVTIANGGVLPNIHQVLLPKKAGKDKGDIGSASQEF

SEQ ID NO: 20028 - protein, 137 aa, Zea mays
MSSTGGGGRGKAKPATKSVSRSSKAGLQFPVGRIARYLKAGKYAERVGAGAPVYLSAVLEYLAAEVLELAGNAARDNKKNRIVPRHIQLAVRNDEELSKLLGTVTIAAGGVMPNIHQTLLPKKAGQKGDIGSASQEF

SEQ ID NO: 20029 - protein, 137 aa, Scabiosa columbaria
MSSPTKGGRGKPKSSKSVSRSSKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKVGKGKGEIGSASQEF

SEQ ID NO: 20030 - protein, 137 aa, Triticum aestivum
MSSAGGGRGKGKAVSKTVSRSSKAGLQFPVGRIARYLKIGKYAQRVGAGAPVYLSAVLEYLAAEVLELAGNAARDNKKTRIVPRHIQLAVRNDEELSRLLGAVTIAAGGVLPNIHTTLLPKKVGKGKGDIGSASQEF

SEQ ID NO: 20031 - protein, 141 aa, Euonymus alatus
MSSTGGGSTKGGRGKPKATKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKMGKGKGDIGSASQEF

SEQ ID NO: 20032 - protein, 140 aa, Manihot esculenta
MSSTGRPTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKMGKDKGDIGSASQEF

SEQ ID NO: 20033 - protein, 140 aa, Manihot esculenta
MSSTGGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGDIGSASQEF

SEQ ID NO: 20034 - protein, 140 aa, Citrus clementina
MSSTGGSTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGDIGSASQEF

SEQ ID NO: 20035 - protein, 140 aa, Cucumis sativus
  Sequence also found in Organisms: Cucumis melo, Citrullus lanatus
MSSTGGSTKGGRGKPKATKSVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKDKGDIGSASQEF

SEQ ID NO: 20036 - protein, 140 aa, Eucalyptus grandis
MSSKEGGKGGRGKPKATKSVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKTGGKGKGDIGSASQEF

SEQ ID NO: 20037 - protein, 140 aa, Jatropha curcas
MSSTGGSTKGGRGKPKSSKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKMGKGKGEIGSASQEF

SEQ ID NO: 20038 - protein, 140 aa, Citrus sinensis
MSSTGGSTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKMGKGKGDIGSASQEF

SEQ ID NO: 20039 - protein, 140 aa, Camellia sinensis
MSSGGGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGDIGSASQEF

SEQ ID NO: 20040 - protein, 137 aa, Hordeum vulgare
MSSAGGGRGKAKAASKIVSRSSKAGLQFPVGRIARYLKIGKYAQRVGAGAPVYLSAVLEYLAAEVLELAGNAARDNKKTRIVPRHIQLAVRNDEELSRLLGTVTIAAGGVLPNIHTTLLPKKVGKGKGDIGSASQEF

SEQ ID NO: 20041 - protein, 139 aa, Aristolochia fimbriata
MSSAGSTKGGRGKPKSSKSVSRSQKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKQGKGKGEPGSASQEF

SEQ ID NO: 20042 - protein, 139 aa, Cicer arietinum
MSSTATTKGGRGKPKASKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGEIGSASQEF

SEQ ID NO: 20043 - protein, 136 aa, Echinochloa colona
MSSGGGRGRAKGTKSVTRSAKAGLQFPVGRVARYLKTGKYAERVGGGAPVYLSAVLEYLAAEVLELAGNAARDNKKNRIVPRHIQLAVRNDEELSKLLGAVTIAAGGVLPNIHQTLLPKKAGGKGKADIGSASQEF

SEQ ID NO: 20044 - protein, 135 aa, Festuca arundinacea
MSSAGGRGKAKGSKSTTRSSKAGLQFPVGRIARYLKIGKYAQRVGAGAPVYLSAVLEYLAAEVLELAGNAARDNKKTRIVPRHIQLAVRNDEELSKLLGAVTIAAGGVLPNIHTTLLPKKAGKAKGDIGSASQEF

SEQ ID NO: 20045 - protein, 137 aa, Secale cereale
MSSAGSGRGKGKAVSKTVSRSSKAGLQFPVGRIARYLKIGKYAQRVGAGAPVYLSAVLEYLAAEVLELAGNAARDNKKTRIVPRHIQLAVRNDEELSRLLGAVTIAAGGVLPNIHTTLLPKKVGKGKGDIGSASQEF

SEQ ID NO: 20046 - protein, 137 aa, Sorghum bicolor
MSSTGGGGRGKAKPATKSVSRSSKAGLQFPVGRIARYLKAGKYAERVGAGAPVYLSAVLEYLAAEVLELAGNAARDNKKNRIVPRHIQLAVRNDEELSKLLGTVTIAAGGVMPNIHSTLLPKKAGQKGDIGSASQEF

SEQ ID NO: 20047 - protein, 136 aa, Panicum virgatum
MSSGGGRGRAKGTKSVSRSSKAGLQFPVGRVARFLKTGKYAERVGGGAPVYLAAVLEYLAAEVLELAGNAARDNKKNRIVPRHIQLAVRNDEELSKLLGAVTIAAGGVLPNIHQTLLPKKAGGKGKADIGSASQEF

SEQ ID NO: 20048 - protein, 136 aa, Panicum virgatum
MSSGAGRGKPKGTKAVSRSSKAGLQFPVGRVARYLKTGKYAERVGGGAPVYLSAVLEYLAAEVLELAGNAARDNKKNRIVPRHIQLAARNDEELSKLLGAVTIAAGGVLPNIHQTLLPKKAGGKGKADIGSASQEF

SEQ ID NO: 20049 - protein, 139 aa, Trigonella foenum-graecum
MSSTGTTKGGRGKPKAAKSVSRSSKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKVGKGKGEIGSASQEF

SEQ ID NO: 20050 - protein, 139 aa, Vicia sativa
MSSTATTKGGRGKSKAAKSVSRSSKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPKKVGKGKEEIGSASQEF

SEQ ID NO: 20051 - protein, 142 aa, Eucalyptus grandis
MSSKEGGGGGKGGRGKPKSSKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKMGKGKGDIGSASQEF

SEQ ID NO: 20052 - protein, 141 aa, Euonymus alatus
MSSTGAGSTKGGRGKPKATKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKLGKGKGDIGSASQEF

SEQ ID NO: 20053 - protein, 141 aa, Olea europaea
MSSTGGASTKGGRGKPKASKSVSRSSKAGLQFPVGRIARFLKAGKYAERVGAGAPVYLSAVLEYLAAEVLELAGNAARDNKKNRIVPRHIQLAVRNDEELSKLLGNVTIANGGVLPNIHQNLLPKKAGGKDKEIGSASQEF

SEQ ID NO: 20054 - protein, 141 aa, Sesamum indicum
MSSNAAASTKGGRGKPKSSKSVSRSSKAGLQFPVGRIARFLKAGKYAERVGAGAPVYLSAVLEYLAAEVLELAGNAARDNKKNRIVPRHIQLAVRNDEELSKLLGNVTIANGGVLPNIHQTLLPKKAGGKDKEIGSASQEF

SEQ ID NO: 20055 - protein, 141 aa, Tripterygium wilfordii
MSSTGGGSTKGGRGKPKATKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKMGKGKGEIGSASQEF

SEQ ID NO: 20056 - protein, 140 aa, Glycine max
  Sequence also found in Organisms: Cajanus cajan
MSSTGGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKAGKGKGEIGSASQEF

SEQ ID NO: 20057 - protein, 140 aa, Glycine max
  Sequence also found in Organisms: Phaseolus vulgaris, Vigna unguiculata, Glycyrrhiza uralensis
MSSTGGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGEIGSASQEF

SEQ ID NO: 20058 - protein, 140 aa, Aquilegia formosa
MSTKETTKGGRGKPKASKSVSRSSKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKAGKGKGAEIGSASQEF

SEQ ID NO: 20059 - protein, 140 aa, Theobroma cacao
MSSTGASTKGGRGKPKSSKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKMGKGKGDIGSASQEF

SEQ ID NO: 20060 - protein, 140 aa, Gossypium hirsutum
MSSTGGSTKGGRGKPKASKSVSRSHKAGLQFPVGRIARFLKAGKYAERVGAGAPVYLSAVLEYLAAEVLELAGNAARDNKKTRIVPRHIQLAVRNDEELSKLLGSVTIANGGVLPNIHQTLLPKKMGKDKGEIGSASQEF

SEQ ID NO: 20061 - protein, 140 aa, Euphorbia peplus
MSSTGGSTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKAGASKGDIGSASQEF

SEQ ID NO: 20062 - protein, 140 aa, Euphorbia peplus
MSSTGGSTKGGRGKPKSAKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKAGASKGDIGSASQEF

SEQ ID NO: 20063 - protein, 140 aa, Panax ginseng
MSSKEGSTKGGRGKPKSSKSVTRSSKAGLQFPVGRIARFLKNGKYAERVGAGAPVYLSAVLEYLAAEVLELAGNAARDNKKNRIVPRHIQLAVRNDEELSKLLGAVTIANGGVLPNIHQNLLPKKVGKDKGDIGSASQEF

SEQ ID NO: 20064 - protein, 140 aa, Gossypium raimondii
MSSTGGSAKGGRGKPKSSKAVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKMGKGKGDIGSASQEF

SEQ ID NO: 20065 - protein, 140 aa, Sarracenia psittacina
MSSGGGSTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGEIGSASQEF

SEQ ID NO: 20066 - protein, 139 aa, Pinus taeda
MSSAGGGGGRGKAKSSKSVSRSHKAGLQFPVGRIARFLKSGKYAERVGAGAPVYMAAVLEYLAAEVLELAGNAARDNKKNRIVPRHIQLAVRNDEELSKLLGAVTIANGGVLPNIHGVLLPKKVGKGKGDEIGSASQEF

SEQ ID NO: 20067 - protein, 139 aa, Aquilegia formosa
MSSGGSTKGGRGKPKSAKSVSRSSKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPKKTGKGKDDILSASQEF

SEQ ID NO: 20068 - protein, 139 aa, Musa acuminata
MSSAAPAKGGRGKAKSSKSVSRSQKAGLQFPVGRIARFLKAGKYAERVGAGAPVYLAAVLEYLAAEVLELAGNAARDNKKNRIVPRHIQLAVRNDEELSKLLGAVTIASGGVLPNIHQTLLPSKAGKGKGDIGSASQEF

SEQ ID NO: 20069 - protein, 139 aa, Manihot esculenta
MSSAGSTKGGRGKPKSSKSVSRSQKAGLQFPVGRIARFLKAGKYADRVGAGAPVYLSAVLEYLAAEVLELAGNAARDNKKNRIVPRHIQLAVRNDEELSKLLGTVTIANGGVLPNIHQNLLPKKIGKGKGDIGSASQEF

SEQ ID NO: 20070 - protein, 139 aa, Cocos nucifera
MSSTASTKGGRGKPKSSKSVSRSQKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPKKAGKEKGDLGSASQEF
